US012551560B2

(12) United States Patent
Oakes et al.

(10) Patent No.: US 12,551,560 B2
(45) Date of Patent: Feb. 17, 2026

(54) COMPOSITIONS AND METHODS FOR USE IN IMMUNOTHERAPY

(71) Applicant: Scribe Therapeutics Inc., Alameda, CA (US)

(72) Inventors: Benjamin Oakes, El Cerrito, CA (US); Sean Higgins, Alameda, CA (US); Hannah Spinner, Boston, MA (US); Sarah Denny, San Francisco, CA (US); Brett T. Staahl, Tiburon, CA (US); Kian Taylor, Atlanta, GA (US); Katherine Baney, Berkeley, CA (US); Isabel Colin, Oakland, CA (US); Maroof Adil, Davis, CA (US); Cole Urnes, Los Alamitos, CA (US)

(73) Assignee: Scribe Therapeutics Inc., Alameda, CA (US)

( * ) Notice: Subject to any disclaimer, the term of this patent is extended or adjusted under 35 U.S.C. 154(b) by 1010 days.

(21) Appl. No.: 17/641,404

(22) PCT Filed: Sep. 9, 2020

(86) PCT No.: PCT/US2020/050008
§ 371 (c)(1),
(2) Date: Mar. 8, 2022

(87) PCT Pub. No.: WO2021/050601
PCT Pub. Date: Mar. 18, 2021

(65) Prior Publication Data

US 2023/0081117 A1 Mar. 16, 2023

Related U.S. Application Data

(60) Provisional application No. 63/075,041, filed on Sep. 4, 2020, provisional application No. 62/897,947, filed on Sep. 9, 2019.

(51) Int. Cl.

| | |
|---|---|
| ***A61K 45/06*** | (2006.01) |
| ***A61K 40/11*** | (2025.01) |
| ***A61K 40/31*** | (2025.01) |
| ***A61K 40/32*** | (2025.01) |
| ***A61K 40/42*** | (2025.01) |
| ***A61K 48/00*** | (2006.01) |
| ***C07K 14/705*** | (2006.01) |
| ***C07K 14/715*** | (2006.01) |
| ***C07K 14/725*** | (2006.01) |
| ***C12N 9/22*** | (2006.01) |
| ***C12N 15/11*** | (2006.01) |

(52) U.S. Cl.

CPC .............. *A61K 45/06* (2013.01); *A61K 40/11* (2025.01); *A61K 40/31* (2025.01); *A61K 40/32* (2025.01); *A61K 40/4211* (2025.01); *A61K 48/005* (2013.01); *C07K 14/7051* (2013.01); *C07K 14/70517* (2013.01); *C07K 14/70521* (2013.01); *C07K 14/70578* (2013.01); *C07K 14/70596* (2013.01); *C07K 14/7151* (2013.01); *C12N 9/22* (2013.01); *C12N 15/11* (2013.01)

(58) Field of Classification Search

CPC ....................................................... C12N 9/22
See application file for complete search history.

(56) References Cited

U.S. PATENT DOCUMENTS

| | | | |
|---|---|---|---|
| 5,199,942 | A | 4/1993 | Gillis |
| 5,405,783 | A | 4/1995 | Pirrung et al. |
| 5,412,087 | A | 5/1995 | McGall et al. |
| 5,445,934 | A | 8/1995 | Fodor et al. |
| 5,641,870 | A | 6/1997 | Rinderknecht et al. |
| 5,695,937 | A | 12/1997 | Kinzler et al. |
| 6,410,319 | B1 | 6/2002 | Raubitschek et al. |
| 6,451,995 | B1 | 9/2002 | Cheung et al. |
| 7,070,995 | B2 | 7/2006 | Jensen |
| 7,265,209 | B2 | 9/2007 | Jensen |
| 7,354,762 | B2 | 4/2008 | Jensen |
| 7,446,179 | B2 | 11/2008 | Jensen |
| 7,446,190 | B2 | 11/2008 | Sadelain et al. |
| 7,446,191 | B2 | 11/2008 | Jensen |
| 8,324,353 | B2 | 12/2012 | Jensen |
| 8,339,645 | B2 | 12/2012 | Nakawaki |

(Continued)

FOREIGN PATENT DOCUMENTS

| | | | |
|---|---|---|---|
| CN | 109312336 | A | 2/2019 |
| CN | 109688820 | A | 4/2019 |

(Continued)

OTHER PUBLICATIONS

US 8,252,592 B2, 08/2012, Sadelain et al. (withdrawn)

(Continued)

*Primary Examiner* — Christopher M Babic
*Assistant Examiner* — Jennifer S Spence
(74) *Attorney, Agent, or Firm* — COOLEY LLP

(57) ABSTRACT

Provided herein are CasX:gNA systems, and compositions and methods relating thereto, the systems comprising CasX proteins, guide nucleic acids (gNAs), and optionally donor template nucleic acids useful for the modification cell genes encoding proteins involved in antigen processing, antigen presentation, antigen recognition, and/or antigen response, as well as methods of producing and using populations of cells comprising these modified genes. In some embodiments, the modified cells further express chimeric antigen receptors (CAR) or engineered T cell receptors (TCR). Such systems are useful for preparing cells for immunotherapy.

37 Claims, 321 Drawing Sheets

Specification includes a Sequence Listing.

(56) References Cited

U.S. PATENT DOCUMENTS

| | | | |
|---|---|---|---|
| 8,398,282 B2 | 3/2013 | Kuhlman et al. | |
| 8,479,118 B2 | 7/2013 | Lyndersay et al. | |
| 9,855,297 B2 | 1/2018 | Duchateau et al. | |
| 9,890,393 B2 | 2/2018 | Duchateau et al. | |
| 10,570,415 B2 | 2/2020 | Doudna et al. | |
| 11,013,767 B2 | 5/2021 | Terrett et al. | |
| 11,560,555 B2 | 1/2023 | Oakes et al. | |
| 11,795,472 B2 | 10/2023 | Doudna et al. | |
| 11,873,504 B2 | 1/2024 | Doudna et al. | |
| 12,084,692 B2 | 9/2024 | Oakes et al. | |
| 12,163,125 B2 | 12/2024 | Vijayakumar et al. | |
| 2002/0131960 A1 | 9/2002 | Sadelain et al. | |
| 2013/0149337 A1 | 6/2013 | Cooper et al. | |
| 2013/0287748 A1 | 10/2013 | June et al. | |
| 2017/0369870 A1 | 12/2017 | Gill et al. | |
| 2018/0100158 A1 | 4/2018 | Del'guidice et al. | |
| 2018/0141992 A1 | 5/2018 | Cowan et al. | |
| 2018/0258424 A1 | 9/2018 | Greenberg et al. | |
| 2018/0325955 A1 | 11/2018 | Terrett et al. | |
| 2018/0362975 A1 | 12/2018 | Chen et al. | |
| 2019/0024075 A1 | 1/2019 | Gourguechon et al. | |
| 2019/0136230 A1 | 5/2019 | Sather et al. | |
| 2020/0181608 A1 | 6/2020 | Peng et al. | |
| 2020/0216805 A1 | 7/2020 | Yuan et al. | |
| 2020/0407737 A1* | 12/2020 | Hummel | C12N 9/22 |
| 2022/0081681 A1 | 3/2022 | Oakes et al. | |
| 2022/0220508 A1 | 7/2022 | Oakes et al. | |
| 2024/0026385 A1 | 1/2024 | Vijayakumar et al. | |
| 2024/0167052 A1 | 5/2024 | Doudna et al. | |
| 2024/0376462 A1 | 11/2024 | Vijayakumar et al. | |
| 2025/0011756 A1 | 1/2025 | Vijayakumar et al. | |
| 2025/0043262 A1 | 2/2025 | Oakes et al. | |
| 2025/0136962 A1 | 5/2025 | Oakes et al. | |

FOREIGN PATENT DOCUMENTS

| | | | | |
|---|---|---|---|---|
| CN | 110023494 A | 7/2019 | | |
| EP | 3 441 461 A1 | 2/2019 | | |
| KR | 10-2018-0051625 A | 5/2018 | | |
| WO | WO-2010/075303 A1 | 7/2010 | | |
| WO | WO-2012/068627 A1 | 5/2012 | | |
| WO | WO-2012/129514 A1 | 9/2012 | | |
| WO | WO-2013/071154 A1 | 5/2013 | | |
| WO | WO-2013/123061 A1 | 8/2013 | | |
| WO | WO-2013/126726 A1 | 8/2013 | | |
| WO | WO-2013/166321 A1 | 11/2013 | | |
| WO | WO-2014/031687 A1 | 2/2014 | | |
| WO | WO-2014/165707 A2 | 10/2014 | | |
| WO | WO-2014/165707 A3 | 10/2014 | | |
| WO | WO-2017/068077 A1 | 4/2017 | | |
| WO | WO-2018/064371 A1 | 4/2018 | | |
| WO | WO-2018/068135 A1 | 4/2018 | | |
| WO | WO-2018/132783 A1 | 7/2018 | | |
| WO | WO-2018/152418 A1 | 8/2018 | | |
| WO | WO-2018/195555 A1 | 10/2018 | | |
| WO | WO-2019/046285 A1 | 3/2019 | | |
| WO | WO-2019/051278 A1 | 3/2019 | | |
| WO | WO-2019084148 A1 * | 5/2019 | | C12N 15/102 |
| WO | WO-2019/118516 A1 | 6/2019 | | |
| WO | WO-2019/152519 A1 | 8/2019 | | |
| WO | WO-2020/023529 A1 | 1/2020 | | |
| WO | WO-2020/041456 A1 | 2/2020 | | |
| WO | WO-2020041387 A1 * | 2/2020 | | C12N 9/90 |
| WO | WO-2020/247882 A1 | 12/2020 | | |
| WO | WO-2021/050601 A1 | 3/2021 | | |

OTHER PUBLICATIONS

Aguilera, T.A. et al. (Jun. 2009). "Systemic in vivo distribution of activatable cell penetrating peptides is superior to that of cell penetrating peptides," Integr. Biol. (Camb) 1(5-6):371-381. Published online May 11, 2009.

Al-Lazikani, B. et al. (1997). "Standard conformations for the canonical structures of immunoglobulins," JMB 273:927-948.

Altschul, S.F. et al. (1990). "Basic local alignment search tool," J. Mol. Biol, 215:403-410.

Barrett, D.M. et al. (2015). "Chimeric antigen receptor and TCR Modified T cells Enter Main Street and Wall Street," J. Immunol. 195:755-761.

Bird, R.E. et al. (1988). "Single-chain antigen-binding proteins," Science 242:423-426.

Burstein, D. et al. (Feb. 2017). "New CRISPR-Cas systems from uncultivated microbes," Nature 542:237-241. Published online Dec. 22, 2016, with Supplemental Materials, 28 total pages.

Chen, B. et al. (2003). "Influence of histidine on the stability and physical properties of a fully human (antibody in aqueous and solid forms," Pharm. Res. 20:1952-1960.

Genbank Accession No. BAG36664.1 (2008). Unnamed protein product (*Homo sapiens*), 2 total pages.

Genbank Accession No. AAA62478.2 (1999). Induced by lymphocyte activation; similar to human receptor protein encoded by GenBank accession No. U03397 (*Homo sapiens*), 2 total pages.

Ghirlando, R. et al. (1999). "Glycosylation of human IgG-Fc: influences on structure revealed by differential scanning microcalorimetry," Immunol Letters 68:47-52.

Huston, J.S. et al. (1988). "Protein engineering of antibody binding sites: Recovery of specific activity in an anti-digoxin single-chain Fv analogue produced in *Escherichia coli*," PNAS 85:5879-5883.

International Search Report mailed on Feb. 10, 2021, for PCT Application No. PCT/US2020/050008, filed on Sep. 9, 2020, 11 pages.

Kotin, R.M. (1994). "Prospects for the use of adeno-associated virus as a vector for human gene therapy," Human Gene Therapy 5:793-801.

Kamiya, T. et al. (2018). "A novel method to generate T-cell receptor-deficient chimeric antigen receptor T cells," Blood Advances 2:517-528.

Liu, J.J. et al. "CasX enzymes comprise a distinct family of RNA-guided genome editors," Nature 566:218-223. Published online Feb. 4, 2019.

Liu, J.J. et al. CasX enzymes comprise a distinct family of RNA-guided genome editors, Nature 568:E8-E10. (Author correction: published online Apr. 3, 2019).

Mandal, P.K. et al. (2014). "Efficient ablation of genes in human hematopoietic stem and effector cells using CRISPR/Cas9," Cell Stem Cell. 15:643-652.

Murray, A. et al. (2002). "Epitope Affinity Chromatography and Biophysical Studies of Monoclonal Antibodies and Recombinant Antibody Fragments," J. Chromatogr Sci 40:343-349.

Noguchi, H. et al. (Jul. 2003). "PDX-1 protein containing its own antennapedia-like protein transduction domain can transduce pancreatic duct and islet cells," Diabetes 52:1732-1737.

Qi, L.S. et al. (Feb. 2013). "Repurposing CRISPR as an RNA-guided platform for sequence-specific control of gene expression," Cell 152:1173-1183.

Razeghian, E. et al. (2021). "A deep insight into CRISPR/Cas9 application in CAR-T cell-based tumor immunotherapies," Stem Cell Research & Therapy 12:428, 17 total pages.

Ren, J. et al. (2016). "Multiplex Genome Editing to Generate Universal CAR T Cells Resistant to PD1 Inhibition," Clinical Cancer Research 23:2255-2266.

Roberson, E.D.O. et al. (2019). "A catalog of CasX genome editing sites in common model organisms," BMC Genomics 20:1-5.

Roth, T.L. et al. (2018). "Reprogramming human T cell function and specificity with non-viral genome targeting," Nature 559(7714):405-409, with Extended Data, 41 total pages.

Rupp, L.J. et al. (2017). "CRISPR/Cas9-mediated PD-1 disruption enhances anti-tumor efficacy of human chimeric antigen receptor T cells," Sci. Rep. 7:737, 10 total pages.

Schumann, K. et al. (2015). "Generation of knock-in primary human T cells using Cas9 ribonucleoproteins," PNAS 112:10437-10442.

Smith, T.F. et al. (1981). "Comparison of biosequences," Adv. Appl. Math. 2:482-489.

(56) References Cited

OTHER PUBLICATIONS

Themeli, M. et al. (2013). "Generation of tumor-targeted human T lymphocytes from induced pluripotent stem cells for cancer therapy," Nat. Biotechnol. 31:928-933.
Tréhin, R. et al. (Jul. 2004). "Cellular uptake but low permeation of human calcitonin-derived cell penetrating peptides and Tat(47-57) through well-differentiated epithelial models," Pharm. Res. 21:1248-1256.
Wender, P.A. et al. (Nov. 2000). "The design, synthesis, and evaluation of molecules that enable or enhance cellular uptake: peptoid molecular transporters," PNAS 97:13003-13008.
Written Opinion of the International Searching Authority mailed on Feb. 10, 2021, for PCT Application No. PCT/US2020/050008, filed on Sep. 9, 2020, 13 pages.
Xu, H. et al. (2019). "Targeted Disruption of HLA Genes via CRISPR-Cas9 Generates IPSCs with Enhanced Immune Compatibility," Cell Stem Cell. 24:566-578.
Yang, H. et al. (May 2019). "CasX: a new and small CRISPR gene-editing protein," Cell Res. 29:345-1346. Published online Apr. 16, 2019.
Yoon, D.H. et al. (2018). "Incorporation of Immune Checkpoint Blockade into Chimeric Antigen Receptor T Cells (CAR-Ts): Combination or Built-In CAR-T," Int. J. Mol. Sci. 19:340, 16 total pages.
Zhang, J. et al. (Jun. 1997). "PowerBLAST: a new network BLAST application for interactive or automated sequence analysis and annotation," Genome Res. 7:649-656.
U.S. Appl. No. 18/869,765, filed Nov. 26, 2024, by Zhou et al. (Copy not attached).

* cited by examiner pSTX34 plasmid organization

FIG. 35: Table 3A: Targeting Sequences for B2M

| Name | SEQ ID NO. | Name | SEQ ID NO. |
|---|---|---|---|
| GTCN_0 | 725 | CTCN_844 | 3996 |
| GTCN_1 | 726 | TTCN_855 | 3997 |
| TTCN_0 | 727 | GTCN_456 | 3998 |
| GTCN_2 | 728 | TTCN_856 | 3999 |
| TTCN_1 | 729 | CTCN_845 | 4000 |
| ATCN_0 | 730 | GTCN_457 | 4001 |
| TTCN_2 | 731 | ATCN_517 | 4002 |
| GTCN_3 | 732 | ATCN_518 | 4003 |
| ATCN_1 | 733 | CTCN_846 | 4004 |
| CTCN_0 | 734 | ATCN_519 | 4005 |
| ATCN_2 | 735 | GTCN_458 | 4006 |
| GTCN_4 | 736 | CTCN_847 | 4007 |
| TTCN_3 | 737 | GTCN_459 | 4008 |
| GTCN_5 | 738 | TTCN_857 | 4009 |
| TTCN_4 | 739 | ATCN_520 | 4010 |
| TTCN_5 | 740 | CTCN_848 | 4011 |
| ATCN_3 | 741 | GTCN_460 | 4012 |
| ATCN_4 | 742 | CTCN_849 | 4013 |
| TTCN_6 | 743 | TTCN_858 | 4014 |
| GTCN_6 | 744 | TTCN_859 | 4015 |
| TTCN_7 | 745 | TTCN_860 | 4016 |
| TTCN_8 | 746 | TTCN_861 | 4017 |
| CTCN_1 | 747 | GTCN_461 | 4018 |
| TTCN_9 | 748 | CTCN_850 | 4019 |
| TTCN_10 | 749 | CTCN_851 | 4020 |
| TTCN_11 | 750 | CTCN_852 | 4021 |
| TTCN_12 | 751 | GTCN_462 | 4022 |
| GTCN_7 | 752 | CTCN_853 | 4023 |
| TTCN_13 | 753 | GTCN_463 | 4024 |
| GTCN_8 | 754 | GTCN_464 | 4025 |
| TTCN_18 | 755 | GTCN_465 | 4026 |
| TTCN_19 | 756 | GTCN_466 | 4027 |
| CTCN_6 | 757 | ATCN_521 | 4028 |
| ATCN_6 | 758 | CTCN_854 | 4029 |
| TTCN_20 | 759 | GTCN_467 | 4030 |
| TTCN_21 | 760 | TTCN_862 | 4031 |
| TTCN_22 | 761 | TTCN_863 | 4032 |
| CTCN_7 | 762 | GTCN_468 | 4033 |
| CTCN_8 | 763 | TTCN_864 | 4034 |
| CTCN_9 | 764 | CTCN_855 | 4035 |
| TTCN_23 | 765 | ATCN_522 | 4036 |
| ATCN_7 | 766 | GTCN_469 | 4037 |
| TTCN_24 | 767 | CTCN_856 | 4038 |
| CTCN_10 | 768 | CTCN_857 | 4039 |
| ATCN_8 | 769 | CTCN_858 | 4040 |
| TTCN_25 | 770 | CTCN_859 | 4041 |
| CTCN_11 | 771 | CTCN_860 | 4042 |
| TTCN_26 | 772 | CTCN_861 | 4043 |
| CTCN_12 | 773 | TTCN_865 | 4044 |
| GTCN_10 | 774 | CTCN_862 | 4045 |
| ATCN_9 | 775 | ATCN_523 | 4046 |

| | | | |
|---|---|---|---|
| CTCN_13 | 776 | CTCN_863 | 4047 |
| TTCN_27 | 777 | GTCN_470 | 4048 |
| GTCN_11 | 778 | CTCN_864 | 4049 |
| TTCN_28 | 779 | CTCN_865 | 4050 |
| CTCN_14 | 780 | CTCN_866 | 4051 |
| TTCN_29 | 781 | CTCN_867 | 4052 |
| ATCN_10 | 782 | GTCN_471 | 4053 |
| ATCN_11 | 783 | TTCN_866 | 4054 |
| TTCN_30 | 784 | CTCN_868 | 4055 |
| ATCN_12 | 785 | CTCN_869 | 4056 |
| CTCN_15 | 786 | CTCN_870 | 4057 |
| GTCN_12 | 787 | CTCN_871 | 4058 |
| CTCN_16 | 788 | CTCN_872 | 4059 |
| CTCN_17 | 789 | CTCN_873 | 4060 |
| CTCN_18 | 790 | CTCN_874 | 4061 |
| CTCN_19 | 791 | CTCN_875 | 4062 |
| ATCN_13 | 792 | CTCN_876 | 4063 |
| TTCN_31 | 793 | GTCN_472 | 4064 |
| ATCN_14 | 794 | TTCN_867 | 4065 |
| GTCN_13 | 795 | TTCN_868 | 4066 |
| CTCN_20 | 796 | CTCN_877 | 4067 |
| ATCN_15 | 797 | TTCN_869 | 4068 |
| TTCN_32 | 798 | CTCN_878 | 4069 |
| CTCN_21 | 799 | GTCN_473 | 4070 |
| TTCN_33 | 800 | ATCN_524 | 4071 |
| TTCN_34 | 801 | ATCN_525 | 4072 |
| GTCN_14 | 802 | CTCN_879 | 4073 |
| CTCN_22 | 803 | TTCN_870 | 4074 |
| CTCN_23 | 804 | CTCN_880 | 4075 |
| ATCN_16 | 805 | TTCN_871 | 4076 |
| CTCN_24 | 806 | GTCN_474 | 4077 |
| CTCN_25 | 807 | TTCN_872 | 4078 |
| ATCN_17 | 808 | CTCN_881 | 4079 |
| ATCN_18 | 809 | CTCN_882 | 4080 |
| CTCN_26 | 810 | GTCN_475 | 4081 |
| CTCN_27 | 811 | GTCN_476 | 4082 |
| CTCN_28 | 812 | CTCN_883 | 4083 |
| GTCN_15 | 813 | GTCN_477 | 4084 |
| CTCN_29 | 814 | GTCN_478 | 4085 |
| GTCN_16 | 815 | GTCN_479 | 4086 |
| CTCN_30 | 816 | ATCN_526 | 4087 |
| ATCN_19 | 817 | GTCN_480 | 4088 |
| CTCN_31 | 818 | CTCN_884 | 4089 |
| TTCN_35 | 819 | CTCN_885 | 4090 |
| GTCN_17 | 820 | CTCN_886 | 4091 |
| CTCN_32 | 821 | TTCN_873 | 4092 |
| CTCN_33 | 822 | CTCN_887 | 4093 |
| CTCN_34 | 823 | TTCN_874 | 4094 |
| GTCN_18 | 824 | CTCN_888 | 4095 |
| TTCN_36 | 825 | TTCN_875 | 4096 |
| GTCN_19 | 826 | CTCN_889 | 4097 |
| CTCN_35 | 827 | CTCN_890 | 4098 |
| CTCN_36 | 828 | CTCN_891 | 4099 |

FIG. 35 (continued)

| | | | |
|---|---|---|---|
| GTCN_20 | 829 | GTCN_481 | 4100 |
| GTCN_21 | 830 | CTCN_892 | 4101 |
| ATCN_20 | 831 | GTCN_482 | 4102 |
| CTCN_37 | 832 | CTCN_893 | 4103 |
| CTCN_38 | 833 | TTCN_876 | 4104 |
| TTCN_37 | 834 | CTCN_894 | 4105 |
| ATCN_21 | 835 | GTCN_483 | 4106 |
| CTCN_39 | 836 | CTCN_895 | 4107 |
| TTCN_38 | 837 | GTCN_484 | 4108 |
| CTCN_40 | 838 | GTCN_485 | 4109 |
| TTCN_39 | 839 | CTCN_896 | 4110 |
| ATCN_22 | 840 | TTCN_877 | 4111 |
| GTCN_22 | 841 | GTCN_486 | 4112 |
| TTCN_40 | 842 | CTCN_897 | 4113 |
| CTCN_41 | 843 | CTCN_898 | 4114 |
| TTCN_41 | 844 | GTCN_487 | 4115 |
| TTCN_42 | 845 | TTCN_878 | 4116 |
| GTCN_23 | 846 | GTCN_488 | 4117 |
| CTCN_42 | 847 | TTCN_879 | 4118 |
| CTCN_43 | 848 | GTCN_489 | 4119 |
| TTCN_43 | 849 | CTCN_899 | 4120 |
| TTCN_44 | 850 | GTCN_490 | 4121 |
| GTCN_24 | 851 | CTCN_900 | 4122 |
| GTCN_25 | 852 | TTCN_880 | 4123 |
| CTCN_44 | 853 | GTCN_491 | 4124 |
| GTCN_26 | 854 | TTCN_881 | 4125 |
| TTCN_45 | 855 | ATCN_527 | 4126 |
| TTCN_46 | 856 | TTCN_882 | 4127 |
| CTCN_45 | 857 | TTCN_883 | 4128 |
| GTCN_27 | 858 | TTCN_884 | 4129 |
| TTCN_47 | 859 | ATCN_528 | 4130 |
| TTCN_48 | 860 | GTCN_492 | 4131 |
| TTCN_49 | 861 | TTCN_885 | 4132 |
| TTCN_50 | 862 | GTCN_493 | 4133 |
| GTCN_28 | 863 | ATCN_529 | 4134 |
| TTCN_51 | 864 | TTCN_886 | 4135 |
| ATCN_23 | 865 | GTCN_494 | 4136 |
| ATCN_24 | 866 | GTCN_495 | 4137 |
| ATCN_25 | 867 | TTCN_887 | 4138 |
| TTCN_52 | 868 | ATCN_530 | 4139 |
| CTCN_46 | 869 | TTCN_888 | 4140 |
| ATCN_26 | 870 | ATCN_531 | 4141 |
| ATCN_27 | 871 | ATCN_532 | 4142 |
| ATCN_28 | 872 | TTCN_889 | 4143 |
| CTCN_47 | 873 | CTCN_901 | 4144 |
| ATCN_29 | 874 | CTCN_902 | 4145 |
| TTCN_53 | 875 | ATCN_533 | 4146 |
| TTCN_54 | 876 | TTCN_890 | 4147 |
| GTCN_29 | 877 | TTCN_891 | 4148 |
| CTCN_48 | 878 | CTCN_903 | 4149 |
| GTCN_30 | 879 | ATCN_534 | 4150 |
| GTCN_31 | 880 | TTCN_892 | 4151 |
| ATCN_30 | 881 | ATCN_535 | 4152 |

| | | | |
|---|---|---|---|
| TTCN_55 | 882 | ATCN_536 | 4153 |
| TTCN_56 | 883 | CTCN_904 | 4154 |
| TTCN_57 | 884 | ATCN_537 | 4155 |
| ATCN_31 | 885 | TTCN_893 | 4156 |
| CTCN_49 | 886 | GTCN_496 | 4157 |
| CTCN_50 | 887 | CTCN_905 | 4158 |
| GTCN_32 | 888 | TTCN_894 | 4159 |
| TTCN_58 | 889 | TTCN_895 | 4160 |
| TTCN_59 | 890 | TTCN_896 | 4161 |
| CTCN_51 | 891 | CTCN_906 | 4162 |
| GTCN_33 | 892 | ATCN_538 | 4163 |
| CTCN_52 | 893 | TTCN_897 | 4164 |
| TTCN_60 | 894 | CTCN_907 | 4165 |
| CTCN_53 | 895 | CTCN_908 | 4166 |
| CTCN_54 | 896 | GTCN_497 | 4167 |
| TTCN_61 | 897 | TTCN_898 | 4168 |
| CTCN_55 | 898 | CTCN_909 | 4169 |
| CTCN_56 | 899 | TTCN_899 | 4170 |
| TTCN_62 | 900 | CTCN_910 | 4171 |
| GTCN_34 | 901 | CTCN_911 | 4172 |
| TTCN_63 | 902 | TTCN_900 | 4173 |
| TTCN_64 | 903 | ATCN_539 | 4174 |
| CTCN_57 | 904 | CTCN_912 | 4175 |
| TTCN_65 | 905 | TTCN_901 | 4176 |
| CTCN_58 | 906 | TTCN_902 | 4177 |
| CTCN_59 | 907 | CTCN_913 | 4178 |
| TTCN_66 | 908 | ATCN_540 | 4179 |
| TTCN_67 | 909 | CTCN_914 | 4180 |
| CTCN_60 | 910 | CTCN_915 | 4181 |
| CTCN_61 | 911 | CTCN_916 | 4182 |
| CTCN_62 | 912 | ATCN_541 | 4183 |
| CTCN_63 | 913 | CTCN_917 | 4184 |
| CTCN_64 | 914 | GTCN_498 | 4185 |
| CTCN_65 | 915 | CTCN_918 | 4186 |
| GTCN_35 | 916 | GTCN_499 | 4187 |
| CTCN_66 | 917 | TTCN_903 | 4188 |
| CTCN_67 | 918 | GTCN_500 | 4189 |
| GTCN_36 | 919 | CTCN_919 | 4190 |
| CTCN_68 | 920 | CTCN_920 | 4191 |
| CTCN_69 | 921 | GTCN_501 | 4192 |
| CTCN_70 | 922 | CTCN_921 | 4193 |
| CTCN_71 | 923 | CTCN_922 | 4194 |
| TTCN_68 | 924 | CTCN_923 | 4195 |
| CTCN_72 | 925 | ATCN_542 | 4196 |
| GTCN_37 | 926 | ATCN_543 | 4197 |
| GTCN_38 | 927 | CTCN_924 | 4198 |
| TTCN_69 | 928 | CTCN_925 | 4199 |
| CTCN_73 | 929 | CTCN_926 | 4200 |
| GTCN_39 | 930 | ATCN_544 | 4201 |
| CTCN_74 | 931 | CTCN_927 | 4202 |
| CTCN_75 | 932 | CTCN_928 | 4203 |
| CTCN_76 | 933 | CTCN_929 | 4204 |
| CTCN_77 | 934 | GTCN_502 | 4205 |

FIG. 35 (continued)

| | | | |
|---|---|---|---|
| CTCN_78 | 935 | GTCN_503 | 4206 |
| ATCN_32 | 936 | CTCN_930 | 4207 |
| CTCN_79 | 937 | CTCN_931 | 4208 |
| GTCN_40 | 938 | TTCN_904 | 4209 |
| ATCN_33 | 939 | TTCN_905 | 4210 |
| TTCN_70 | 940 | CTCN_932 | 4211 |
| TTCN_71 | 941 | TTCN_906 | 4212 |
| CTCN_80 | 942 | TTCN_907 | 4213 |
| GTCN_41 | 943 | TTCN_908 | 4214 |
| TTCN_72 | 944 | TTCN_909 | 4215 |
| CTCN_81 | 945 | TTCN_910 | 4216 |
| ATCN_34 | 946 | TTCN_911 | 4217 |
| TTCN_73 | 947 | GTCN_504 | 4218 |
| GTCN_42 | 948 | GTCN_505 | 4219 |
| TTCN_74 | 949 | CTCN_933 | 4220 |
| TTCN_75 | 950 | ATCN_545 | 4221 |
| GTCN_43 | 951 | ATCN_546 | 4222 |
| GTCN_44 | 952 | ATCN_547 | 4223 |
| CTCN_82 | 953 | GTCN_506 | 4224 |
| CTCN_83 | 954 | CTCN_934 | 4225 |
| CTCN_84 | 955 | GTCN_507 | 4226 |
| GTCN_45 | 956 | CTCN_935 | 4227 |
| CTCN_85 | 957 | ATCN_548 | 4228 |
| CTCN_86 | 958 | ATCN_549 | 4229 |
| GTCN_46 | 959 | CTCN_936 | 4230 |
| CTCN_87 | 960 | TTCN_912 | 4231 |
| CTCN_88 | 961 | CTCN_937 | 4232 |
| GTCN_47 | 962 | TTCN_913 | 4233 |
| CTCN_89 | 963 | CTCN_938 | 4234 |
| GTCN_48 | 964 | ATCN_550 | 4235 |
| ATCN_35 | 965 | ATCN_551 | 4236 |
| TTCN_76 | 966 | TTCN_914 | 4237 |
| TTCN_77 | 967 | TTCN_915 | 4238 |
| TTCN_78 | 968 | ATCN_552 | 4239 |
| CTCN_90 | 969 | ATCN_553 | 4240 |
| CTCN_91 | 970 | CTCN_939 | 4241 |
| ATCN_36 | 971 | TTCN_916 | 4242 |
| GTCN_49 | 972 | TTCN_917 | 4243 |
| GTCN_50 | 973 | ATCN_554 | 4244 |
| CTCN_92 | 974 | ATCN_555 | 4245 |
| CTCN_93 | 975 | ATCN_556 | 4246 |
| TTCN_79 | 976 | GTCN_508 | 4247 |
| TTCN_80 | 977 | ATCN_557 | 4248 |
| CTCN_94 | 978 | ATCN_558 | 4249 |
| CTCN_95 | 979 | ATCN_559 | 4250 |
| CTCN_96 | 980 | TTCN_918 | 4251 |
| TTCN_81 | 981 | TTCN_919 | 4252 |
| GTCN_51 | 982 | GTCN_509 | 4253 |
| CTCN_97 | 983 | TTCN_920 | 4254 |
| CTCN_98 | 984 | TTCN_921 | 4255 |
| TTCN_82 | 985 | ATCN_560 | 4256 |
| TTCN_83 | 986 | TTCN_922 | 4257 |
| CTCN_99 | 987 | ATCN_561 | 4258 |

| | | | |
|---|---|---|---|
| TTCN_84 | 988 | ATCN_562 | 4259 |
| TTCN_85 | 989 | CTCN_940 | 4260 |
| TTCN_86 | 990 | TTCN_923 | 4261 |
| TTCN_87 | 991 | GTCN_510 | 4262 |
| CTCN_100 | 992 | TTCN_924 | 4263 |
| TTCN_88 | 993 | CTCN_941 | 4264 |
| GTCN_52 | 994 | CTCN_942 | 4265 |
| GTCN_53 | 995 | GTCN_511 | 4266 |
| ATCN_37 | 996 | TTCN_925 | 4267 |
| ATCN_38 | 997 | TTCN_926 | 4268 |
| GTCN_54 | 998 | CTCN_943 | 4269 |
| TTCN_89 | 999 | CTCN_944 | 4270 |
| TTCN_90 | 1000 | GTCN_512 | 4271 |
| GTCN_55 | 1001 | CTCN_945 | 4272 |
| ATCN_39 | 1002 | TTCN_927 | 4273 |
| GTCN_56 | 1003 | GTCN_513 | 4274 |
| CTCN_101 | 1004 | ATCN_563 | 4275 |
| CTCN_102 | 1005 | GTCN_514 | 4276 |
| GTCN_57 | 1006 | CTCN_946 | 4277 |
| CTCN_103 | 1007 | TTCN_928 | 4278 |
| ATCN_40 | 1008 | TTCN_929 | 4279 |
| CTCN_104 | 1009 | ATCN_564 | 4280 |
| CTCN_105 | 1010 | ATCN_565 | 4281 |
| CTCN_106 | 1011 | CTCN_947 | 4282 |
| GTCN_58 | 1012 | CTCN_948 | 4283 |
| TTCN_91 | 1013 | ATCN_566 | 4284 |
| CTCN_107 | 1014 | TTCN_930 | 4285 |
| TTCN_92 | 1015 | CTCN_949 | 4286 |
| ATCN_41 | 1016 | CTCN_950 | 4287 |
| ATCN_42 | 1017 | CTCN_951 | 4288 |
| ATCN_43 | 1018 | TTCN_931 | 4289 |
| ATCN_44 | 1019 | ATCN_567 | 4290 |
| CTCN_108 | 1020 | TTCN_932 | 4291 |
| TTCN_93 | 1021 | ATCN_568 | 4292 |
| CTCN_109 | 1022 | CTCN_952 | 4293 |
| CTCN_110 | 1023 | ATCN_569 | 4294 |
| CTCN_111 | 1024 | ATCN_570 | 4295 |
| CTCN_112 | 1025 | CTCN_953 | 4296 |
| CTCN_113 | 1026 | TTCN_933 | 4297 |
| CTCN_114 | 1027 | TTCN_934 | 4298 |
| TTCN_94 | 1028 | CTCN_954 | 4299 |
| CTCN_115 | 1029 | ATCN_571 | 4300 |
| TTCN_95 | 1030 | CTCN_955 | 4301 |
| GTCN_59 | 1031 | CTCN_956 | 4302 |
| CTCN_116 | 1032 | CTCN_957 | 4303 |
| GTCN_60 | 1033 | TTCN_935 | 4304 |
| TTCN_96 | 1034 | ATCN_572 | 4305 |
| ATCN_45 | 1035 | GTCN_515 | 4306 |
| TTCN_97 | 1036 | TTCN_936 | 4307 |
| TTCN_98 | 1037 | ATCN_573 | 4308 |
| TTCN_99 | 1038 | TTCN_937 | 4309 |
| TTCN_100 | 1039 | ATCN_574 | 4310 |
| CTCN_117 | 1040 | CTCN_958 | 4311 |

FIG. 35 (continued)

| | | | |
|---|---|---|---|
| GTCN_61 | 1041 | ATCN_575 | 4312 |
| CTCN_118 | 1042 | TTCN_938 | 4313 |
| TTCN_101 | 1043 | ATCN_576 | 4314 |
| GTCN_62 | 1044 | TTCN_939 | 4315 |
| TTCN_102 | 1045 | CTCN_959 | 4316 |
| GTCN_63 | 1046 | CTCN_960 | 4317 |
| CTCN_119 | 1047 | ATCN_577 | 4318 |
| CTCN_120 | 1048 | ATCN_578 | 4319 |
| ATCN_46 | 1049 | GTCN_516 | 4320 |
| ATCN_47 | 1050 | CTCN_961 | 4321 |
| ATCN_48 | 1051 | CTCN_962 | 4322 |
| TTCN_103 | 1052 | TTCN_940 | 4323 |
| TTCN_104 | 1053 | CTCN_963 | 4324 |
| GTCN_64 | 1054 | CTCN_964 | 4325 |
| TTCN_105 | 1055 | GTCN_517 | 4326 |
| TTCN_106 | 1056 | CTCN_965 | 4327 |
| CTCN_121 | 1057 | CTCN_966 | 4328 |
| GTCN_65 | 1058 | ATCN_579 | 4329 |
| CTCN_122 | 1059 | ATCN_580 | 4330 |
| GTCN_66 | 1060 | TTCN_941 | 4331 |
| TTCN_107 | 1061 | TTCN_942 | 4332 |
| TTCN_108 | 1062 | GTCN_518 | 4333 |
| CTCN_123 | 1063 | ATCN_581 | 4334 |
| ATCN_49 | 1064 | TTCN_943 | 4335 |
| ATCN_50 | 1065 | CTCN_967 | 4336 |
| GTCN_67 | 1066 | TTCN_944 | 4337 |
| GTCN_68 | 1067 | TTCN_945 | 4338 |
| TTCN_109 | 1068 | TTCN_946 | 4339 |
| CTCN_124 | 1069 | CTCN_968 | 4340 |
| ATCN_51 | 1070 | TTCN_947 | 4341 |
| CTCN_125 | 1071 | TTCN_948 | 4342 |
| GTCN_69 | 1072 | TTCN_949 | 4343 |
| CTCN_126 | 1073 | ATCN_582 | 4344 |
| GTCN_70 | 1074 | GTCN_519 | 4345 |
| CTCN_127 | 1075 | GTCN_520 | 4346 |
| CTCN_128 | 1076 | CTCN_969 | 4347 |
| ATCN_52 | 1077 | CTCN_970 | 4348 |
| ATCN_53 | 1078 | TTCN_950 | 4349 |
| CTCN_129 | 1079 | TTCN_951 | 4350 |
| CTCN_130 | 1080 | TTCN_952 | 4351 |
| CTCN_131 | 1081 | TTCN_953 | 4352 |
| CTCN_132 | 1082 | ATCN_583 | 4353 |
| CTCN_133 | 1083 | ATCN_584 | 4354 |
| TTCN_110 | 1084 | ATCN_585 | 4355 |
| CTCN_134 | 1085 | GTCN_521 | 4356 |
| TTCN_111 | 1086 | CTCN_971 | 4357 |
| ATCN_54 | 1087 | ATCN_586 | 4358 |
| CTCN_135 | 1088 | ATCN_587 | 4359 |
| GTCN_71 | 1089 | TTCN_954 | 4360 |
| TTCN_112 | 1090 | TTCN_955 | 4361 |
| TTCN_113 | 1091 | GTCN_522 | 4362 |
| TTCN_114 | 1092 | GTCN_523 | 4363 |
| TTCN_115 | 1093 | CTCN_972 | 4364 |

| | | | |
|---|---|---|---|
| GTCN_72 | 1094 | ATCN_588 | 4365 |
| CTCN_136 | 1095 | ATCN_589 | 4366 |
| ATCN_55 | 1096 | GTCN_524 | 4367 |
| GTCN_73 | 1097 | CTCN_973 | 4368 |
| TTCN_116 | 1098 | CTCN_974 | 4369 |
| ATCN_56 | 1099 | TTCN_956 | 4370 |
| GTCN_74 | 1100 | CTCN_975 | 4371 |
| CTCN_137 | 1101 | TTCN_957 | 4372 |
| TTCN_117 | 1102 | GTCN_525 | 4373 |
| TTCN_118 | 1103 | CTCN_976 | 4374 |
| ATCN_57 | 1104 | CTCN_977 | 4375 |
| CTCN_138 | 1105 | GTCN_526 | 4376 |
| ATCN_58 | 1106 | CTCN_978 | 4377 |
| TTCN_119 | 1107 | TTCN_958 | 4378 |
| TTCN_120 | 1108 | CTCN_979 | 4379 |
| TTCN_121 | 1109 | TTCN_959 | 4380 |
| TTCN_122 | 1110 | CTCN_980 | 4381 |
| TTCN_123 | 1111 | ATCN_590 | 4382 |
| GTCN_75 | 1112 | CTCN_981 | 4383 |
| ATCN_59 | 1113 | ATCN_591 | 4384 |
| GTCN_76 | 1114 | ATCN_592 | 4385 |
| GTCN_77 | 1115 | TTCN_960 | 4386 |
| TTCN_124 | 1116 | CTCN_982 | 4387 |
| CTCN_139 | 1117 | TTCN_961 | 4388 |
| ATCN_60 | 1118 | GTCN_527 | 4389 |
| CTCN_140 | 1119 | TTCN_962 | 4390 |
| CTCN_141 | 1120 | ATCN_593 | 4391 |
| ATCN_61 | 1121 | GTCN_528 | 4392 |
| ATCN_62 | 1122 | CTCN_983 | 4393 |
| CTCN_142 | 1123 | TTCN_963 | 4394 |
| CTCN_143 | 1124 | GTCN_529 | 4395 |
| GTCN_78 | 1125 | TTCN_964 | 4396 |
| GTCN_79 | 1126 | ATCN_594 | 4397 |
| CTCN_144 | 1127 | TTCN_965 | 4398 |
| ATCN_63 | 1128 | CTCN_984 | 4399 |
| CTCN_145 | 1129 | CTCN_985 | 4400 |
| CTCN_146 | 1130 | CTCN_986 | 4401 |
| CTCN_147 | 1131 | CTCN_987 | 4402 |
| GTCN_80 | 1132 | ATCN_595 | 4403 |
| CTCN_148 | 1133 | ATCN_596 | 4404 |
| GTCN_81 | 1134 | CTCN_988 | 4405 |
| CTCN_149 | 1135 | CTCN_989 | 4406 |
| CTCN_150 | 1136 | TTCN_966 | 4407 |
| CTCN_151 | 1137 | CTCN_990 | 4408 |
| CTCN_152 | 1138 | ATCN_597 | 4409 |
| TTCN_125 | 1139 | TTCN_967 | 4410 |
| ATCN_64 | 1140 | ATCN_598 | 4411 |
| TTCN_126 | 1141 | TTCN_968 | 4412 |
| CTCN_153 | 1142 | ATCN_599 | 4413 |
| CTCN_154 | 1143 | ATCN_600 | 4414 |
| CTCN_155 | 1144 | TTCN_969 | 4415 |
| ATCN_65 | 1145 | CTCN_991 | 4416 |
| ATCN_66 | 1146 | ATCN_601 | 4417 |

FIG. 35 (continued)

| | | | |
|---|---|---|---|
| CTCN_156 | 1147 | ATCN_602 | 4418 |
| GTCN_82 | 1148 | CTCN_992 | 4419 |
| TTCN_127 | 1149 | GTCN_530 | 4420 |
| TTCN_128 | 1150 | CTCN_993 | 4421 |
| GTCN_83 | 1151 | GTCN_531 | 4422 |
| TTCN_129 | 1152 | TTCN_970 | 4423 |
| CTCN_157 | 1153 | TTCN_971 | 4424 |
| CTCN_158 | 1154 | ATCN_603 | 4425 |
| GTCN_84 | 1155 | ATCN_604 | 4426 |
| CTCN_159 | 1156 | ATCN_605 | 4427 |
| ATCN_67 | 1157 | ATCN_606 | 4428 |
| ATCN_68 | 1158 | CTCN_994 | 4429 |
| CTCN_160 | 1159 | TTCN_972 | 4430 |
| CTCN_161 | 1160 | TTCN_973 | 4431 |
| CTCN_162 | 1161 | TTCN_974 | 4432 |
| ATCN_69 | 1162 | TTCN_975 | 4433 |
| CTCN_163 | 1163 | TTCN_976 | 4434 |
| GTCN_85 | 1164 | CTCN_995 | 4435 |
| ATCN_70 | 1165 | CTCN_996 | 4436 |
| CTCN_164 | 1166 | ATCN_607 | 4437 |
| TTCN_130 | 1167 | TTCN_977 | 4438 |
| GTCN_86 | 1168 | CTCN_997 | 4439 |
| CTCN_165 | 1169 | TTCN_978 | 4440 |
| CTCN_166 | 1170 | TTCN_979 | 4441 |
| ATCN_71 | 1171 | TTCN_980 | 4442 |
| ATCN_72 | 1172 | ATCN_608 | 4443 |
| CTCN_167 | 1173 | ATCN_609 | 4444 |
| CTCN_168 | 1174 | GTCN_532 | 4445 |
| GTCN_87 | 1175 | CTCN_998 | 4446 |
| ATCN_73 | 1176 | CTCN_999 | 4447 |
| CTCN_169 | 1177 | ATCN_610 | 4448 |
| GTCN_88 | 1178 | TTCN_981 | 4449 |
| CTCN_170 | 1179 | CTCN_1000 | 4450 |
| GTCN_89 | 1180 | CTCN_1001 | 4451 |
| GTCN_90 | 1181 | CTCN_1002 | 4452 |
| CTCN_171 | 1182 | ATCN_611 | 4453 |
| TTCN_131 | 1183 | TTCN_982 | 4454 |
| GTCN_91 | 1184 | GTCN_533 | 4455 |
| TTCN_132 | 1185 | CTCN_1003 | 4456 |
| CTCN_172 | 1186 | CTCN_1004 | 4457 |
| CTCN_173 | 1187 | CTCN_1005 | 4458 |
| ATCN_74 | 1188 | CTCN_1006 | 4459 |
| TTCN_133 | 1189 | TTCN_983 | 4460 |
| TTCN_134 | 1190 | CTCN_1007 | 4461 |
| ATCN_75 | 1191 | ATCN_612 | 4462 |
| TTCN_135 | 1192 | CTCN_1008 | 4463 |
| ATCN_76 | 1193 | GTCN_534 | 4464 |
| CTCN_174 | 1194 | TTCN_984 | 4465 |
| GTCN_92 | 1195 | ATCN_613 | 4466 |
| ATCN_77 | 1196 | TTCN_985 | 4467 |
| ATCN_78 | 1197 | ATCN_614 | 4468 |
| TTCN_136 | 1198 | TTCN_986 | 4469 |
| TTCN_137 | 1199 | CTCN_1009 | 4470 |

| | | | |
|---|---|---|---|
| ATCN_79 | 1200 | TTCN_987 | 4471 |
| TTCN_138 | 1201 | CTCN_1010 | 4472 |
| TTCN_139 | 1202 | TTCN_988 | 4473 |
| TTCN_140 | 1203 | ATCN_615 | 4474 |
| CTCN_175 | 1204 | GTCN_535 | 4475 |
| TTCN_141 | 1205 | TTCN_989 | 4476 |
| GTCN_93 | 1206 | TTCN_990 | 4477 |
| TTCN_142 | 1207 | CTCN_1011 | 4478 |
| GTCN_94 | 1208 | TTCN_991 | 4479 |
| CTCN_176 | 1209 | TTCN_992 | 4480 |
| CTCN_177 | 1210 | CTCN_1012 | 4481 |
| ATCN_80 | 1211 | CTCN_1013 | 4482 |
| ATCN_81 | 1212 | TTCN_993 | 4483 |
| GTCN_95 | 1213 | TTCN_994 | 4484 |
| GTCN_96 | 1214 | CTCN_1014 | 4485 |
| ATCN_82 | 1215 | TTCN_995 | 4486 |
| ATCN_83 | 1216 | ATCN_616 | 4487 |
| TTCN_143 | 1217 | ATCN_617 | 4488 |
| TTCN_144 | 1218 | GTCN_536 | 4489 |
| TTCN_145 | 1219 | ATCN_618 | 4490 |
| TTCN_146 | 1220 | GTCN_537 | 4491 |
| ATCN_84 | 1221 | TTCN_996 | 4492 |
| ATCN_85 | 1222 | GTCN_538 | 4493 |
| ATCN_86 | 1223 | TTCN_997 | 4494 |
| CTCN_178 | 1224 | ATCN_619 | 4495 |
| TTCN_147 | 1225 | TTCN_998 | 4496 |
| ATCN_87 | 1226 | CTCN_1015 | 4497 |
| TTCN_148 | 1227 | CTCN_1016 | 4498 |
| ATCN_88 | 1228 | ATCN_620 | 4499 |
| ATCN_89 | 1229 | TTCN_999 | 4500 |
| GTCN_97 | 1230 | CTCN_1017 | 4501 |
| CTCN_179 | 1231 | GTCN_539 | 4502 |
| TTCN_149 | 1232 | ATCN_621 | 4503 |
| TTCN_150 | 1233 | CTCN_1018 | 4504 |
| CTCN_180 | 1234 | TTCN_1000 | 4505 |
| GTCN_98 | 1235 | TTCN_1001 | 4506 |
| CTCN_181 | 1236 | GTCN_540 | 4507 |
| ATCN_90 | 1237 | TTCN_1002 | 4508 |
| GTCN_99 | 1238 | TTCN_1003 | 4509 |
| TTCN_151 | 1239 | GTCN_541 | 4510 |
| ATCN_91 | 1240 | TTCN_1004 | 4511 |
| TTCN_152 | 1241 | ATCN_622 | 4512 |
| GTCN_100 | 1242 | ATCN_623 | 4513 |
| CTCN_182 | 1243 | GTCN_542 | 4514 |
| TTCN_153 | 1244 | TTCN_1005 | 4515 |
| TTCN_154 | 1245 | GTCN_543 | 4516 |
| TTCN_155 | 1246 | TTCN_1006 | 4517 |
| TTCN_156 | 1247 | TTCN_1007 | 4518 |
| TTCN_157 | 1248 | CTCN_1019 | 4519 |
| TTCN_158 | 1249 | CTCN_1020 | 4520 |
| CTCN_183 | 1250 | CTCN_1021 | 4521 |
| GTCN_101 | 1251 | TTCN_1008 | 4522 |
| TTCN_159 | 1252 | TTCN_1009 | 4523 |

FIG. 35 (continued)

| | | | |
|---|---|---|---|
| TTCN_160 | 1253 | CTCN_1022 | 4524 |
| GTCN_102 | 1254 | TTCN_1010 | 4525 |
| GTCN_103 | 1255 | GTCN_544 | 4526 |
| TTCN_161 | 1256 | GTCN_545 | 4527 |
| CTCN_184 | 1257 | TTCN_1011 | 4528 |
| GTCN_104 | 1258 | GTCN_546 | 4529 |
| TTCN_162 | 1259 | GTCN_547 | 4530 |
| TTCN_163 | 1260 | TTCN_1012 | 4531 |
| ATCN_92 | 1261 | ATCN_624 | 4532 |
| ATCN_93 | 1262 | CTCN_1023 | 4533 |
| TTCN_164 | 1263 | TTCN_1013 | 4534 |
| CTCN_185 | 1264 | TTCN_1014 | 4535 |
| TTCN_165 | 1265 | TTCN_1015 | 4536 |
| TTCN_166 | 1266 | ATCN_625 | 4537 |
| TTCN_167 | 1267 | CTCN_1024 | 4538 |
| TTCN_168 | 1268 | TTCN_1016 | 4539 |
| TTCN_169 | 1269 | GTCN_548 | 4540 |
| ATCN_94 | 1270 | GTCN_549 | 4541 |
| TTCN_170 | 1271 | ATCN_626 | 4542 |
| GTCN_105 | 1272 | GTCN_550 | 4543 |
| TTCN_171 | 1273 | TTCN_1017 | 4544 |
| CTCN_186 | 1274 | TTCN_1018 | 4545 |
| ATCN_95 | 1275 | CTCN_1025 | 4546 |
| CTCN_187 | 1276 | GTCN_551 | 4547 |
| TTCN_172 | 1277 | ATCN_627 | 4548 |
| GTCN_106 | 1278 | ATCN_628 | 4549 |
| GTCN_107 | 1279 | GTCN_552 | 4550 |
| TTCN_173 | 1280 | TTCN_1019 | 4551 |
| TTCN_174 | 1281 | CTCN_1026 | 4552 |
| TTCN_175 | 1282 | GTCN_553 | 4553 |
| TTCN_176 | 1283 | ATCN_629 | 4554 |
| CTCN_188 | 1284 | ATCN_630 | 4555 |
| CTCN_189 | 1285 | ATCN_631 | 4556 |
| ATCN_96 | 1286 | ATCN_632 | 4557 |
| CTCN_190 | 1287 | ATCN_633 | 4558 |
| ATCN_97 | 1288 | GTCN_554 | 4559 |
| TTCN_177 | 1289 | TTCN_1020 | 4560 |
| GTCN_108 | 1290 | TTCN_1021 | 4561 |
| GTCN_109 | 1291 | ATCN_634 | 4562 |
| CTCN_191 | 1292 | ATCN_635 | 4563 |
| CTCN_192 | 1293 | ATCN_636 | 4564 |
| ATCN_98 | 1294 | CTCN_1027 | 4565 |
| TTCN_178 | 1295 | ATCN_637 | 4566 |
| GTCN_110 | 1296 | ATCN_638 | 4567 |
| CTCN_193 | 1297 | TTCN_1022 | 4568 |
| TTCN_179 | 1298 | TTCN_1023 | 4569 |
| ATCN_99 | 1299 | TTCN_1024 | 4570 |
| TTCN_180 | 1300 | CTCN_1028 | 4571 |
| GTCN_111 | 1301 | CTCN_1029 | 4572 |
| TTCN_181 | 1302 | CTCN_1030 | 4573 |
| CTCN_194 | 1303 | TTCN_1025 | 4574 |
| TTCN_182 | 1304 | TTCN_1026 | 4575 |
| TTCN_183 | 1305 | CTCN_1031 | 4576 |

| | | | |
|---|---|---|---|
| ATCN_100 | 1306 | TTCN_1027 | 4577 |
| TTCN_184 | 1307 | TTCN_1028 | 4578 |
| CTCN_195 | 1308 | TTCN_1029 | 4579 |
| ATCN_101 | 1309 | ATCN_639 | 4580 |
| ATCN_102 | 1310 | CTCN_1032 | 4581 |
| ATCN_103 | 1311 | TTCN_1030 | 4582 |
| TTCN_185 | 1312 | GTCN_555 | 4583 |
| CTCN_196 | 1313 | GTCN_556 | 4584 |
| TTCN_186 | 1314 | ATCN_640 | 4585 |
| CTCN_197 | 1315 | ATCN_641 | 4586 |
| TTCN_187 | 1316 | GTCN_557 | 4587 |
| TTCN_188 | 1317 | TTCN_1031 | 4588 |
| TTCN_189 | 1318 | CTCN_1033 | 4589 |
| ATCN_104 | 1319 | TTCN_1032 | 4590 |
| TTCN_190 | 1320 | ATCN_642 | 4591 |
| TTCN_191 | 1321 | ATCN_643 | 4592 |
| GTCN_112 | 1322 | CTCN_1034 | 4593 |
| ATCN_105 | 1323 | TTCN_1033 | 4594 |
| GTCN_113 | 1324 | TTCN_1034 | 4595 |
| CTCN_198 | 1325 | CTCN_1035 | 4596 |
| TTCN_192 | 1326 | TTCN_1035 | 4597 |
| TTCN_193 | 1327 | TTCN_1036 | 4598 |
| TTCN_194 | 1328 | TTCN_1037 | 4599 |
| CTCN_199 | 1329 | TTCN_1038 | 4600 |
| TTCN_195 | 1330 | GTCN_558 | 4601 |
| TTCN_196 | 1331 | GTCN_559 | 4602 |
| TTCN_197 | 1332 | TTCN_1039 | 4603 |
| CTCN_200 | 1333 | TTCN_1040 | 4604 |
| ATCN_106 | 1334 | CTCN_1036 | 4605 |
| CTCN_201 | 1335 | GTCN_560 | 4606 |
| TTCN_198 | 1336 | TTCN_1041 | 4607 |
| CTCN_202 | 1337 | ATCN_644 | 4608 |
| TTCN_199 | 1338 | ATCN_645 | 4609 |
| CTCN_203 | 1339 | CTCN_1037 | 4610 |
| TTCN_200 | 1340 | GTCN_561 | 4611 |
| TTCN_201 | 1341 | ATCN_646 | 4612 |
| CTCN_204 | 1342 | CTCN_1038 | 4613 |
| GTCN_114 | 1343 | GTCN_562 | 4614 |
| ATCN_107 | 1344 | CTCN_1039 | 4615 |
| CTCN_205 | 1345 | TTCN_1042 | 4616 |
| ATCN_108 | 1346 | TTCN_1043 | 4617 |
| ATCN_109 | 1347 | GTCN_563 | 4618 |
| ATCN_110 | 1348 | CTCN_1040 | 4619 |
| GTCN_115 | 1349 | GTCN_564 | 4620 |
| TTCN_202 | 1350 | GTCN_565 | 4621 |
| CTCN_206 | 1351 | CTCN_1041 | 4622 |
| TTCN_203 | 1352 | ATCN_647 | 4623 |
| TTCN_204 | 1353 | CTCN_1042 | 4624 |
| ATCN_111 | 1354 | CTCN_1043 | 4625 |
| CTCN_207 | 1355 | TTCN_1044 | 4626 |
| CTCN_208 | 1356 | GTCN_566 | 4627 |
| CTCN_209 | 1357 | CTCN_1044 | 4628 |
| ATCN_112 | 1358 | TTCN_1045 | 4629 |

FIG. 35 (continued)

| | | | |
|---|---|---|---|
| TTCN_205 | 1359 | TTCN_1046 | 4630 |
| GTCN_116 | 1360 | TTCN_1047 | 4631 |
| TTCN_206 | 1361 | ATCN_648 | 4632 |
| CTCN_210 | 1362 | GTCN_567 | 4633 |
| CTCN_211 | 1363 | TTCN_1048 | 4634 |
| TTCN_207 | 1364 | TTCN_1049 | 4635 |
| CTCN_212 | 1365 | CTCN_1045 | 4636 |
| TTCN_208 | 1366 | CTCN_1046 | 4637 |
| GTCN_117 | 1367 | TTCN_1050 | 4638 |
| CTCN_213 | 1368 | TTCN_1051 | 4639 |
| ATCN_113 | 1369 | GTCN_568 | 4640 |
| TTCN_209 | 1370 | CTCN_1047 | 4641 |
| GTCN_118 | 1371 | CTCN_1048 | 4642 |
| TTCN_210 | 1372 | CTCN_1049 | 4643 |
| CTCN_214 | 1373 | TTCN_1052 | 4644 |
| ATCN_114 | 1374 | ATCN_649 | 4645 |
| CTCN_215 | 1375 | ATCN_650 | 4646 |
| CTCN_216 | 1376 | ATCN_651 | 4647 |
| ATCN_115 | 1377 | TTCN_1053 | 4648 |
| GTCN_119 | 1378 | TTCN_1054 | 4649 |
| CTCN_217 | 1379 | TTCN_1055 | 4650 |
| TTCN_211 | 1380 | GTCN_569 | 4651 |
| CTCN_218 | 1381 | ATCN_652 | 4652 |
| CTCN_219 | 1382 | CTCN_1050 | 4653 |
| TTCN_212 | 1383 | CTCN_1051 | 4654 |
| TTCN_213 | 1384 | CTCN_1052 | 4655 |
| ATCN_116 | 1385 | CTCN_1053 | 4656 |
| CTCN_220 | 1386 | TTCN_1056 | 4657 |
| TTCN_214 | 1387 | TTCN_1057 | 4658 |
| TTCN_215 | 1388 | CTCN_1054 | 4659 |
| GTCN_120 | 1389 | TTCN_1058 | 4660 |
| CTCN_221 | 1390 | TTCN_1059 | 4661 |
| CTCN_222 | 1391 | TTCN_1060 | 4662 |
| CTCN_223 | 1392 | GTCN_570 | 4663 |
| ATCN_117 | 1393 | TTCN_1061 | 4664 |
| TTCN_216 | 1394 | CTCN_1055 | 4665 |
| CTCN_224 | 1395 | CTCN_1056 | 4666 |
| CTCN_225 | 1396 | CTCN_1057 | 4667 |
| CTCN_226 | 1397 | CTCN_1058 | 4668 |
| ATCN_118 | 1398 | GTCN_571 | 4669 |
| ATCN_119 | 1399 | ATCN_653 | 4670 |
| TTCN_217 | 1400 | TTCN_1062 | 4671 |
| ATCN_120 | 1401 | GTCN_572 | 4672 |
| TTCN_218 | 1402 | CTCN_1059 | 4673 |
| ATCN_121 | 1403 | CTCN_1060 | 4674 |
| CTCN_227 | 1404 | TTCN_1063 | 4675 |
| GTCN_121 | 1405 | CTCN_1061 | 4676 |
| GTCN_122 | 1406 | CTCN_1062 | 4677 |
| CTCN_228 | 1407 | ATCN_654 | 4678 |
| TTCN_219 | 1408 | TTCN_1064 | 4679 |
| GTCN_123 | 1409 | ATCN_655 | 4680 |
| TTCN_220 | 1410 | ATCN_656 | 4681 |
| CTCN_229 | 1411 | ATCN_657 | 4682 |

| | | | |
|---|---|---|---|
| ATCN_122 | 1412 | ATCN_658 | 4683 |
| ATCN_123 | 1413 | CTCN_1063 | 4684 |
| TTCN_221 | 1414 | CTCN_1064 | 4685 |
| CTCN_230 | 1415 | TTCN_1065 | 4686 |
| CTCN_231 | 1416 | CTCN_1065 | 4687 |
| ATCN_124 | 1417 | CTCN_1066 | 4688 |
| TTCN_222 | 1418 | CTCN_1067 | 4689 |
| ATCN_125 | 1419 | CTCN_1068 | 4690 |
| CTCN_232 | 1420 | TTCN_1066 | 4691 |
| GTCN_124 | 1421 | GTCN_573 | 4692 |
| CTCN_233 | 1422 | TTCN_1067 | 4693 |
| TTCN_223 | 1423 | CTCN_1069 | 4694 |
| TTCN_224 | 1424 | ATCN_659 | 4695 |
| GTCN_125 | 1425 | CTCN_1070 | 4696 |
| TTCN_225 | 1426 | GTCN_574 | 4697 |
| CTCN_234 | 1427 | TTCN_1068 | 4698 |
| GTCN_126 | 1428 | TTCN_1069 | 4699 |
| TTCN_226 | 1429 | TTCN_1070 | 4700 |
| GTCN_127 | 1430 | ATCN_660 | 4701 |
| CTCN_235 | 1431 | TTCN_1071 | 4702 |
| CTCN_236 | 1432 | TTCN_1072 | 4703 |
| CTCN_237 | 1433 | ATCN_661 | 4704 |
| CTCN_238 | 1434 | CTCN_1071 | 4705 |
| CTCN_239 | 1435 | TTCN_1073 | 4706 |
| TTCN_227 | 1436 | TTCN_1074 | 4707 |
| CTCN_240 | 1437 | TTCN_1075 | 4708 |
| CTCN_241 | 1438 | ATCN_662 | 4709 |
| TTCN_228 | 1439 | CTCN_1072 | 4710 |
| CTCN_242 | 1440 | CTCN_1073 | 4711 |
| GTCN_128 | 1441 | ATCN_663 | 4712 |
| TTCN_229 | 1442 | TTCN_1076 | 4713 |
| TTCN_230 | 1443 | ATCN_664 | 4714 |
| CTCN_243 | 1444 | ATCN_665 | 4715 |
| CTCN_244 | 1445 | ATCN_666 | 4716 |
| TTCN_231 | 1446 | GTCN_575 | 4717 |
| GTCN_129 | 1447 | CTCN_1074 | 4718 |
| TTCN_232 | 1448 | GTCN_576 | 4719 |
| ATCN_126 | 1449 | TTCN_1077 | 4720 |
| CTCN_245 | 1450 | CTCN_1075 | 4721 |
| CTCN_246 | 1451 | GTCN_577 | 4722 |
| ATCN_127 | 1452 | GTCN_578 | 4723 |
| TTCN_233 | 1453 | GTCN_579 | 4724 |
| GTCN_130 | 1454 | TTCN_1078 | 4725 |
| ATCN_128 | 1455 | CTCN_1076 | 4726 |
| ATCN_129 | 1456 | TTCN_1079 | 4727 |
| CTCN_247 | 1457 | CTCN_1077 | 4728 |
| CTCN_248 | 1458 | GTCN_580 | 4729 |
| CTCN_249 | 1459 | TTCN_1080 | 4730 |
| CTCN_250 | 1460 | ATCN_667 | 4731 |
| CTCN_251 | 1461 | TTCN_1081 | 4732 |
| TTCN_234 | 1462 | ATCN_668 | 4733 |
| GTCN_131 | 1463 | CTCN_1078 | 4734 |
| GTCN_132 | 1464 | GTCN_581 | 4735 |

FIG. 35 (continued)

| | | | |
|---|---|---|---|
| CTCN_252 | 1465 | GTCN_582 | 4736 |
| TTCN_235 | 1466 | GTCN_583 | 4737 |
| CTCN_253 | 1467 | ATCN_669 | 4738 |
| GTCN_133 | 1468 | GTCN_584 | 4739 |
| TTCN_236 | 1469 | ATCN_670 | 4740 |
| CTCN_254 | 1470 | ATCN_671 | 4741 |
| GTCN_134 | 1471 | TTCN_1082 | 4742 |
| ATCN_130 | 1472 | TTCN_1083 | 4743 |
| TTCN_237 | 1473 | ATCN_672 | 4744 |
| ATCN_131 | 1474 | CTCN_1079 | 4745 |
| TTCN_238 | 1475 | ATCN_673 | 4746 |
| ATCN_132 | 1476 | ATCN_674 | 4747 |
| CTCN_255 | 1477 | CTCN_1080 | 4748 |
| GTCN_135 | 1478 | CTCN_1081 | 4749 |
| GTCN_136 | 1479 | TTCN_1084 | 4750 |
| CTCN_256 | 1480 | GTCN_585 | 4751 |
| GTCN_137 | 1481 | TTCN_1085 | 4752 |
| CTCN_257 | 1482 | ATCN_675 | 4753 |
| ATCN_133 | 1483 | ATCN_676 | 4754 |
| CTCN_258 | 1484 | TTCN_1086 | 4755 |
| CTCN_259 | 1485 | GTCN_586 | 4756 |
| CTCN_260 | 1486 | CTCN_1082 | 4757 |
| CTCN_261 | 1487 | ATCN_677 | 4758 |
| CTCN_262 | 1488 | ATCN_678 | 4759 |
| ATCN_134 | 1489 | ATCN_679 | 4760 |
| CTCN_263 | 1490 | TTCN_1087 | 4761 |
| CTCN_264 | 1491 | TTCN_1088 | 4762 |
| GTCN_138 | 1492 | TTCN_1089 | 4763 |
| TTCN_239 | 1493 | TTCN_1090 | 4764 |
| CTCN_265 | 1494 | TTCN_1091 | 4765 |
| GTCN_139 | 1495 | ATCN_680 | 4766 |
| ATCN_135 | 1496 | ATCN_681 | 4767 |
| TTCN_240 | 1497 | ATCN_682 | 4768 |
| TTCN_241 | 1498 | TTCN_1092 | 4769 |
| GTCN_140 | 1499 | TTCN_1093 | 4770 |
| GTCN_141 | 1500 | TTCN_1094 | 4771 |
| TTCN_242 | 1501 | ATCN_683 | 4772 |
| GTCN_142 | 1502 | GTCN_587 | 4773 |
| CTCN_266 | 1503 | ATCN_684 | 4774 |
| CTCN_267 | 1504 | ATCN_685 | 4775 |
| ATCN_136 | 1505 | TTCN_1095 | 4776 |
| GTCN_143 | 1506 | TTCN_1096 | 4777 |
| TTCN_243 | 1507 | CTCN_1083 | 4778 |
| GTCN_144 | 1508 | GTCN_588 | 4779 |
| TTCN_244 | 1509 | CTCN_1084 | 4780 |
| TTCN_245 | 1510 | ATCN_686 | 4781 |
| TTCN_246 | 1511 | ATCN_687 | 4782 |
| TTCN_247 | 1512 | CTCN_1085 | 4783 |
| GTCN_145 | 1513 | CTCN_1086 | 4784 |
| CTCN_268 | 1514 | CTCN_1087 | 4785 |
| CTCN_269 | 1515 | CTCN_1088 | 4786 |
| TTCN_248 | 1516 | CTCN_1089 | 4787 |
| GTCN_146 | 1517 | CTCN_1090 | 4788 |

| | | | |
|---|---|---|---|
| GTCN_147 | 1518 | CTCN_1091 | 4789 |
| TTCN_249 | 1519 | TTCN_1097 | 4790 |
| TTCN_250 | 1520 | TTCN_1098 | 4791 |
| TTCN_251 | 1521 | CTCN_1092 | 4792 |
| GTCN_148 | 1522 | ATCN_688 | 4793 |
| TTCN_252 | 1523 | ATCN_689 | 4794 |
| TTCN_253 | 1524 | ATCN_690 | 4795 |
| TTCN_254 | 1525 | GTCN_589 | 4796 |
| TTCN_255 | 1526 | ATCN_691 | 4797 |
| ATCN_137 | 1527 | TTCN_1099 | 4798 |
| CTCN_270 | 1528 | CTCN_1093 | 4799 |
| ATCN_138 | 1529 | TTCN_1100 | 4800 |
| CTCN_271 | 1530 | ATCN_692 | 4801 |
| GTCN_149 | 1531 | CTCN_1094 | 4802 |
| GTCN_150 | 1532 | CTCN_1095 | 4803 |
| TTCN_256 | 1533 | ATCN_693 | 4804 |
| CTCN_272 | 1534 | TTCN_1101 | 4805 |
| ATCN_139 | 1535 | CTCN_1096 | 4806 |
| ATCN_140 | 1536 | TTCN_1102 | 4807 |
| TTCN_257 | 1537 | TTCN_1103 | 4808 |
| TTCN_258 | 1538 | TTCN_1104 | 4809 |
| GTCN_151 | 1539 | GTCN_590 | 4810 |
| CTCN_273 | 1540 | ATCN_694 | 4811 |
| GTCN_152 | 1541 | TTCN_1105 | 4812 |
| CTCN_274 | 1542 | TTCN_1106 | 4813 |
| ATCN_141 | 1543 | TTCN_1107 | 4814 |
| ATCN_142 | 1544 | GTCN_591 | 4815 |
| GTCN_153 | 1545 | ATCN_695 | 4816 |
| CTCN_275 | 1546 | TTCN_1108 | 4817 |
| ATCN_143 | 1547 | TTCN_1109 | 4818 |
| CTCN_276 | 1548 | ATCN_696 | 4819 |
| GTCN_154 | 1549 | ATCN_697 | 4820 |
| CTCN_277 | 1550 | TTCN_1110 | 4821 |
| TTCN_259 | 1551 | ATCN_698 | 4822 |
| ATCN_144 | 1552 | ATCN_699 | 4823 |
| TTCN_260 | 1553 | ATCN_700 | 4824 |
| TTCN_261 | 1554 | CTCN_1097 | 4825 |
| CTCN_278 | 1555 | ATCN_701 | 4826 |
| GTCN_155 | 1556 | CTCN_1098 | 4827 |
| CTCN_279 | 1557 | CTCN_1099 | 4828 |
| TTCN_262 | 1558 | TTCN_1111 | 4829 |
| CTCN_280 | 1559 | TTCN_1112 | 4830 |
| TTCN_263 | 1560 | GTCN_592 | 4831 |
| CTCN_281 | 1561 | TTCN_1113 | 4832 |
| CTCN_282 | 1562 | TTCN_1114 | 4833 |
| CTCN_283 | 1563 | TTCN_1115 | 4834 |
| GTCN_156 | 1564 | CTCN_1100 | 4835 |
| CTCN_284 | 1565 | CTCN_1101 | 4836 |
| TTCN_264 | 1566 | CTCN_1102 | 4837 |
| TTCN_265 | 1567 | ATCN_702 | 4838 |
| ATCN_145 | 1568 | TTCN_1116 | 4839 |
| TTCN_266 | 1569 | TTCN_1117 | 4840 |
| GTCN_157 | 1570 | ATCN_703 | 4841 |

FIG. 35 (continued)

| | | | |
|---|---|---|---|
| TTCN_267 | 1571 | TTCN_1118 | 4842 |
| TTCN_268 | 1572 | ATCN_704 | 4843 |
| CTCN_285 | 1573 | ATCN_705 | 4844 |
| TTCN_269 | 1574 | CTCN_1103 | 4845 |
| CTCN_286 | 1575 | TTCN_1119 | 4846 |
| TTCN_270 | 1576 | GTCN_593 | 4847 |
| GTCN_158 | 1577 | GTCN_594 | 4848 |
| CTCN_287 | 1578 | CTCN_1104 | 4849 |
| GTCN_159 | 1579 | TTCN_1120 | 4850 |
| TTCN_271 | 1580 | TTCN_1121 | 4851 |
| GTCN_160 | 1581 | TTCN_1122 | 4852 |
| CTCN_288 | 1582 | GTCN_595 | 4853 |
| CTCN_289 | 1583 | CTCN_1105 | 4854 |
| TTCN_272 | 1584 | CTCN_1106 | 4855 |
| TTCN_273 | 1585 | GTCN_596 | 4856 |
| GTCN_161 | 1586 | CTCN_1107 | 4857 |
| ATCN_146 | 1587 | CTCN_1108 | 4858 |
| ATCN_147 | 1588 | CTCN_1109 | 4859 |
| ATCN_148 | 1589 | ATCN_706 | 4860 |
| ATCN_149 | 1590 | TTCN_1123 | 4861 |
| TTCN_274 | 1591 | ATCN_707 | 4862 |
| CTCN_290 | 1592 | TTCN_1124 | 4863 |
| TTCN_275 | 1593 | ATCN_708 | 4864 |
| CTCN_291 | 1594 | ATCN_709 | 4865 |
| CTCN_292 | 1595 | ATCN_710 | 4866 |
| GTCN_162 | 1596 | GTCN_597 | 4867 |
| GTCN_163 | 1597 | CTCN_1110 | 4868 |
| ATCN_150 | 1598 | ATCN_711 | 4869 |
| ATCN_151 | 1599 | TTCN_1125 | 4870 |
| GTCN_164 | 1600 | GTCN_598 | 4871 |
| ATCN_152 | 1601 | TTCN_1126 | 4872 |
| ATCN_153 | 1602 | GTCN_599 | 4873 |
| CTCN_293 | 1603 | ATCN_712 | 4874 |
| CTCN_294 | 1604 | ATCN_713 | 4875 |
| GTCN_165 | 1605 | GTCN_600 | 4876 |
| CTCN_295 | 1606 | TTCN_1127 | 4877 |
| CTCN_296 | 1607 | ATCN_714 | 4878 |
| CTCN_297 | 1608 | ATCN_715 | 4879 |
| TTCN_276 | 1609 | CTCN_1111 | 4880 |
| CTCN_298 | 1610 | ATCN_716 | 4881 |
| CTCN_299 | 1611 | TTCN_1128 | 4882 |
| CTCN_300 | 1612 | ATCN_717 | 4883 |
| TTCN_277 | 1613 | TTCN_1129 | 4884 |
| TTCN_278 | 1614 | GTCN_601 | 4885 |
| CTCN_301 | 1615 | TTCN_1130 | 4886 |
| TTCN_279 | 1616 | GTCN_602 | 4887 |
| TTCN_280 | 1617 | CTCN_1112 | 4888 |
| TTCN_281 | 1618 | GTCN_603 | 4889 |
| GTCN_166 | 1619 | ATCN_718 | 4890 |
| CTCN_302 | 1620 | TTCN_1131 | 4891 |
| CTCN_303 | 1621 | ATCN_719 | 4892 |
| CTCN_304 | 1622 | ATCN_720 | 4893 |
| TTCN_282 | 1623 | TTCN_1132 | 4894 |

| | | | |
|---|---|---|---|
| GTCN_167 | 1624 | ATCN_721 | 4895 |
| CTCN_305 | 1625 | ATCN_722 | 4896 |
| CTCN_306 | 1626 | CTCN_1113 | 4897 |
| TTCN_283 | 1627 | ATCN_723 | 4898 |
| ATCN_154 | 1628 | TTCN_1133 | 4899 |
| CTCN_307 | 1629 | TTCN_1134 | 4900 |
| CTCN_308 | 1630 | GTCN_604 | 4901 |
| GTCN_168 | 1631 | ATCN_724 | 4902 |
| GTCN_169 | 1632 | TTCN_1135 | 4903 |
| CTCN_309 | 1633 | ATCN_725 | 4904 |
| CTCN_310 | 1634 | GTCN_605 | 4905 |
| CTCN_311 | 1635 | TTCN_1136 | 4906 |
| TTCN_284 | 1636 | ATCN_726 | 4907 |
| TTCN_285 | 1637 | CTCN_1114 | 4908 |
| ATCN_155 | 1638 | TTCN_1137 | 4909 |
| CTCN_312 | 1639 | GTCN_606 | 4910 |
| TTCN_286 | 1640 | ATCN_727 | 4911 |
| CTCN_313 | 1641 | CTCN_1115 | 4912 |
| TTCN_287 | 1642 | ATCN_728 | 4913 |
| CTCN_314 | 1643 | ATCN_729 | 4914 |
| CTCN_315 | 1644 | TTCN_1138 | 4915 |
| TTCN_288 | 1645 | CTCN_1116 | 4916 |
| CTCN_316 | 1646 | CTCN_1117 | 4917 |
| TTCN_289 | 1647 | GTCN_607 | 4918 |
| ATCN_156 | 1648 | ATCN_730 | 4919 |
| GTCN_170 | 1649 | CTCN_1118 | 4920 |
| TTCN_290 | 1650 | ATCN_731 | 4921 |
| CTCN_317 | 1651 | ATCN_732 | 4922 |
| CTCN_318 | 1652 | TTCN_1139 | 4923 |
| GTCN_171 | 1653 | TTCN_1140 | 4924 |
| CTCN_319 | 1654 | TTCN_1141 | 4925 |
| TTCN_291 | 1655 | ATCN_733 | 4926 |
| ATCN_157 | 1656 | TTCN_1142 | 4927 |
| ATCN_158 | 1657 | TTCN_1143 | 4928 |
| CTCN_320 | 1658 | CTCN_1119 | 4929 |
| CTCN_321 | 1659 | GTCN_608 | 4930 |
| ATCN_159 | 1660 | CTCN_1120 | 4931 |
| ATCN_160 | 1661 | GTCN_609 | 4932 |
| CTCN_322 | 1662 | ATCN_734 | 4933 |
| GTCN_172 | 1663 | CTCN_1121 | 4934 |
| GTCN_173 | 1664 | ATCN_735 | 4935 |
| CTCN_323 | 1665 | ATCN_736 | 4936 |
| TTCN_292 | 1666 | ATCN_737 | 4937 |
| ATCN_161 | 1667 | CTCN_1122 | 4938 |
| TTCN_293 | 1668 | CTCN_1123 | 4939 |
| TTCN_294 | 1669 | GTCN_610 | 4940 |
| ATCN_162 | 1670 | CTCN_1124 | 4941 |
| CTCN_324 | 1671 | GTCN_611 | 4942 |
| TTCN_295 | 1672 | GTCN_612 | 4943 |
| TTCN_296 | 1673 | GTCN_613 | 4944 |
| TTCN_297 | 1674 | CTCN_1125 | 4945 |
| TTCN_298 | 1675 | TTCN_1144 | 4946 |
| TTCN_299 | 1676 | TTCN_1145 | 4947 |

FIG. 35 (continued)

| | | | |
|---|---|---|---|
| ATCN_163 | 1677 | TTCN_1146 | 4948 |
| CTCN_325 | 1678 | TTCN_1147 | 4949 |
| TTCN_300 | 1679 | TTCN_1148 | 4950 |
| CTCN_326 | 1680 | TTCN_1149 | 4951 |
| TTCN_301 | 1681 | ATCN_738 | 4952 |
| TTCN_302 | 1682 | CTCN_1126 | 4953 |
| GTCN_174 | 1683 | CTCN_1127 | 4954 |
| CTCN_327 | 1684 | TTCN_1150 | 4955 |
| TTCN_303 | 1685 | CTCN_1128 | 4956 |
| CTCN_328 | 1686 | CTCN_1129 | 4957 |
| GTCN_175 | 1687 | CTCN_1130 | 4958 |
| ATCN_164 | 1688 | TTCN_1151 | 4959 |
| CTCN_329 | 1689 | CTCN_1131 | 4960 |
| TTCN_304 | 1690 | ATCN_739 | 4961 |
| TTCN_305 | 1691 | TTCN_1152 | 4962 |
| CTCN_330 | 1692 | TTCN_1153 | 4963 |
| GTCN_176 | 1693 | GTCN_614 | 4964 |
| TTCN_306 | 1694 | TTCN_1154 | 4965 |
| GTCN_177 | 1695 | CTCN_1132 | 4966 |
| ATCN_165 | 1696 | TTCN_1155 | 4967 |
| TTCN_307 | 1697 | GTCN_615 | 4968 |
| TTCN_308 | 1698 | TTCN_1156 | 4969 |
| TTCN_309 | 1699 | GTCN_616 | 4970 |
| TTCN_310 | 1700 | TTCN_1157 | 4971 |
| GTCN_178 | 1701 | CTCN_1133 | 4972 |
| CTCN_331 | 1702 | TTCN_1158 | 4973 |
| GTCN_179 | 1703 | ATCN_740 | 4974 |
| ATCN_166 | 1704 | ATCN_741 | 4975 |
| ATCN_167 | 1705 | CTCN_1134 | 4976 |
| TTCN_311 | 1706 | TTCN_1159 | 4977 |
| GTCN_180 | 1707 | TTCN_1160 | 4978 |
| CTCN_332 | 1708 | TTCN_1161 | 4979 |
| ATCN_168 | 1709 | CTCN_1135 | 4980 |
| ATCN_169 | 1710 | TTCN_1162 | 4981 |
| TTCN_312 | 1711 | GTCN_617 | 4982 |
| TTCN_313 | 1712 | ATCN_742 | 4983 |
| ATCN_170 | 1713 | TTCN_1163 | 4984 |
| GTCN_181 | 1714 | CTCN_1136 | 4985 |
| TTCN_314 | 1715 | CTCN_1137 | 4986 |
| TTCN_315 | 1716 | TTCN_1164 | 4987 |
| GTCN_182 | 1717 | GTCN_618 | 4988 |
| CTCN_333 | 1718 | ATCN_743 | 4989 |
| TTCN_316 | 1719 | CTCN_1138 | 4990 |
| CTCN_334 | 1720 | CTCN_1139 | 4991 |
| TTCN_317 | 1721 | ATCN_744 | 4992 |
| CTCN_335 | 1722 | TTCN_1165 | 4993 |
| GTCN_183 | 1723 | CTCN_1140 | 4994 |
| TTCN_318 | 1724 | TTCN_1166 | 4995 |
| CTCN_336 | 1725 | CTCN_1141 | 4996 |
| CTCN_337 | 1726 | TTCN_1167 | 4997 |
| ATCN_171 | 1727 | TTCN_1168 | 4998 |
| CTCN_338 | 1728 | GTCN_619 | 4999 |
| GTCN_184 | 1729 | CTCN_1142 | 5000 |

| | | | |
|---|---|---|---|
| ATCN_172 | 1730 | ATCN_745 | 5001 |
| GTCN_185 | 1731 | GTCN_620 | 5002 |
| TTCN_319 | 1732 | GTCN_621 | 5003 |
| ATCN_173 | 1733 | TTCN_1169 | 5004 |
| CTCN_339 | 1734 | TTCN_1170 | 5005 |
| ATCN_174 | 1735 | ATCN_746 | 5006 |
| CTCN_340 | 1736 | TTCN_1171 | 5007 |
| TTCN_320 | 1737 | TTCN_1172 | 5008 |
| TTCN_321 | 1738 | GTCN_622 | 5009 |
| GTCN_186 | 1739 | TTCN_1173 | 5010 |
| CTCN_341 | 1740 | ATCN_747 | 5011 |
| CTCN_342 | 1741 | TTCN_1174 | 5012 |
| CTCN_343 | 1742 | CTCN_1143 | 5013 |
| CTCN_344 | 1743 | TTCN_1175 | 5014 |
| GTCN_187 | 1744 | CTCN_1144 | 5015 |
| GTCN_188 | 1745 | ATCN_748 | 5016 |
| CTCN_345 | 1746 | CTCN_1145 | 5017 |
| GTCN_189 | 1747 | GTCN_623 | 5018 |
| CTCN_346 | 1748 | CTCN_1146 | 5019 |
| CTCN_347 | 1749 | CTCN_1147 | 5020 |
| CTCN_348 | 1750 | GTCN_624 | 5021 |
| CTCN_349 | 1751 | ATCN_749 | 5022 |
| GTCN_190 | 1752 | TTCN_1176 | 5023 |
| GTCN_191 | 1753 | CTCN_1148 | 5024 |
| TTCN_322 | 1754 | CTCN_1149 | 5025 |
| CTCN_350 | 1755 | TTCN_1177 | 5026 |
| TTCN_323 | 1756 | ATCN_750 | 5027 |
| TTCN_324 | 1757 | TTCN_1178 | 5028 |
| CTCN_351 | 1758 | CTCN_1150 | 5029 |
| TTCN_325 | 1759 | CTCN_1151 | 5030 |
| TTCN_326 | 1760 | GTCN_625 | 5031 |
| GTCN_192 | 1761 | GTCN_626 | 5032 |
| ATCN_175 | 1762 | CTCN_1152 | 5033 |
| GTCN_193 | 1763 | CTCN_1153 | 5034 |
| GTCN_194 | 1764 | GTCN_627 | 5035 |
| CTCN_352 | 1765 | CTCN_1154 | 5036 |
| ATCN_176 | 1766 | TTCN_1179 | 5037 |
| GTCN_195 | 1767 | ATCN_751 | 5038 |
| GTCN_196 | 1768 | ATCN_752 | 5039 |
| GTCN_197 | 1769 | CTCN_1155 | 5040 |
| TTCN_327 | 1770 | GTCN_628 | 5041 |
| TTCN_328 | 1771 | TTCN_1180 | 5042 |
| GTCN_198 | 1772 | CTCN_1156 | 5043 |
| CTCN_353 | 1773 | ATCN_753 | 5044 |
| GTCN_199 | 1774 | TTCN_1181 | 5045 |
| CTCN_354 | 1775 | CTCN_1157 | 5046 |
| CTCN_355 | 1776 | CTCN_1158 | 5047 |
| CTCN_356 | 1777 | CTCN_1159 | 5048 |
| ATCN_177 | 1778 | GTCN_629 | 5049 |
| CTCN_357 | 1779 | GTCN_630 | 5050 |
| ATCN_178 | 1780 | CTCN_1160 | 5051 |
| ATCN_179 | 1781 | ATCN_754 | 5052 |
| TTCN_329 | 1782 | TTCN_1182 | 5053 |

FIG. 35 (continued)

| | | | |
|---|---|---|---|
| CTCN_358 | 1783 | CTCN_1161 | 5054 |
| TTCN_330 | 1784 | TTCN_1183 | 5055 |
| ATCN_180 | 1785 | TTCN_1184 | 5056 |
| TTCN_331 | 1786 | CTCN_1162 | 5057 |
| CTCN_359 | 1787 | CTCN_1163 | 5058 |
| TTCN_332 | 1788 | TTCN_1185 | 5059 |
| GTCN_200 | 1789 | ATCN_755 | 5060 |
| ATCN_181 | 1790 | CTCN_1164 | 5061 |
| ATCN_182 | 1791 | CTCN_1165 | 5062 |
| ATCN_183 | 1792 | GTCN_631 | 5063 |
| ATCN_184 | 1793 | CTCN_1166 | 5064 |
| CTCN_360 | 1794 | TTCN_1186 | 5065 |
| ATCN_185 | 1795 | CTCN_1167 | 5066 |
| ATCN_186 | 1796 | CTCN_1168 | 5067 |
| TTCN_333 | 1797 | GTCN_632 | 5068 |
| TTCN_334 | 1798 | CTCN_1169 | 5069 |
| CTCN_361 | 1799 | ATCN_756 | 5070 |
| ATCN_187 | 1800 | CTCN_1170 | 5071 |
| TTCN_335 | 1801 | CTCN_1171 | 5072 |
| ATCN_188 | 1802 | CTCN_1172 | 5073 |
| TTCN_336 | 1803 | TTCN_1187 | 5074 |
| GTCN_201 | 1804 | ATCN_757 | 5075 |
| ATCN_189 | 1805 | TTCN_1188 | 5076 |
| ATCN_190 | 1806 | CTCN_1173 | 5077 |
| CTCN_362 | 1807 | TTCN_1189 | 5078 |
| ATCN_191 | 1808 | CTCN_1174 | 5079 |
| TTCN_337 | 1809 | CTCN_1175 | 5080 |
| TTCN_338 | 1810 | CTCN_1176 | 5081 |
| TTCN_339 | 1811 | ATCN_758 | 5082 |
| CTCN_363 | 1812 | CTCN_1177 | 5083 |
| GTCN_202 | 1813 | ATCN_759 | 5084 |
| ATCN_192 | 1814 | TTCN_1190 | 5085 |
| ATCN_193 | 1815 | GTCN_633 | 5086 |
| TTCN_340 | 1816 | GTCN_634 | 5087 |
| GTCN_203 | 1817 | CTCN_1178 | 5088 |
| CTCN_364 | 1818 | CTCN_1179 | 5089 |
| GTCN_204 | 1819 | CTCN_1180 | 5090 |
| CTCN_365 | 1820 | ATCN_760 | 5091 |
| CTCN_366 | 1821 | ATCN_761 | 5092 |
| GTCN_205 | 1822 | CTCN_1181 | 5093 |
| ATCN_194 | 1823 | CTCN_1182 | 5094 |
| CTCN_367 | 1824 | TTCN_1191 | 5095 |
| CTCN_368 | 1825 | CTCN_1183 | 5096 |
| GTCN_206 | 1826 | CTCN_1184 | 5097 |
| TTCN_341 | 1827 | ATCN_762 | 5098 |
| TTCN_342 | 1828 | CTCN_1185 | 5099 |
| GTCN_207 | 1829 | ATCN_763 | 5100 |
| ATCN_195 | 1830 | CTCN_1186 | 5101 |
| ATCN_196 | 1831 | GTCN_635 | 5102 |
| TTCN_343 | 1832 | ATCN_764 | 5103 |
| CTCN_369 | 1833 | TTCN_1192 | 5104 |
| ATCN_197 | 1834 | TTCN_1193 | 5105 |
| GTCN_208 | 1835 | ATCN_765 | 5106 |

| | | | |
|---|---|---|---|
| ATCN_198 | 1836 | ATCN_766 | 5107 |
| TTCN_344 | 1837 | ATCN_767 | 5108 |
| CTCN_370 | 1838 | ATCN_768 | 5109 |
| GTCN_209 | 1839 | CTCN_1187 | 5110 |
| TTCN_345 | 1840 | ATCN_769 | 5111 |
| CTCN_371 | 1841 | GTCN_636 | 5112 |
| CTCN_372 | 1842 | ATCN_770 | 5113 |
| ATCN_199 | 1843 | ATCN_771 | 5114 |
| CTCN_373 | 1844 | CTCN_1188 | 5115 |
| CTCN_374 | 1845 | TTCN_1194 | 5116 |
| GTCN_210 | 1846 | GTCN_637 | 5117 |
| CTCN_375 | 1847 | GTCN_638 | 5118 |
| ATCN_200 | 1848 | CTCN_1189 | 5119 |
| CTCN_376 | 1849 | TTCN_1195 | 5120 |
| TTCN_346 | 1850 | ATCN_772 | 5121 |
| ATCN_201 | 1851 | ATCN_773 | 5122 |
| TTCN_347 | 1852 | CTCN_1190 | 5123 |
| TTCN_348 | 1853 | TTCN_1196 | 5124 |
| GTCN_211 | 1854 | GTCN_639 | 5125 |
| TTCN_349 | 1855 | GTCN_640 | 5126 |
| TTCN_350 | 1856 | TTCN_1197 | 5127 |
| TTCN_351 | 1857 | TTCN_1198 | 5128 |
| TTCN_352 | 1858 | CTCN_1191 | 5129 |
| TTCN_353 | 1859 | GTCN_641 | 5130 |
| ATCN_202 | 1860 | CTCN_1192 | 5131 |
| TTCN_354 | 1861 | GTCN_642 | 5132 |
| GTCN_212 | 1862 | GTCN_643 | 5133 |
| CTCN_377 | 1863 | TTCN_1199 | 5134 |
| GTCN_213 | 1864 | ATCN_774 | 5135 |
| ATCN_203 | 1865 | ATCN_775 | 5136 |
| GTCN_214 | 1866 | GTCN_644 | 5137 |
| ATCN_204 | 1867 | TTCN_1200 | 5138 |
| TTCN_355 | 1868 | ATCN_776 | 5139 |
| TTCN_356 | 1869 | TTCN_1201 | 5140 |
| TTCN_357 | 1870 | ATCN_777 | 5141 |
| TTCN_358 | 1871 | TTCN_1202 | 5142 |
| GTCN_215 | 1872 | GTCN_645 | 5143 |
| TTCN_359 | 1873 | GTCN_646 | 5144 |
| TTCN_360 | 1874 | CTCN_1193 | 5145 |
| TTCN_361 | 1875 | CTCN_1194 | 5146 |
| TTCN_362 | 1876 | CTCN_1195 | 5147 |
| CTCN_378 | 1877 | CTCN_1196 | 5148 |
| ATCN_205 | 1878 | TTCN_1203 | 5149 |
| CTCN_379 | 1879 | TTCN_1204 | 5150 |
| ATCN_206 | 1880 | CTCN_1197 | 5151 |
| ATCN_207 | 1881 | ATCN_778 | 5152 |
| CTCN_380 | 1882 | TTCN_1205 | 5153 |
| GTCN_216 | 1883 | CTCN_1198 | 5154 |
| CTCN_381 | 1884 | CTCN_1199 | 5155 |
| ATCN_208 | 1885 | ATCN_779 | 5156 |
| ATCN_209 | 1886 | ATCN_780 | 5157 |
| CTCN_382 | 1887 | CTCN_1200 | 5158 |
| CTCN_383 | 1888 | CTCN_1201 | 5159 |

FIG. 35 (continued)

| | | | |
|---|---|---|---|
| TTCN_363 | 1889 | TTCN_1206 | 5160 |
| ATCN_210 | 1890 | TTCN_1207 | 5161 |
| TTCN_364 | 1891 | CTCN_1202 | 5162 |
| CTCN_384 | 1892 | ATCN_781 | 5163 |
| CTCN_385 | 1893 | TTCN_1208 | 5164 |
| CTCN_386 | 1894 | TTCN_1209 | 5165 |
| CTCN_387 | 1895 | ATCN_782 | 5166 |
| ATCN_211 | 1896 | TTCN_1210 | 5167 |
| TTCN_365 | 1897 | CTCN_1203 | 5168 |
| TTCN_366 | 1898 | ATCN_783 | 5169 |
| TTCN_367 | 1899 | GTCN_647 | 5170 |
| GTCN_217 | 1900 | TTCN_1211 | 5171 |
| CTCN_388 | 1901 | GTCN_648 | 5172 |
| CTCN_389 | 1902 | ATCN_784 | 5173 |
| GTCN_218 | 1903 | CTCN_1204 | 5174 |
| CTCN_390 | 1904 | ATCN_785 | 5175 |
| ATCN_212 | 1905 | CTCN_1205 | 5176 |
| CTCN_391 | 1906 | CTCN_1206 | 5177 |
| ATCN_213 | 1907 | CTCN_1207 | 5178 |
| TTCN_368 | 1908 | CTCN_1208 | 5179 |
| TTCN_369 | 1909 | GTCN_649 | 5180 |
| TTCN_370 | 1910 | CTCN_1209 | 5181 |
| CTCN_392 | 1911 | ATCN_786 | 5182 |
| CTCN_393 | 1912 | CTCN_1210 | 5183 |
| TTCN_371 | 1913 | TTCN_1212 | 5184 |
| TTCN_372 | 1914 | ATCN_787 | 5185 |
| GTCN_219 | 1915 | TTCN_1213 | 5186 |
| TTCN_373 | 1916 | TTCN_1214 | 5187 |
| TTCN_374 | 1917 | GTCN_650 | 5188 |
| TTCN_375 | 1918 | TTCN_1215 | 5189 |
| CTCN_394 | 1919 | GTCN_651 | 5190 |
| ATCN_214 | 1920 | GTCN_652 | 5191 |
| TTCN_376 | 1921 | TTCN_1216 | 5192 |
| CTCN_395 | 1922 | TTCN_1217 | 5193 |
| GTCN_220 | 1923 | CTCN_1211 | 5194 |
| ATCN_215 | 1924 | TTCN_1218 | 5195 |
| ATCN_216 | 1925 | CTCN_1212 | 5196 |
| CTCN_396 | 1926 | TTCN_1219 | 5197 |
| TTCN_377 | 1927 | GTCN_653 | 5198 |
| TTCN_378 | 1928 | CTCN_1213 | 5199 |
| ATCN_217 | 1929 | TTCN_1220 | 5200 |
| TTCN_379 | 1930 | GTCN_654 | 5201 |
| TTCN_380 | 1931 | CTCN_1214 | 5202 |
| TTCN_381 | 1932 | ATCN_788 | 5203 |
| GTCN_221 | 1933 | CTCN_1215 | 5204 |
| TTCN_382 | 1934 | CTCN_1216 | 5205 |
| GTCN_222 | 1935 | TTCN_1221 | 5206 |
| GTCN_223 | 1936 | GTCN_655 | 5207 |
| CTCN_397 | 1937 | TTCN_1222 | 5208 |
| GTCN_224 | 1938 | GTCN_656 | 5209 |
| ATCN_218 | 1939 | CTCN_1217 | 5210 |
| ATCN_219 | 1940 | TTCN_1223 | 5211 |
| CTCN_398 | 1941 | ATCN_789 | 5212 |

| | | | |
|---|---|---|---|
| TTCN_383 | 1942 | CTCN_1218 | 5213 |
| GTCN_225 | 1943 | CTCN_1219 | 5214 |
| TTCN_384 | 1944 | CTCN_1220 | 5215 |
| GTCN_226 | 1945 | CTCN_1221 | 5216 |
| ATCN_220 | 1946 | TTCN_1224 | 5217 |
| TTCN_385 | 1947 | ATCN_790 | 5218 |
| GTCN_227 | 1948 | TTCN_1225 | 5219 |
| CTCN_399 | 1949 | CTCN_1222 | 5220 |
| GTCN_228 | 1950 | CTCN_1223 | 5221 |
| ATCN_221 | 1951 | CTCN_1224 | 5222 |
| ATCN_222 | 1952 | CTCN_1225 | 5223 |
| ATCN_223 | 1953 | CTCN_1226 | 5224 |
| TTCN_386 | 1954 | ATCN_791 | 5225 |
| TTCN_387 | 1955 | ATCN_792 | 5226 |
| ATCN_224 | 1956 | CTCN_1227 | 5227 |
| TTCN_388 | 1957 | CTCN_1228 | 5228 |
| TTCN_389 | 1958 | GTCN_657 | 5229 |
| TTCN_390 | 1959 | CTCN_1229 | 5230 |
| ATCN_225 | 1960 | CTCN_1230 | 5231 |
| TTCN_391 | 1961 | GTCN_658 | 5232 |
| CTCN_400 | 1962 | CTCN_1231 | 5233 |
| TTCN_392 | 1963 | ATCN_793 | 5234 |
| TTCN_393 | 1964 | CTCN_1232 | 5235 |
| TTCN_394 | 1965 | CTCN_1233 | 5236 |
| TTCN_395 | 1966 | TTCN_1226 | 5237 |
| ATCN_226 | 1967 | GTCN_659 | 5238 |
| GTCN_229 | 1968 | CTCN_1234 | 5239 |
| ATCN_227 | 1969 | ATCN_794 | 5240 |
| GTCN_230 | 1970 | ATCN_795 | 5241 |
| CTCN_401 | 1971 | CTCN_1235 | 5242 |
| CTCN_402 | 1972 | CTCN_1236 | 5243 |
| ATCN_228 | 1973 | CTCN_1237 | 5244 |
| TTCN_396 | 1974 | CTCN_1238 | 5245 |
| CTCN_403 | 1975 | ATCN_796 | 5246 |
| CTCN_404 | 1976 | ATCN_797 | 5247 |
| ATCN_229 | 1977 | ATCN_798 | 5248 |
| CTCN_405 | 1978 | GTCN_660 | 5249 |
| CTCN_406 | 1979 | GTCN_661 | 5250 |
| TTCN_397 | 1980 | CTCN_1239 | 5251 |
| GTCN_231 | 1981 | TTCN_1227 | 5252 |
| GTCN_232 | 1982 | GTCN_662 | 5253 |
| CTCN_407 | 1983 | TTCN_1228 | 5254 |
| GTCN_233 | 1984 | CTCN_1240 | 5255 |
| ATCN_230 | 1985 | CTCN_1241 | 5256 |
| CTCN_408 | 1986 | CTCN_1242 | 5257 |
| TTCN_398 | 1987 | CTCN_1243 | 5258 |
| TTCN_399 | 1988 | TTCN_1229 | 5259 |
| GTCN_234 | 1989 | ATCN_799 | 5260 |
| TTCN_400 | 1990 | TTCN_1230 | 5261 |
| CTCN_409 | 1991 | CTCN_1244 | 5262 |
| CTCN_410 | 1992 | CTCN_1245 | 5263 |
| ATCN_231 | 1993 | CTCN_1246 | 5264 |
| ATCN_232 | 1994 | ATCN_800 | 5265 |

FIG. 35 (continued)

| | | | |
|---|---|---|---|
| TTCN_401 | 1995 | GTCN_663 | 5266 |
| TTCN_402 | 1996 | GTCN_664 | 5267 |
| ATCN_233 | 1997 | TTCN_1231 | 5268 |
| ATCN_234 | 1998 | CTCN_1247 | 5269 |
| GTCN_235 | 1999 | TTCN_1232 | 5270 |
| TTCN_403 | 2000 | ATCN_801 | 5271 |
| TTCN_404 | 2001 | CTCN_1248 | 5272 |
| TTCN_405 | 2002 | TTCN_1233 | 5273 |
| CTCN_411 | 2003 | CTCN_1249 | 5274 |
| ATCN_235 | 2004 | TTCN_1234 | 5275 |
| TTCN_406 | 2005 | TTCN_1235 | 5276 |
| TTCN_407 | 2006 | CTCN_1250 | 5277 |
| GTCN_236 | 2007 | GTCN_665 | 5278 |
| TTCN_408 | 2008 | GTCN_666 | 5279 |
| TTCN_409 | 2009 | GTCN_667 | 5280 |
| ATCN_236 | 2010 | TTCN_1236 | 5281 |
| GTCN_237 | 2011 | TTCN_1237 | 5282 |
| CTCN_412 | 2012 | ATCN_802 | 5283 |
| CTCN_413 | 2013 | CTCN_1251 | 5284 |
| TTCN_410 | 2014 | CTCN_1252 | 5285 |
| CTCN_414 | 2015 | TTCN_1238 | 5286 |
| GTCN_238 | 2016 | TTCN_1239 | 5287 |
| CTCN_415 | 2017 | CTCN_1253 | 5288 |
| GTCN_239 | 2018 | CTCN_1254 | 5289 |
| GTCN_240 | 2019 | ATCN_803 | 5290 |
| CTCN_416 | 2020 | ATCN_804 | 5291 |
| CTCN_417 | 2021 | GTCN_668 | 5292 |
| ATCN_237 | 2022 | TTCN_1240 | 5293 |
| ATCN_238 | 2023 | GTCN_669 | 5294 |
| CTCN_418 | 2024 | CTCN_1255 | 5295 |
| CTCN_419 | 2025 | CTCN_1256 | 5296 |
| CTCN_420 | 2026 | GTCN_670 | 5297 |
| CTCN_421 | 2027 | TTCN_1241 | 5298 |
| TTCN_411 | 2028 | TTCN_1242 | 5299 |
| TTCN_412 | 2029 | ATCN_805 | 5300 |
| CTCN_422 | 2030 | ATCN_806 | 5301 |
| CTCN_423 | 2031 | TTCN_1243 | 5302 |
| CTCN_424 | 2032 | TTCN_1244 | 5303 |
| CTCN_425 | 2033 | TTCN_1245 | 5304 |
| CTCN_426 | 2034 | ATCN_807 | 5305 |
| TTCN_413 | 2035 | TTCN_1246 | 5306 |
| CTCN_427 | 2036 | CTCN_1257 | 5307 |
| GTCN_241 | 2037 | TTCN_1247 | 5308 |
| CTCN_428 | 2038 | CTCN_1258 | 5309 |
| GTCN_242 | 2039 | TTCN_1248 | 5310 |
| CTCN_429 | 2040 | GTCN_671 | 5311 |
| GTCN_243 | 2041 | CTCN_1259 | 5312 |
| CTCN_430 | 2042 | CTCN_1260 | 5313 |
| ATCN_239 | 2043 | GTCN_672 | 5314 |
| CTCN_431 | 2044 | GTCN_673 | 5315 |
| CTCN_432 | 2045 | ATCN_808 | 5316 |
| CTCN_433 | 2046 | GTCN_674 | 5317 |
| CTCN_434 | 2047 | TTCN_1249 | 5318 |

| | | | |
|---|---|---|---|
| ATCN_240 | 2048 | TTCN_1250 | 5319 |
| ATCN_241 | 2049 | CTCN_1261 | 5320 |
| GTCN_244 | 2050 | TTCN_1251 | 5321 |
| CTCN_435 | 2051 | CTCN_1262 | 5322 |
| CTCN_436 | 2052 | TTCN_1252 | 5323 |
| TTCN_414 | 2053 | CTCN_1263 | 5324 |
| ATCN_242 | 2054 | CTCN_1264 | 5325 |
| TTCN_415 | 2055 | CTCN_1265 | 5326 |
| TTCN_416 | 2056 | CTCN_1266 | 5327 |
| GTCN_245 | 2057 | TTCN_1253 | 5328 |
| GTCN_246 | 2058 | TTCN_1254 | 5329 |
| TTCN_417 | 2059 | TTCN_1255 | 5330 |
| CTCN_437 | 2060 | GTCN_675 | 5331 |
| GTCN_247 | 2061 | ATCN_809 | 5332 |
| CTCN_438 | 2062 | CTCN_1267 | 5333 |
| ATCN_243 | 2063 | TTCN_1256 | 5334 |
| CTCN_439 | 2064 | ATCN_810 | 5335 |
| CTCN_440 | 2065 | ATCN_811 | 5336 |
| ATCN_244 | 2066 | GTCN_676 | 5337 |
| CTCN_441 | 2067 | TTCN_1257 | 5338 |
| TTCN_418 | 2068 | TTCN_1258 | 5339 |
| TTCN_419 | 2069 | TTCN_1259 | 5340 |
| TTCN_420 | 2070 | TTCN_1260 | 5341 |
| CTCN_442 | 2071 | CTCN_1268 | 5342 |
| ATCN_245 | 2072 | ATCN_812 | 5343 |
| GTCN_248 | 2073 | CTCN_1269 | 5344 |
| CTCN_443 | 2074 | CTCN_1270 | 5345 |
| CTCN_444 | 2075 | GTCN_677 | 5346 |
| TTCN_421 | 2076 | CTCN_1271 | 5347 |
| ATCN_246 | 2077 | TTCN_1261 | 5348 |
| ATCN_247 | 2078 | CTCN_1272 | 5349 |
| CTCN_445 | 2079 | GTCN_678 | 5350 |
| CTCN_446 | 2080 | CTCN_1273 | 5351 |
| CTCN_447 | 2081 | GTCN_679 | 5352 |
| ATCN_248 | 2082 | GTCN_680 | 5353 |
| CTCN_448 | 2083 | CTCN_1274 | 5354 |
| GTCN_249 | 2084 | CTCN_1275 | 5355 |
| GTCN_250 | 2085 | CTCN_1276 | 5356 |
| CTCN_449 | 2086 | CTCN_1277 | 5357 |
| TTCN_422 | 2087 | ATCN_813 | 5358 |
| TTCN_423 | 2088 | CTCN_1278 | 5359 |
| ATCN_249 | 2089 | GTCN_681 | 5360 |
| CTCN_450 | 2090 | CTCN_1279 | 5361 |
| CTCN_451 | 2091 | GTCN_682 | 5362 |
| TTCN_424 | 2092 | GTCN_683 | 5363 |
| TTCN_425 | 2093 | CTCN_1280 | 5364 |
| TTCN_426 | 2094 | GTCN_684 | 5365 |
| CTCN_452 | 2095 | ATCN_814 | 5366 |
| GTCN_251 | 2096 | ATCN_815 | 5367 |
| GTCN_252 | 2097 | CTCN_1281 | 5368 |
| TTCN_427 | 2098 | CTCN_1282 | 5369 |
| GTCN_253 | 2099 | CTCN_1283 | 5370 |
| TTCN_428 | 2100 | CTCN_1284 | 5371 |

FIG. 35 (continued)

| | | | |
|---|---|---|---|
| TTCN_429 | 2281 | TTCN_1262 | 5372 |
| TTCN_430 | 2282 | ATCN_816 | 5373 |
| ATCN_250 | 2283 | TTCN_1263 | 5374 |
| TTCN_431 | 2284 | CTCN_1285 | 5375 |
| ATCN_251 | 2285 | CTCN_1286 | 5376 |
| ATCN_252 | 2286 | CTCN_1287 | 5377 |
| TTCN_432 | 2287 | CTCN_1288 | 5378 |
| CTCN_453 | 2288 | TTCN_1264 | 5379 |
| TTCN_433 | 2289 | CTCN_1289 | 5380 |
| TTCN_434 | 2290 | GTCN_685 | 5381 |
| ATCN_253 | 2291 | ATCN_817 | 5382 |
| GTCN_254 | 2292 | TTCN_1265 | 5383 |
| GTCN_255 | 2293 | ATCN_818 | 5384 |
| CTCN_454 | 2294 | GTCN_686 | 5385 |
| ATCN_254 | 2295 | GTCN_687 | 5386 |
| CTCN_455 | 2296 | CTCN_1290 | 5387 |
| GTCN_256 | 2297 | CTCN_1291 | 5388 |
| TTCN_435 | 2298 | GTCN_688 | 5389 |
| CTCN_456 | 2299 | CTCN_1292 | 5390 |
| GTCN_257 | 2300 | ATCN_819 | 5391 |
| CTCN_457 | 2301 | ATCN_820 | 5392 |
| CTCN_458 | 2302 | CTCN_1293 | 5393 |
| TTCN_436 | 2303 | CTCN_1294 | 5394 |
| ATCN_255 | 2304 | ATCN_821 | 5395 |
| GTCN_258 | 2305 | CTCN_1295 | 5396 |
| ATCN_256 | 2306 | CTCN_1296 | 5397 |
| CTCN_459 | 2307 | GTCN_689 | 5398 |
| TTCN_437 | 2308 | GTCN_690 | 5399 |
| CTCN_460 | 2309 | CTCN_1297 | 5400 |
| CTCN_461 | 2310 | TTCN_1266 | 5401 |
| TTCN_438 | 2311 | ATCN_822 | 5402 |
| CTCN_462 | 2312 | CTCN_1298 | 5403 |
| ATCN_257 | 2313 | ATCN_823 | 5404 |
| ATCN_258 | 2314 | CTCN_1299 | 5405 |
| ATCN_259 | 2315 | CTCN_1300 | 5406 |
| ATCN_260 | 2316 | CTCN_1301 | 5407 |
| CTCN_463 | 2317 | TTCN_1267 | 5408 |
| CTCN_464 | 2318 | ATCN_824 | 5409 |
| CTCN_465 | 2319 | TTCN_1268 | 5410 |
| CTCN_466 | 2320 | CTCN_1302 | 5411 |
| GTCN_259 | 2321 | CTCN_1303 | 5412 |
| TTCN_439 | 2322 | CTCN_1304 | 5413 |
| CTCN_467 | 2323 | CTCN_1305 | 5414 |
| CTCN_468 | 2324 | ATCN_825 | 5415 |
| TTCN_440 | 2325 | ATCN_826 | 5416 |
| TTCN_441 | 2326 | GTCN_691 | 5417 |
| CTCN_469 | 2327 | CTCN_1306 | 5418 |
| TTCN_442 | 2328 | GTCN_692 | 5419 |
| TTCN_443 | 2329 | GTCN_693 | 5420 |
| TTCN_444 | 2330 | GTCN_694 | 5421 |
| TTCN_445 | 2331 | ATCN_827 | 5422 |
| TTCN_446 | 2332 | CTCN_1307 | 5423 |
| CTCN_470 | 2333 | CTCN_1308 | 5424 |

| | | | |
|---|---|---|---|
| TTCN_447 | 2334 | CTCN_1309 | 5425 |
| GTCN_260 | 2335 | CTCN_1310 | 5426 |
| CTCN_471 | 2336 | CTCN_1311 | 5427 |
| CTCN_472 | 2337 | ATCN_828 | 5428 |
| TTCN_448 | 2338 | ATCN_829 | 5429 |
| ATCN_261 | 2339 | GTCN_695 | 5430 |
| TTCN_449 | 2340 | CTCN_1312 | 5431 |
| GTCN_261 | 2341 | ATCN_830 | 5432 |
| GTCN_262 | 2342 | TTCN_1269 | 5433 |
| GTCN_263 | 2343 | GTCN_696 | 5434 |
| GTCN_264 | 2344 | CTCN_1313 | 5435 |
| CTCN_473 | 2345 | TTCN_1270 | 5436 |
| ATCN_262 | 2346 | GTCN_697 | 5437 |
| CTCN_474 | 2347 | ATCN_831 | 5438 |
| TTCN_450 | 2348 | TTCN_1271 | 5439 |
| GTCN_265 | 2349 | ATCN_832 | 5440 |
| TTCN_451 | 2350 | CTCN_1314 | 5441 |
| ATCN_263 | 2351 | ATCN_833 | 5442 |
| CTCN_475 | 2352 | TTCN_1272 | 5443 |
| ATCN_264 | 2353 | ATCN_834 | 5444 |
| ATCN_265 | 2354 | ATCN_835 | 5445 |
| TTCN_452 | 2355 | TTCN_1273 | 5446 |
| GTCN_266 | 2356 | GTCN_698 | 5447 |
| CTCN_476 | 2357 | ATCN_836 | 5448 |
| CTCN_477 | 2358 | GTCN_699 | 5449 |
| GTCN_267 | 2359 | TTCN_1274 | 5450 |
| TTCN_453 | 2360 | GTCN_700 | 5451 |
| CTCN_478 | 2361 | TTCN_1275 | 5452 |
| ATCN_266 | 2362 | GTCN_701 | 5453 |
| CTCN_479 | 2363 | TTCN_1276 | 5454 |
| CTCN_480 | 2364 | CTCN_1315 | 5455 |
| CTCN_481 | 2365 | GTCN_702 | 5456 |
| GTCN_268 | 2366 | TTCN_1277 | 5457 |
| CTCN_482 | 2367 | TTCN_1278 | 5458 |
| CTCN_483 | 2368 | TTCN_1279 | 5459 |
| TTCN_454 | 2369 | TTCN_1280 | 5460 |
| CTCN_484 | 2370 | TTCN_1281 | 5461 |
| ATCN_267 | 2371 | CTCN_1316 | 5462 |
| ATCN_268 | 2372 | GTCN_703 | 5463 |
| TTCN_455 | 2373 | GTCN_704 | 5464 |
| TTCN_456 | 2374 | CTCN_1317 | 5465 |
| CTCN_485 | 2375 | ATCN_837 | 5466 |
| TTCN_457 | 2376 | CTCN_1318 | 5467 |
| TTCN_458 | 2377 | CTCN_1319 | 5468 |
| CTCN_486 | 2378 | CTCN_1320 | 5469 |
| CTCN_487 | 2379 | GTCN_705 | 5470 |
| CTCN_488 | 2380 | CTCN_1321 | 5471 |
| CTCN_489 | 2381 | ATCN_838 | 5472 |
| TTCN_459 | 2382 | CTCN_1322 | 5473 |
| GTCN_269 | 2383 | ATCN_839 | 5474 |
| GTCN_270 | 2384 | CTCN_1323 | 5475 |
| CTCN_490 | 2385 | CTCN_1324 | 5476 |
| CTCN_491 | 2386 | CTCN_1325 | 5477 |

FIG. 35 (continued)

| | | | |
|---|---|---|---|
| TTCN_460 | 2387 | GTCN_706 | 5478 |
| ATCN_269 | 2388 | TTCN_1282 | 5479 |
| TTCN_461 | 2389 | CTCN_1326 | 5480 |
| TTCN_462 | 2390 | ATCN_840 | 5481 |
| CTCN_492 | 2391 | GTCN_707 | 5482 |
| GTCN_271 | 2392 | CTCN_1327 | 5483 |
| CTCN_493 | 2393 | TTCN_1283 | 5484 |
| CTCN_494 | 2394 | GTCN_708 | 5485 |
| CTCN_495 | 2395 | TTCN_1284 | 5486 |
| TTCN_463 | 2396 | CTCN_1328 | 5487 |
| TTCN_464 | 2397 | TTCN_1285 | 5488 |
| TTCN_465 | 2398 | ATCN_841 | 5489 |
| ATCN_270 | 2399 | ATCN_842 | 5490 |
| TTCN_466 | 2400 | CTCN_1329 | 5491 |
| ATCN_271 | 2401 | GTCN_709 | 5492 |
| ATCN_272 | 2402 | CTCN_1330 | 5493 |
| GTCN_272 | 2403 | CTCN_1331 | 5494 |
| TTCN_467 | 2404 | CTCN_1332 | 5495 |
| CTCN_496 | 2405 | ATCN_843 | 5496 |
| GTCN_273 | 2406 | CTCN_1333 | 5497 |
| ATCN_273 | 2407 | CTCN_1334 | 5498 |
| GTCN_274 | 2408 | TTCN_1286 | 5499 |
| TTCN_468 | 2409 | GTCN_710 | 5500 |
| TTCN_469 | 2410 | ATCN_844 | 5501 |
| GTCN_275 | 2411 | ATCN_845 | 5502 |
| CTCN_497 | 2412 | TTCN_1287 | 5503 |
| CTCN_498 | 2413 | GTCN_711 | 5504 |
| TTCN_470 | 2414 | TTCN_1288 | 5505 |
| CTCN_499 | 2415 | CTCN_1335 | 5506 |
| TTCN_471 | 2416 | GTCN_712 | 5507 |
| CTCN_500 | 2417 | GTCN_713 | 5508 |
| CTCN_501 | 2418 | TTCN_1289 | 5509 |
| GTCN_276 | 2419 | TTCN_1290 | 5510 |
| TTCN_472 | 2420 | TTCN_1291 | 5511 |
| ATCN_274 | 2421 | ATCN_846 | 5512 |
| CTCN_502 | 2422 | ATCN_847 | 5513 |
| TTCN_473 | 2423 | ATCN_848 | 5514 |
| TTCN_474 | 2424 | ATCN_849 | 5515 |
| TTCN_475 | 2425 | TTCN_1292 | 5516 |
| CTCN_503 | 2426 | TTCN_1293 | 5517 |
| TTCN_476 | 2427 | TTCN_1294 | 5518 |
| CTCN_504 | 2428 | CTCN_1336 | 5519 |
| CTCN_505 | 2429 | CTCN_1337 | 5520 |
| TTCN_477 | 2430 | TTCN_1295 | 5521 |
| TTCN_478 | 2431 | TTCN_1296 | 5522 |
| CTCN_506 | 2432 | ATCN_850 | 5523 |
| CTCN_507 | 2433 | GTCN_714 | 5524 |
| CTCN_508 | 2434 | CTCN_1338 | 5525 |
| ATCN_275 | 2435 | CTCN_1339 | 5526 |
| CTCN_509 | 2436 | ATCN_851 | 5527 |
| GTCN_277 | 2437 | CTCN_1340 | 5528 |
| CTCN_510 | 2438 | GTCN_715 | 5529 |
| CTCN_511 | 2439 | ATCN_852 | 5530 |

| | | | |
|---|---|---|---|
| GTCN_278 | 2440 | GTCN_716 | 5531 |
| GTCN_279 | 2441 | ATCN_853 | 5532 |
| CTCN_512 | 2442 | GTCN_717 | 5533 |
| CTCN_513 | 2443 | CTCN_1341 | 5534 |
| TTCN_479 | 2444 | ATCN_854 | 5535 |
| CTCN_514 | 2445 | TTCN_1297 | 5536 |
| GTCN_280 | 2446 | TTCN_1298 | 5537 |
| TTCN_480 | 2447 | ATCN_855 | 5538 |
| TTCN_481 | 2448 | GTCN_718 | 5539 |
| CTCN_515 | 2449 | GTCN_719 | 5540 |
| TTCN_482 | 2450 | TTCN_1299 | 5541 |
| ATCN_276 | 2451 | ATCN_856 | 5542 |
| CTCN_516 | 2452 | TTCN_1300 | 5543 |
| CTCN_517 | 2453 | CTCN_1342 | 5544 |
| GTCN_281 | 2454 | GTCN_720 | 5545 |
| CTCN_518 | 2455 | GTCN_721 | 5546 |
| CTCN_519 | 2456 | TTCN_1301 | 5547 |
| CTCN_520 | 2457 | CTCN_1343 | 5548 |
| ATCN_277 | 2458 | TTCN_1302 | 5549 |
| TTCN_483 | 2459 | GTCN_722 | 5550 |
| TTCN_484 | 2460 | CTCN_1344 | 5551 |
| ATCN_278 | 2461 | GTCN_723 | 5552 |
| CTCN_521 | 2462 | CTCN_1345 | 5553 |
| CTCN_522 | 2463 | ATCN_857 | 5554 |
| CTCN_523 | 2464 | CTCN_1346 | 5555 |
| GTCN_282 | 2465 | ATCN_858 | 5556 |
| ATCN_279 | 2466 | CTCN_1347 | 5557 |
| ATCN_280 | 2467 | CTCN_1348 | 5558 |
| CTCN_524 | 2468 | CTCN_1349 | 5559 |
| CTCN_525 | 2469 | TTCN_1303 | 5560 |
| TTCN_485 | 2470 | TTCN_1304 | 5561 |
| CTCN_526 | 2471 | ATCN_859 | 5562 |
| CTCN_527 | 2472 | TTCN_1305 | 5563 |
| GTCN_283 | 2473 | CTCN_1350 | 5564 |
| CTCN_528 | 2474 | CTCN_1351 | 5565 |
| ATCN_281 | 2475 | CTCN_1352 | 5566 |
| ATCN_282 | 2476 | CTCN_1353 | 5567 |
| ATCN_283 | 2477 | TTCN_1306 | 5568 |
| ATCN_284 | 2478 | GTCN_724 | 5569 |
| ATCN_285 | 2479 | CTCN_1354 | 5570 |
| CTCN_529 | 2480 | ATCN_860 | 5571 |
| ATCN_286 | 2481 | TTCN_1307 | 5572 |
| TTCN_486 | 2482 | GTCN_725 | 5573 |
| CTCN_530 | 2483 | CTCN_1355 | 5574 |
| ATCN_287 | 2484 | CTCN_1356 | 5575 |
| GTCN_284 | 2485 | GTCN_726 | 5576 |
| TTCN_487 | 2486 | CTCN_1357 | 5577 |
| ATCN_288 | 2487 | ATCN_861 | 5578 |
| TTCN_488 | 2488 | ATCN_862 | 5579 |
| TTCN_489 | 2489 | CTCN_1358 | 5580 |
| TTCN_490 | 2490 | CTCN_1359 | 5581 |
| TTCN_491 | 2491 | ATCN_863 | 5582 |
| GTCN_285 | 2492 | TTCN_1308 | 5583 |

FIG. 35 (continued)

| | | | |
|---|---|---|---|
| CTCN_531 | 2493 | CTCN_1360 | 5584 |
| GTCN_286 | 2494 | TTCN_1309 | 5585 |
| TTCN_492 | 2495 | TTCN_1310 | 5586 |
| GTCN_287 | 2496 | CTCN_1361 | 5587 |
| TTCN_493 | 2497 | CTCN_1362 | 5588 |
| ATCN_289 | 2498 | GTCN_727 | 5589 |
| TTCN_494 | 2499 | TTCN_1311 | 5590 |
| TTCN_495 | 2500 | GTCN_728 | 5591 |
| TTCN_496 | 2501 | TTCN_1312 | 5592 |
| ATCN_290 | 2502 | TTCN_1313 | 5593 |
| ATCN_291 | 2503 | CTCN_1363 | 5594 |
| GTCN_288 | 2504 | GTCN_729 | 5595 |
| TTCN_497 | 2505 | CTCN_1364 | 5596 |
| ATCN_292 | 2506 | TTCN_1314 | 5597 |
| TTCN_498 | 2507 | GTCN_730 | 5598 |
| TTCN_499 | 2508 | TTCN_1315 | 5599 |
| TTCN_500 | 2509 | TTCN_1316 | 5600 |
| CTCN_532 | 2510 | TTCN_1317 | 5601 |
| CTCN_533 | 2511 | TTCN_1318 | 5602 |
| ATCN_293 | 2512 | ATCN_864 | 5603 |
| ATCN_294 | 2513 | CTCN_1365 | 5604 |
| TTCN_501 | 2514 | TTCN_1319 | 5605 |
| TTCN_502 | 2515 | ATCN_865 | 5606 |
| ATCN_295 | 2516 | CTCN_1366 | 5607 |
| TTCN_503 | 2517 | CTCN_1367 | 5608 |
| TTCN_504 | 2518 | GTCN_731 | 5609 |
| ATCN_296 | 2519 | CTCN_1368 | 5610 |
| CTCN_534 | 2520 | ATCN_866 | 5611 |
| ATCN_297 | 2521 | ATCN_867 | 5612 |
| CTCN_535 | 2522 | CTCN_1369 | 5613 |
| GTCN_289 | 2523 | CTCN_1370 | 5614 |
| TTCN_505 | 2524 | CTCN_1371 | 5615 |
| CTCN_536 | 2525 | GTCN_732 | 5616 |
| CTCN_537 | 2526 | CTCN_1372 | 5617 |
| TTCN_506 | 2527 | GTCN_733 | 5618 |
| CTCN_538 | 2528 | CTCN_1373 | 5619 |
| GTCN_290 | 2529 | CTCN_1374 | 5620 |
| TTCN_507 | 2530 | CTCN_1375 | 5621 |
| ATCN_298 | 2531 | ATCN_868 | 5622 |
| GTCN_291 | 2532 | GTCN_734 | 5623 |
| TTCN_508 | 2533 | TTCN_1320 | 5624 |
| ATCN_299 | 2534 | CTCN_1376 | 5625 |
| ATCN_300 | 2535 | CTCN_1377 | 5626 |
| TTCN_509 | 2536 | ATCN_869 | 5627 |
| TTCN_510 | 2537 | TTCN_1321 | 5628 |
| TTCN_511 | 2538 | CTCN_1378 | 5629 |
| TTCN_512 | 2539 | CTCN_1379 | 5630 |
| TTCN_513 | 2540 | CTCN_1380 | 5631 |
| CTCN_539 | 2541 | GTCN_735 | 5632 |
| CTCN_540 | 2542 | CTCN_1381 | 5633 |
| ATCN_301 | 2543 | GTCN_736 | 5634 |
| TTCN_514 | 2544 | CTCN_1382 | 5635 |
| TTCN_515 | 2545 | ATCN_870 | 5636 |

| | | | |
|---|---|---|---|
| TTCN_516 | 2546 | GTCN_737 | 5637 |
| CTCN_541 | 2547 | ATCN_871 | 5638 |
| TTCN_517 | 2548 | ATCN_872 | 5639 |
| TTCN_518 | 2549 | ATCN_873 | 5640 |
| TTCN_519 | 2550 | ATCN_874 | 5641 |
| ATCN_302 | 2551 | ATCN_875 | 5642 |
| TTCN_520 | 2552 | ATCN_876 | 5643 |
| TTCN_521 | 2553 | ATCN_877 | 5644 |
| TTCN_522 | 2554 | ATCN_878 | 5645 |
| TTCN_523 | 2555 | ATCN_879 | 5646 |
| TTCN_524 | 2556 | ATCN_880 | 5647 |
| TTCN_525 | 2557 | CTCN_1383 | 5648 |
| CTCN_542 | 2558 | TTCN_1322 | 5649 |
| ATCN_303 | 2559 | TTCN_1323 | 5650 |
| TTCN_526 | 2560 | ATCN_881 | 5651 |
| ATCN_304 | 2561 | CTCN_1384 | 5652 |
| TTCN_527 | 2562 | TTCN_1324 | 5653 |
| TTCN_528 | 2563 | CTCN_1385 | 5654 |
| TTCN_529 | 2564 | GTCN_738 | 5655 |
| TTCN_530 | 2565 | GTCN_739 | 5656 |
| TTCN_531 | 2566 | CTCN_1386 | 5657 |
| GTCN_292 | 2567 | CTCN_1387 | 5658 |
| GTCN_293 | 2568 | TTCN_1325 | 5659 |
| CTCN_543 | 2569 | TTCN_1326 | 5660 |
| TTCN_532 | 2570 | ATCN_882 | 5661 |
| TTCN_533 | 2571 | ATCN_883 | 5662 |
| TTCN_534 | 2572 | ATCN_884 | 5663 |
| CTCN_544 | 2573 | CTCN_1388 | 5664 |
| ATCN_305 | 2574 | TTCN_1327 | 5665 |
| TTCN_535 | 2575 | GTCN_740 | 5666 |
| TTCN_536 | 2576 | TTCN_1328 | 5667 |
| GTCN_294 | 2577 | CTCN_1389 | 5668 |
| CTCN_545 | 2578 | TTCN_1329 | 5669 |
| TTCN_537 | 2579 | CTCN_1390 | 5670 |
| ATCN_306 | 2580 | CTCN_1391 | 5671 |
| ATCN_307 | 2581 | ATCN_885 | 5672 |
| TTCN_538 | 2582 | ATCN_886 | 5673 |
| GTCN_295 | 2583 | ATCN_887 | 5674 |
| GTCN_296 | 2584 | CTCN_1392 | 5675 |
| GTCN_297 | 2585 | CTCN_1393 | 5676 |
| ATCN_308 | 2586 | ATCN_888 | 5677 |
| CTCN_546 | 2587 | ATCN_889 | 5678 |
| TTCN_539 | 2588 | ATCN_890 | 5679 |
| ATCN_309 | 2589 | TTCN_1330 | 5680 |
| ATCN_310 | 2590 | CTCN_1394 | 5681 |
| CTCN_547 | 2591 | ATCN_891 | 5682 |
| CTCN_548 | 2592 | CTCN_1395 | 5683 |
| TTCN_540 | 2593 | TTCN_1331 | 5684 |
| TTCN_541 | 2594 | TTCN_1332 | 5685 |
| TTCN_542 | 2595 | CTCN_1396 | 5686 |
| ATCN_311 | 2596 | CTCN_1397 | 5687 |
| TTCN_543 | 2597 | TTCN_1333 | 5688 |
| ATCN_312 | 2598 | TTCN_1334 | 5689 |

FIG. 35 (continued)

| | | | |
|---|---|---|---|
| ATCN_313 | 2599 | TTCN_1335 | 5690 |
| ATCN_314 | 2600 | TTCN_1336 | 5691 |
| CTCN_549 | 2601 | CTCN_1398 | 5692 |
| CTCN_550 | 2602 | ATCN_892 | 5693 |
| CTCN_551 | 2603 | ATCN_893 | 5694 |
| ATCN_315 | 2604 | ATCN_894 | 5695 |
| ATCN_316 | 2605 | CTCN_1399 | 5696 |
| GTCN_298 | 2606 | CTCN_1400 | 5697 |
| CTCN_552 | 2607 | CTCN_1401 | 5698 |
| ATCN_317 | 2608 | CTCN_1402 | 5699 |
| ATCN_318 | 2609 | ATCN_895 | 5700 |
| GTCN_299 | 2610 | ATCN_896 | 5701 |
| ATCN_319 | 2611 | TTCN_1337 | 5702 |
| GTCN_300 | 2612 | ATCN_897 | 5703 |
| CTCN_553 | 2613 | CTCN_1403 | 5704 |
| TTCN_544 | 2614 | ATCN_898 | 5705 |
| ATCN_320 | 2615 | ATCN_899 | 5706 |
| CTCN_554 | 2616 | CTCN_1404 | 5707 |
| GTCN_301 | 2617 | ATCN_900 | 5708 |
| CTCN_555 | 2618 | CTCN_1405 | 5709 |
| CTCN_556 | 2619 | GTCN_741 | 5710 |
| CTCN_557 | 2620 | GTCN_742 | 5711 |
| CTCN_558 | 2621 | CTCN_1406 | 5712 |
| TTCN_545 | 2622 | ATCN_901 | 5713 |
| TTCN_546 | 2623 | ATCN_902 | 5714 |
| CTCN_559 | 2624 | CTCN_1407 | 5715 |
| CTCN_560 | 2625 | CTCN_1408 | 5716 |
| CTCN_561 | 2626 | CTCN_1409 | 5717 |
| ATCN_321 | 2627 | CTCN_1410 | 5718 |
| ATCN_322 | 2628 | TTCN_1338 | 5719 |
| CTCN_562 | 2629 | TTCN_1339 | 5720 |
| CTCN_563 | 2630 | CTCN_1411 | 5721 |
| GTCN_302 | 2631 | CTCN_1412 | 5722 |
| ATCN_323 | 2632 | CTCN_1413 | 5723 |
| CTCN_564 | 2633 | GTCN_743 | 5724 |
| TTCN_547 | 2634 | CTCN_1414 | 5725 |
| ATCN_324 | 2635 | GTCN_744 | 5726 |
| CTCN_565 | 2636 | TTCN_1340 | 5727 |
| ATCN_325 | 2637 | ATCN_903 | 5728 |
| ATCN_326 | 2638 | GTCN_745 | 5729 |
| ATCN_327 | 2639 | CTCN_1415 | 5730 |
| GTCN_303 | 2640 | ATCN_904 | 5731 |
| ATCN_328 | 2641 | ATCN_905 | 5732 |
| TTCN_548 | 2642 | CTCN_1416 | 5733 |
| ATCN_329 | 2643 | GTCN_746 | 5734 |
| TTCN_549 | 2644 | CTCN_1417 | 5735 |
| GTCN_304 | 2645 | ATCN_906 | 5736 |
| ATCN_330 | 2646 | ATCN_907 | 5737 |
| ATCN_331 | 2647 | ATCN_908 | 5738 |
| ATCN_332 | 2648 | CTCN_1418 | 5739 |
| GTCN_305 | 2649 | ATCN_909 | 5740 |
| TTCN_550 | 2650 | TTCN_1341 | 5741 |
| TTCN_551 | 2651 | ATCN_910 | 5742 |

| | | | |
|---|---|---|---|
| GTCN_306 | 2652 | CTCN_1419 | 5743 |
| CTCN_566 | 2653 | GTCN_747 | 5744 |
| GTCN_307 | 2654 | ATCN_911 | 5745 |
| ATCN_333 | 2655 | TTCN_1342 | 5746 |
| CTCN_567 | 2656 | GTCN_748 | 5747 |
| CTCN_568 | 2657 | CTCN_1420 | 5748 |
| CTCN_569 | 2658 | CTCN_1421 | 5749 |
| CTCN_570 | 2659 | CTCN_1422 | 5750 |
| CTCN_571 | 2660 | CTCN_1423 | 5751 |
| TTCN_552 | 2661 | ATCN_912 | 5752 |
| CTCN_572 | 2662 | ATCN_913 | 5753 |
| TTCN_553 | 2663 | CTCN_1424 | 5754 |
| CTCN_573 | 2664 | GTCN_749 | 5755 |
| TTCN_554 | 2665 | TTCN_1343 | 5756 |
| GTCN_308 | 2666 | CTCN_1425 | 5757 |
| TTCN_555 | 2667 | ATCN_914 | 5758 |
| GTCN_309 | 2668 | ATCN_915 | 5759 |
| CTCN_574 | 2669 | CTCN_1426 | 5760 |
| GTCN_310 | 2670 | CTCN_1427 | 5761 |
| TTCN_556 | 2671 | CTCN_1428 | 5762 |
| ATCN_334 | 2672 | ATCN_916 | 5763 |
| GTCN_311 | 2673 | ATCN_917 | 5764 |
| ATCN_335 | 2674 | CTCN_1429 | 5765 |
| TTCN_557 | 2675 | TTCN_1344 | 5766 |
| ATCN_336 | 2676 | TTCN_1345 | 5767 |
| ATCN_337 | 2677 | GTCN_750 | 5768 |
| TTCN_558 | 2678 | TTCN_1346 | 5769 |
| TTCN_559 | 2679 | GTCN_751 | 5770 |
| TTCN_560 | 2680 | TTCN_1347 | 5771 |
| TTCN_561 | 2681 | ATCN_918 | 5772 |
| ATCN_338 | 2682 | GTCN_752 | 5773 |
| GTCN_312 | 2683 | TTCN_1348 | 5774 |
| GTCN_313 | 2684 | ATCN_919 | 5775 |
| TTCN_562 | 2685 | ATCN_920 | 5776 |
| CTCN_575 | 2686 | TTCN_1349 | 5777 |
| ATCN_339 | 2687 | CTCN_1430 | 5778 |
| GTCN_314 | 2688 | GTCN_753 | 5779 |
| ATCN_340 | 2689 | CTCN_1431 | 5780 |
| TTCN_563 | 2690 | GTCN_754 | 5781 |
| CTCN_576 | 2691 | CTCN_1432 | 5782 |
| GTCN_315 | 2692 | GTCN_755 | 5783 |
| TTCN_564 | 2693 | CTCN_1433 | 5784 |
| CTCN_577 | 2694 | ATCN_921 | 5785 |
| CTCN_578 | 2695 | ATCN_922 | 5786 |
| GTCN_316 | 2696 | GTCN_756 | 5787 |
| ATCN_341 | 2697 | TTCN_1350 | 5788 |
| TTCN_565 | 2698 | CTCN_1434 | 5789 |
| ATCN_342 | 2699 | TTCN_1351 | 5790 |
| GTCN_317 | 2700 | CTCN_1435 | 5791 |
| CTCN_579 | 2701 | GTCN_757 | 5792 |
| TTCN_566 | 2702 | CTCN_1436 | 5793 |
| GTCN_318 | 2703 | TTCN_1352 | 5794 |
| CTCN_580 | 2704 | CTCN_1437 | 5795 |

FIG. 35 (continued)

| | | | |
|---|---|---|---|
| TTCN_567 | 2705 | TTCN_1353 | 5796 |
| TTCN_568 | 2706 | CTCN_1438 | 5797 |
| TTCN_569 | 2707 | TTCN_1354 | 5798 |
| TTCN_570 | 2708 | CTCN_1439 | 5799 |
| GTCN_319 | 2709 | TTCN_1355 | 5800 |
| TTCN_571 | 2710 | TTCN_1356 | 5801 |
| TTCN_572 | 2711 | CTCN_1440 | 5802 |
| TTCN_573 | 2712 | ATCN_923 | 5803 |
| ATCN_343 | 2713 | TTCN_1357 | 5804 |
| TTCN_574 | 2714 | GTCN_758 | 5805 |
| CTCN_581 | 2715 | TTCN_1358 | 5806 |
| TTCN_575 | 2716 | TTCN_1359 | 5807 |
| ATCN_344 | 2717 | TTCN_1360 | 5808 |
| GTCN_320 | 2718 | CTCN_1441 | 5809 |
| CTCN_582 | 2719 | CTCN_1442 | 5810 |
| ATCN_345 | 2720 | ATCN_924 | 5811 |
| ATCN_346 | 2721 | TTCN_1361 | 5812 |
| ATCN_347 | 2722 | TTCN_1362 | 5813 |
| CTCN_583 | 2723 | GTCN_759 | 5814 |
| GTCN_321 | 2724 | CTCN_1443 | 5815 |
| CTCN_584 | 2725 | ATCN_925 | 5816 |
| ATCN_348 | 2726 | ATCN_926 | 5817 |
| ATCN_349 | 2727 | TTCN_1363 | 5818 |
| CTCN_585 | 2728 | TTCN_1364 | 5819 |
| CTCN_586 | 2729 | TTCN_1365 | 5820 |
| TTCN_576 | 2730 | CTCN_1444 | 5821 |
| CTCN_587 | 2731 | CTCN_1445 | 5822 |
| ATCN_350 | 2732 | TTCN_1366 | 5823 |
| ATCN_351 | 2733 | CTCN_1446 | 5824 |
| ATCN_352 | 2734 | CTCN_1447 | 5825 |
| CTCN_588 | 2735 | CTCN_1448 | 5826 |
| CTCN_589 | 2736 | TTCN_1367 | 5827 |
| GTCN_322 | 2737 | ATCN_927 | 5828 |
| CTCN_590 | 2738 | GTCN_760 | 5829 |
| GTCN_323 | 2739 | ATCN_928 | 5830 |
| CTCN_591 | 2740 | TTCN_1368 | 5831 |
| GTCN_324 | 2741 | CTCN_1449 | 5832 |
| CTCN_592 | 2742 | TTCN_1369 | 5833 |
| GTCN_325 | 2743 | CTCN_1450 | 5834 |
| TTCN_577 | 2744 | CTCN_1451 | 5835 |
| TTCN_578 | 2745 | TTCN_1370 | 5836 |
| TTCN_579 | 2746 | CTCN_1452 | 5837 |
| CTCN_593 | 2747 | CTCN_1453 | 5838 |
| CTCN_594 | 2748 | GTCN_761 | 5839 |
| CTCN_595 | 2749 | CTCN_1454 | 5840 |
| CTCN_596 | 2750 | ATCN_929 | 5841 |
| ATCN_353 | 2751 | GTCN_762 | 5842 |
| CTCN_597 | 2752 | CTCN_1455 | 5843 |
| CTCN_598 | 2753 | ATCN_930 | 5844 |
| TTCN_580 | 2754 | CTCN_1456 | 5845 |
| TTCN_581 | 2755 | GTCN_763 | 5846 |
| TTCN_582 | 2756 | ATCN_931 | 5847 |
| ATCN_354 | 2757 | ATCN_932 | 5848 |

| | | | |
|---|---|---|---|
| TTCN_583 | 2758 | CTCN_1457 | 5849 |
| TTCN_584 | 2759 | GTCN_764 | 5850 |
| CTCN_599 | 2760 | TTCN_1371 | 5851 |
| GTCN_326 | 2761 | GTCN_765 | 5852 |
| CTCN_600 | 2762 | ATCN_933 | 5853 |
| TTCN_585 | 2763 | CTCN_1458 | 5854 |
| GTCN_327 | 2764 | TTCN_1372 | 5855 |
| GTCN_328 | 2765 | TTCN_1373 | 5856 |
| GTCN_329 | 2766 | TTCN_1374 | 5857 |
| TTCN_586 | 2767 | ATCN_934 | 5858 |
| GTCN_330 | 2768 | ATCN_935 | 5859 |
| TTCN_587 | 2769 | GTCN_766 | 5860 |
| GTCN_331 | 2770 | CTCN_1459 | 5861 |
| TTCN_588 | 2771 | GTCN_767 | 5862 |
| CTCN_601 | 2772 | CTCN_1460 | 5863 |
| ATCN_355 | 2773 | TTCN_1375 | 5864 |
| CTCN_602 | 2774 | ATCN_936 | 5865 |
| ATCN_356 | 2775 | TTCN_1376 | 5866 |
| TTCN_589 | 2776 | TTCN_1377 | 5867 |
| TTCN_590 | 2777 | TTCN_1378 | 5868 |
| TTCN_591 | 2778 | CTCN_1461 | 5869 |
| CTCN_603 | 2779 | GTCN_768 | 5870 |
| TTCN_592 | 2780 | GTCN_769 | 5871 |
| TTCN_593 | 2781 | GTCN_770 | 5872 |
| CTCN_604 | 2782 | GTCN_771 | 5873 |
| GTCN_332 | 2783 | ATCN_937 | 5874 |
| TTCN_594 | 2784 | ATCN_938 | 5875 |
| TTCN_595 | 2785 | TTCN_1379 | 5876 |
| ATCN_357 | 2786 | ATCN_939 | 5877 |
| TTCN_596 | 2787 | TTCN_1380 | 5878 |
| CTCN_605 | 2788 | GTCN_772 | 5879 |
| TTCN_597 | 2789 | CTCN_1462 | 5880 |
| TTCN_598 | 2790 | GTCN_773 | 5881 |
| GTCN_333 | 2791 | CTCN_1463 | 5882 |
| GTCN_334 | 2792 | TTCN_1381 | 5883 |
| ATCN_358 | 2793 | CTCN_1464 | 5884 |
| TTCN_599 | 2794 | TTCN_1382 | 5885 |
| ATCN_359 | 2795 | ATCN_940 | 5886 |
| CTCN_606 | 2796 | CTCN_1465 | 5887 |
| GTCN_335 | 2797 | TTCN_1383 | 5888 |
| TTCN_600 | 2798 | CTCN_1466 | 5889 |
| GTCN_336 | 2799 | CTCN_1467 | 5890 |
| TTCN_601 | 2800 | ATCN_941 | 5891 |
| CTCN_607 | 2801 | GTCN_774 | 5892 |
| TTCN_602 | 2802 | CTCN_1468 | 5893 |
| TTCN_603 | 2803 | TTCN_1384 | 5894 |
| ATCN_360 | 2804 | TTCN_1385 | 5895 |
| TTCN_604 | 2805 | TTCN_1386 | 5896 |
| CTCN_608 | 2806 | CTCN_1469 | 5897 |
| TTCN_605 | 2807 | CTCN_1470 | 5898 |
| TTCN_606 | 2808 | CTCN_1471 | 5899 |
| ATCN_361 | 2809 | ATCN_942 | 5900 |
| TTCN_607 | 2810 | CTCN_1472 | 5901 |

FIG. 35 (continued)

| | | | |
|---|---|---|---|
| TTCN_608 | 2811 | ATCN_943 | 5902 |
| GTCN_337 | 2812 | ATCN_944 | 5903 |
| GTCN_338 | 2813 | TTCN_1387 | 5904 |
| ATCN_362 | 2814 | TTCN_1388 | 5905 |
| CTCN_609 | 2815 | ATCN_945 | 5906 |
| CTCN_610 | 2816 | ATCN_946 | 5907 |
| TTCN_609 | 2817 | TTCN_1389 | 5908 |
| ATCN_363 | 2818 | ATCN_947 | 5909 |
| ATCN_364 | 2819 | CTCN_1473 | 5910 |
| TTCN_610 | 2820 | ATCN_948 | 5911 |
| TTCN_611 | 2821 | CTCN_1474 | 5912 |
| GTCN_339 | 2822 | TTCN_1390 | 5913 |
| CTCN_611 | 2823 | ATCN_949 | 5914 |
| CTCN_612 | 2824 | ATCN_950 | 5915 |
| GTCN_340 | 2825 | GTCN_775 | 5916 |
| ATCN_365 | 2826 | TTCN_1391 | 5917 |
| TTCN_612 | 2827 | CTCN_1475 | 5918 |
| TTCN_613 | 2828 | ATCN_951 | 5919 |
| TTCN_614 | 2829 | CTCN_1476 | 5920 |
| TTCN_615 | 2830 | CTCN_1477 | 5921 |
| TTCN_616 | 2831 | ATCN_952 | 5922 |
| ATCN_366 | 2832 | CTCN_1478 | 5923 |
| ATCN_367 | 2833 | ATCN_953 | 5924 |
| TTCN_617 | 2834 | TTCN_1392 | 5925 |
| TTCN_618 | 2835 | ATCN_954 | 5926 |
| GTCN_341 | 2836 | ATCN_955 | 5927 |
| ATCN_368 | 2837 | ATCN_956 | 5928 |
| TTCN_619 | 2838 | CTCN_1479 | 5929 |
| TTCN_620 | 2839 | TTCN_1393 | 5930 |
| ATCN_369 | 2840 | TTCN_1394 | 5931 |
| CTCN_613 | 2841 | ATCN_957 | 5932 |
| CTCN_614 | 2842 | ATCN_958 | 5933 |
| CTCN_615 | 2843 | TTCN_1395 | 5934 |
| CTCN_616 | 2844 | TTCN_1396 | 5935 |
| CTCN_617 | 2845 | TTCN_1397 | 5936 |
| CTCN_618 | 2846 | CTCN_1480 | 5937 |
| CTCN_619 | 2847 | TTCN_1398 | 5938 |
| TTCN_621 | 2848 | ATCN_959 | 5939 |
| CTCN_620 | 2849 | TTCN_1399 | 5940 |
| GTCN_342 | 2850 | TTCN_1400 | 5941 |
| CTCN_621 | 2851 | ATCN_960 | 5942 |
| GTCN_343 | 2852 | GTCN_776 | 5943 |
| CTCN_622 | 2853 | CTCN_1481 | 5944 |
| GTCN_344 | 2854 | TTCN_1401 | 5945 |
| CTCN_623 | 2855 | GTCN_777 | 5946 |
| ATCN_370 | 2856 | TTCN_1402 | 5947 |
| ATCN_371 | 2857 | CTCN_1482 | 5948 |
| TTCN_622 | 2858 | TTCN_1403 | 5949 |
| CTCN_624 | 2859 | CTCN_1483 | 5950 |
| TTCN_623 | 2860 | TTCN_1404 | 5951 |
| TTCN_624 | 2861 | TTCN_1405 | 5952 |
| TTCN_625 | 2862 | TTCN_1406 | 5953 |
| CTCN_625 | 2863 | TTCN_1407 | 5954 |

| | | | |
|---|---|---|---|
| CTCN_626 | 2864 | CTCN_1484 | 5955 |
| CTCN_627 | 2865 | TTCN_1408 | 5956 |
| CTCN_628 | 2866 | TTCN_1409 | 5957 |
| ATCN_372 | 2867 | CTCN_1485 | 5958 |
| GTCN_345 | 2868 | TTCN_1410 | 5959 |
| CTCN_629 | 2869 | TTCN_1411 | 5960 |
| GTCN_346 | 2870 | TTCN_1412 | 5961 |
| TTCN_626 | 2871 | GTCN_778 | 5962 |
| ATCN_373 | 2872 | ATCN_961 | 5963 |
| CTCN_630 | 2873 | GTCN_779 | 5964 |
| CTCN_631 | 2874 | CTCN_1486 | 5965 |
| CTCN_632 | 2875 | ATCN_962 | 5966 |
| TTCN_627 | 2876 | GTCN_780 | 5967 |
| CTCN_633 | 2877 | ATCN_963 | 5968 |
| GTCN_347 | 2878 | TTCN_1413 | 5969 |
| CTCN_634 | 2879 | ATCN_964 | 5970 |
| ATCN_374 | 2880 | TTCN_1414 | 5971 |
| ATCN_375 | 2881 | CTCN_1487 | 5972 |
| CTCN_635 | 2882 | ATCN_965 | 5973 |
| ATCN_376 | 2883 | CTCN_1488 | 5974 |
| CTCN_636 | 2884 | GTCN_781 | 5975 |
| CTCN_637 | 2885 | CTCN_1489 | 5976 |
| CTCN_638 | 2886 | GTCN_782 | 5977 |
| CTCN_639 | 2887 | ATCN_966 | 5978 |
| TTCN_628 | 2888 | ATCN_967 | 5979 |
| ATCN_377 | 2889 | CTCN_1490 | 5980 |
| ATCN_378 | 2890 | TTCN_1415 | 5981 |
| TTCN_629 | 2891 | ATCN_968 | 5982 |
| TTCN_630 | 2892 | TTCN_1416 | 5983 |
| TTCN_631 | 2893 | CTCN_1491 | 5984 |
| TTCN_632 | 2894 | TTCN_1417 | 5985 |
| ATCN_279 | 2895 | ATCN_969 | 5986 |
| ATCN_280 | 2896 | TTCN_1418 | 5987 |
| CTCN_524 | 2897 | ATCN_970 | 5988 |
| CTCN_525 | 2898 | ATCN_971 | 5989 |
| TTCN_485 | 2899 | TTCN_1419 | 5990 |
| CTCN_526 | 2900 | TTCN_1420 | 5991 |
| CTCN_527 | 2901 | CTCN_1492 | 5992 |
| GTCN_283 | 2902 | TTCN_1421 | 5993 |
| CTCN_528 | 2903 | GTCN_783 | 5994 |
| ATCN_281 | 2904 | ATCN_972 | 5995 |
| ATCN_282 | 2905 | ATCN_973 | 5996 |
| ATCN_283 | 2906 | CTCN_1493 | 5997 |
| ATCN_284 | 2907 | TTCN_1422 | 5998 |
| ATCN_285 | 2908 | TTCN_1423 | 5999 |
| CTCN_529 | 2909 | GTCN_784 | 6000 |
| ATCN_286 | 2910 | CTCN_1494 | 6001 |
| TTCN_486 | 2911 | CTCN_1495 | 6002 |
| CTCN_530 | 2912 | ATCN_974 | 6003 |
| ATCN_287 | 2913 | ATCN_975 | 6004 |
| GTCN_284 | 2914 | CTCN_1496 | 6005 |
| TTCN_487 | 2915 | ATCN_976 | 6006 |
| ATCN_288 | 2916 | TTCN_1424 | 6007 |

FIG. 35 (continued)

| | | | |
|---|---|---|---|
| TTCN_488 | 2917 | TTCN_1425 | 6008 |
| TTCN_489 | 2918 | TTCN_1426 | 6009 |
| TTCN_490 | 2919 | TTCN_1427 | 6010 |
| TTCN_491 | 2920 | ATCN_977 | 6011 |
| GTCN_285 | 2921 | CTCN_1497 | 6012 |
| CTCN_531 | 2922 | CTCN_1498 | 6013 |
| GTCN_286 | 2923 | ATCN_978 | 6014 |
| TTCN_492 | 2924 | TTCN_1428 | 6015 |
| GTCN_287 | 2925 | CTCN_1499 | 6016 |
| TTCN_493 | 2926 | TTCN_1429 | 6017 |
| ATCN_289 | 2927 | TTCN_1430 | 6018 |
| TTCN_494 | 2928 | TTCN_1431 | 6019 |
| TTCN_495 | 2929 | CTCN_1500 | 6020 |
| TTCN_496 | 2930 | CTCN_1501 | 6021 |
| ATCN_290 | 2931 | ATCN_979 | 6022 |
| ATCN_291 | 2932 | GTCN_785 | 6023 |
| GTCN_288 | 2933 | CTCN_1502 | 6024 |
| TTCN_497 | 2934 | TTCN_1432 | 6025 |
| ATCN_292 | 2935 | TTCN_1433 | 6026 |
| TTCN_498 | 2936 | GTCN_786 | 6027 |
| TTCN_499 | 2937 | ATCN_980 | 6028 |
| TTCN_500 | 2938 | GTCN_787 | 6029 |
| CTCN_532 | 2939 | CTCN_1503 | 6030 |
| CTCN_533 | 2940 | GTCN_788 | 6031 |
| ATCN_293 | 2941 | CTCN_1504 | 6032 |
| ATCN_294 | 2942 | CTCN_1505 | 6033 |
| TTCN_501 | 2943 | TTCN_1434 | 6034 |
| TTCN_502 | 2944 | CTCN_1506 | 6035 |
| ATCN_295 | 2945 | ATCN_981 | 6036 |
| TTCN_503 | 2946 | ATCN_982 | 6037 |
| TTCN_504 | 2947 | CTCN_1507 | 6038 |
| ATCN_296 | 2948 | CTCN_1508 | 6039 |
| CTCN_534 | 2949 | CTCN_1509 | 6040 |
| ATCN_297 | 2950 | TTCN_1435 | 6041 |
| CTCN_535 | 2951 | ATCN_983 | 6042 |
| GTCN_289 | 2952 | ATCN_984 | 6043 |
| TTCN_505 | 2953 | CTCN_1510 | 6044 |
| CTCN_536 | 2954 | CTCN_1511 | 6045 |
| CTCN_537 | 2955 | CTCN_1512 | 6046 |
| TTCN_506 | 2956 | CTCN_1513 | 6047 |
| CTCN_538 | 2957 | ATCN_985 | 6048 |
| GTCN_290 | 2958 | CTCN_1514 | 6049 |
| TTCN_507 | 2959 | ATCN_986 | 6050 |
| ATCN_298 | 2960 | ATCN_987 | 6051 |
| GTCN_291 | 2961 | CTCN_1515 | 6052 |
| TTCN_508 | 2962 | TTCN_1436 | 6053 |
| ATCN_299 | 2963 | TTCN_1437 | 6054 |
| ATCN_300 | 2964 | ATCN_988 | 6055 |
| TTCN_509 | 2965 | TTCN_1438 | 6056 |
| TTCN_510 | 2966 | CTCN_1516 | 6057 |
| TTCN_511 | 2967 | GTCN_789 | 6058 |
| TTCN_512 | 2968 | CTCN_1517 | 6059 |
| TTCN_513 | 2969 | ATCN_989 | 6060 |

| | | | |
|---|---|---|---|
| CTCN_539 | 2970 | ATCN_990 | 6061 |
| CTCN_540 | 2971 | CTCN_1518 | 6062 |
| ATCN_301 | 2972 | CTCN_1519 | 6063 |
| TTCN_514 | 2973 | ATCN_991 | 6064 |
| TTCN_515 | 2974 | CTCN_1520 | 6065 |
| TTCN_516 | 2975 | GTCN_790 | 6066 |
| CTCN_541 | 2976 | CTCN_1521 | 6067 |
| TTCN_517 | 2977 | GTCN_791 | 6068 |
| TTCN_518 | 2978 | GTCN_792 | 6069 |
| TTCN_519 | 2979 | CTCN_1522 | 6070 |
| ATCN_302 | 2980 | CTCN_1523 | 6071 |
| TTCN_520 | 2981 | CTCN_1524 | 6072 |
| TTCN_521 | 2982 | CTCN_1525 | 6073 |
| TTCN_522 | 2983 | GTCN_793 | 6074 |
| TTCN_523 | 2984 | TTCN_1439 | 6075 |
| TTCN_524 | 2985 | TTCN_1440 | 6076 |
| TTCN_525 | 2986 | CTCN_1526 | 6077 |
| CTCN_542 | 2987 | TTCN_1441 | 6078 |
| ATCN_303 | 2988 | ATCN_992 | 6079 |
| TTCN_526 | 2989 | ATCN_993 | 6080 |
| ATCN_304 | 2990 | CTCN_1527 | 6081 |
| TTCN_527 | 2991 | CTCN_1528 | 6082 |
| TTCN_528 | 2992 | TTCN_1442 | 6083 |
| TTCN_529 | 2993 | ATCN_994 | 6084 |
| TTCN_530 | 2994 | ATCN_995 | 6085 |
| TTCN_531 | 2995 | CTCN_1529 | 6086 |
| GTCN_292 | 2996 | ATCN_996 | 6087 |
| GTCN_293 | 2997 | CTCN_1530 | 6088 |
| CTCN_543 | 2998 | TTCN_1443 | 6089 |
| TTCN_532 | 2999 | TTCN_1444 | 6090 |
| TTCN_533 | 3000 | TTCN_1445 | 6091 |
| TTCN_534 | 3001 | CTCN_1531 | 6092 |
| CTCN_544 | 3002 | TTCN_1446 | 6093 |
| ATCN_305 | 3003 | TTCN_1447 | 6094 |
| TTCN_535 | 3004 | TTCN_1448 | 6095 |
| TTCN_536 | 3005 | CTCN_1532 | 6096 |
| GTCN_294 | 3006 | TTCN_1449 | 6097 |
| CTCN_545 | 3007 | GTCN_794 | 6098 |
| TTCN_537 | 3008 | TTCN_1450 | 6099 |
| ATCN_306 | 3009 | GTCN_795 | 6100 |
| ATCN_307 | 3010 | ATCN_997 | 6101 |
| TTCN_538 | 3011 | TTCN_1451 | 6102 |
| GTCN_295 | 3012 | ATCN_998 | 6103 |
| GTCN_296 | 3013 | TTCN_1452 | 6104 |
| GTCN_297 | 3014 | GTCN_796 | 6105 |
| ATCN_308 | 3015 | CTCN_1533 | 6106 |
| CTCN_546 | 3016 | GTCN_797 | 6107 |
| TTCN_539 | 3017 | GTCN_798 | 6108 |
| ATCN_309 | 3018 | CTCN_1534 | 6109 |
| ATCN_310 | 3019 | GTCN_799 | 6110 |
| CTCN_547 | 3020 | CTCN_1535 | 6111 |
| CTCN_548 | 3021 | ATCN_999 | 6112 |
| TTCN_540 | 3022 | TTCN_1453 | 6113 |

FIG. 35 (continued)

| | | | |
|---|---|---|---|
| TTCN_541 | 3023 | TTCN_1454 | 6114 |
| TTCN_542 | 3024 | TTCN_1455 | 6115 |
| ATCN_311 | 3025 | GTCN_800 | 6116 |
| TTCN_543 | 3026 | ATCN_1000 | 6117 |
| ATCN_312 | 3027 | TTCN_1456 | 6118 |
| ATCN_313 | 3028 | CTCN_1536 | 6119 |
| ATCN_314 | 3029 | GTCN_801 | 6120 |
| CTCN_549 | 3030 | CTCN_1537 | 6121 |
| CTCN_550 | 3031 | TTCN_1457 | 6122 |
| CTCN_551 | 3032 | GTCN_802 | 6123 |
| ATCN_315 | 3033 | CTCN_1538 | 6124 |
| ATCN_316 | 3034 | CTCN_1539 | 6125 |
| GTCN_298 | 3035 | GTCN_803 | 6126 |
| CTCN_552 | 3036 | ATCN_1001 | 6127 |
| ATCN_317 | 3037 | GTCN_804 | 6128 |
| ATCN_318 | 3038 | CTCN_1540 | 6129 |
| GTCN_299 | 3039 | TTCN_1458 | 6130 |
| ATCN_319 | 3040 | CTCN_1541 | 6131 |
| GTCN_300 | 3041 | CTCN_1542 | 6132 |
| CTCN_553 | 3042 | CTCN_1543 | 6133 |
| TTCN_544 | 3043 | CTCN_1544 | 6134 |
| ATCN_320 | 3044 | CTCN_1545 | 6135 |
| CTCN_554 | 3045 | TTCN_1459 | 6136 |
| GTCN_301 | 3046 | ATCN_1002 | 6137 |
| CTCN_555 | 3047 | CTCN_1546 | 6138 |
| CTCN_556 | 3048 | CTCN_1547 | 6139 |
| CTCN_557 | 3049 | CTCN_1548 | 6140 |
| CTCN_558 | 3050 | CTCN_1549 | 6141 |
| TTCN_545 | 3051 | GTCN_805 | 6142 |
| TTCN_546 | 3052 | CTCN_1550 | 6143 |
| CTCN_559 | 3053 | TTCN_1460 | 6144 |
| CTCN_560 | 3054 | TTCN_1461 | 6145 |
| CTCN_561 | 3055 | CTCN_1551 | 6146 |
| ATCN_321 | 3056 | GTCN_806 | 6147 |
| ATCN_322 | 3057 | CTCN_1552 | 6148 |
| CTCN_562 | 3058 | GTCN_807 | 6149 |
| CTCN_563 | 3059 | GTCN_808 | 6150 |
| GTCN_302 | 3060 | TTCN_1462 | 6151 |
| ATCN_323 | 3061 | CTCN_1553 | 6152 |
| CTCN_564 | 3062 | TTCN_1463 | 6153 |
| TTCN_547 | 3063 | CTCN_1554 | 6154 |
| ATCN_324 | 3064 | CTCN_1555 | 6155 |
| CTCN_565 | 3065 | CTCN_1556 | 6156 |
| ATCN_325 | 3066 | TTCN_1464 | 6157 |
| ATCN_326 | 3067 | CTCN_1557 | 6158 |
| ATCN_327 | 3068 | CTCN_1558 | 6159 |
| GTCN_303 | 3069 | CTCN_1559 | 6160 |
| ATCN_328 | 3070 | ATCN_1003 | 6161 |
| TTCN_548 | 3071 | TTCN_1465 | 6162 |
| ATCN_329 | 3072 | GTCN_809 | 6163 |
| TTCN_549 | 3073 | TTCN_1466 | 6164 |
| GTCN_304 | 3074 | GTCN_810 | 6165 |
| ATCN_330 | 3075 | GTCN_811 | 6166 |

| | | | |
|---|---|---|---|
| ATCN_331 | 3076 | ATCN_1004 | 6167 |
| ATCN_332 | 3077 | ATCN_1005 | 6168 |
| GTCN_305 | 3078 | CTCN_1560 | 6169 |
| TTCN_550 | 3079 | TTCN_1467 | 6170 |
| TTCN_551 | 3080 | ATCN_1006 | 6171 |
| GTCN_306 | 3081 | TTCN_1468 | 6172 |
| CTCN_566 | 3082 | TTCN_1469 | 6173 |
| GTCN_307 | 3083 | TTCN_1470 | 6174 |
| ATCN_333 | 3084 | CTCN_1561 | 6175 |
| CTCN_567 | 3085 | CTCN_1562 | 6176 |
| CTCN_568 | 3086 | TTCN_1471 | 6177 |
| CTCN_569 | 3087 | CTCN_1563 | 6178 |
| CTCN_570 | 3088 | TTCN_1472 | 6179 |
| CTCN_571 | 3089 | CTCN_1564 | 6180 |
| TTCN_552 | 3090 | CTCN_1565 | 6181 |
| CTCN_572 | 3091 | GTCN_812 | 6182 |
| TTCN_553 | 3092 | TTCN_1473 | 6183 |
| CTCN_573 | 3093 | GTCN_813 | 6184 |
| TTCN_554 | 3094 | CTCN_1566 | 6185 |
| GTCN_308 | 3095 | TTCN_1474 | 6186 |
| TTCN_555 | 3096 | ATCN_1007 | 6187 |
| GTCN_309 | 3097 | ATCN_1008 | 6188 |
| CTCN_574 | 3098 | CTCN_1567 | 6189 |
| GTCN_310 | 3099 | TTCN_1475 | 6190 |
| TTCN_556 | 3100 | GTCN_814 | 6191 |
| ATCN_334 | 3101 | CTCN_1568 | 6192 |
| GTCN_311 | 3102 | TTCN_1476 | 6193 |
| ATCN_335 | 3103 | ATCN_1009 | 6194 |
| TTCN_557 | 3104 | CTCN_1569 | 6195 |
| ATCN_336 | 3105 | CTCN_1570 | 6196 |
| ATCN_337 | 3106 | CTCN_1571 | 6197 |
| TTCN_558 | 3107 | TTCN_1477 | 6198 |
| TTCN_559 | 3108 | CTCN_1572 | 6199 |
| TTCN_560 | 3109 | GTCN_815 | 6200 |
| TTCN_561 | 3110 | TTCN_1478 | 6201 |
| ATCN_338 | 3111 | TTCN_1479 | 6202 |
| GTCN_312 | 3112 | CTCN_1573 | 6203 |
| GTCN_313 | 3113 | TTCN_1480 | 6204 |
| TTCN_562 | 3114 | CTCN_1574 | 6205 |
| CTCN_575 | 3115 | TTCN_1481 | 6206 |
| ATCN_339 | 3116 | ATCN_1010 | 6207 |
| GTCN_314 | 3117 | ATCN_1011 | 6208 |
| ATCN_340 | 3118 | ATCN_1012 | 6209 |
| TTCN_563 | 3119 | TTCN_1482 | 6210 |
| CTCN_576 | 3120 | GTCN_816 | 6211 |
| GTCN_315 | 3121 | ATCN_1013 | 6212 |
| TTCN_564 | 3122 | CTCN_1575 | 6213 |
| CTCN_577 | 3123 | ATCN_1014 | 6214 |
| CTCN_578 | 3124 | TTCN_1483 | 6215 |
| GTCN_316 | 3125 | TTCN_1484 | 6216 |
| ATCN_341 | 3126 | TTCN_1485 | 6217 |
| TTCN_565 | 3127 | CTCN_1576 | 6218 |
| ATCN_342 | 3128 | GTCN_817 | 6219 |

FIG. 35 (continued)

| | | | |
|---|---|---|---|
| GTCN_317 | 3129 | TTCN_1486 | 6220 |
| CTCN_579 | 3130 | GTCN_818 | 6221 |
| TTCN_566 | 3131 | CTCN_1577 | 6222 |
| GTCN_318 | 3132 | TTCN_1487 | 6223 |
| CTCN_580 | 3133 | TTCN_1488 | 6224 |
| TTCN_567 | 3134 | GTCN_819 | 6225 |
| TTCN_568 | 3135 | CTCN_1578 | 6226 |
| TTCN_569 | 3136 | TTCN_1489 | 6227 |
| TTCN_570 | 3137 | CTCN_1579 | 6228 |
| GTCN_319 | 3138 | GTCN_820 | 6229 |
| TTCN_571 | 3139 | TTCN_1490 | 6230 |
| TTCN_572 | 3140 | ATCN_1015 | 6231 |
| TTCN_573 | 3141 | TTCN_1491 | 6232 |
| ATCN_343 | 3142 | GTCN_821 | 6233 |
| TTCN_574 | 3143 | CTCN_1580 | 6234 |
| CTCN_581 | 3144 | TTCN_1492 | 6235 |
| TTCN_575 | 3145 | TTCN_1493 | 6236 |
| ATCN_344 | 3146 | TTCN_1494 | 6237 |
| GTCN_320 | 3147 | GTCN_822 | 6238 |
| CTCN_582 | 3148 | TTCN_1495 | 6239 |
| ATCN_345 | 3149 | TTCN_1496 | 6240 |
| ATCN_346 | 3150 | GTCN_823 | 6241 |
| ATCN_347 | 3151 | GTCN_824 | 6242 |
| CTCN_583 | 3152 | ATCN_1016 | 6243 |
| GTCN_321 | 3153 | ATCN_1017 | 6244 |
| CTCN_584 | 3154 | TTCN_1497 | 6245 |
| ATCN_348 | 3155 | TTCN_1498 | 6246 |
| ATCN_349 | 3156 | TTCN_1499 | 6247 |
| CTCN_585 | 3157 | ATCN_1018 | 6248 |
| CTCN_586 | 3158 | TTCN_1500 | 6249 |
| TTCN_576 | 3159 | CTCN_1581 | 6250 |
| CTCN_587 | 3160 | ATCN_1019 | 6251 |
| ATCN_350 | 3161 | ATCN_1020 | 6252 |
| ATCN_351 | 3162 | ATCN_1021 | 6253 |
| ATCN_352 | 3163 | ATCN_1022 | 6254 |
| CTCN_588 | 3164 | TTCN_1501 | 6255 |
| CTCN_589 | 3165 | CTCN_1582 | 6256 |
| GTCN_322 | 3166 | TTCN_1502 | 6257 |
| CTCN_590 | 3167 | CTCN_1583 | 6258 |
| GTCN_323 | 3168 | TTCN_1503 | 6259 |
| CTCN_591 | 3169 | ATCN_1023 | 6260 |
| GTCN_324 | 3170 | TTCN_1504 | 6261 |
| CTCN_592 | 3171 | GTCN_825 | 6262 |
| GTCN_325 | 3172 | ATCN_1024 | 6263 |
| TTCN_577 | 3173 | TTCN_1505 | 6264 |
| TTCN_578 | 3174 | TTCN_1506 | 6265 |
| TTCN_579 | 3175 | CTCN_1584 | 6266 |
| CTCN_593 | 3176 | CTCN_1585 | 6267 |
| CTCN_594 | 3177 | CTCN_1586 | 6268 |
| CTCN_595 | 3178 | TTCN_1507 | 6269 |
| CTCN_596 | 3179 | ATCN_1025 | 6270 |
| ATCN_353 | 3180 | CTCN_1587 | 6271 |
| CTCN_597 | 3181 | ATCN_1026 | 6272 |

| | | | |
|---|---|---|---|
| CTCN_598 | 3182 | TTCN_1508 | 6273 |
| TTCN_580 | 3183 | TTCN_1509 | 6274 |
| TTCN_581 | 3184 | CTCN_1588 | 6275 |
| TTCN_582 | 3185 | TTCN_1510 | 6276 |
| ATCN_354 | 3186 | CTCN_1589 | 6277 |
| TTCN_583 | 3187 | CTCN_1590 | 6278 |
| TTCN_584 | 3188 | TTCN_1511 | 6279 |
| CTCN_599 | 3189 | TTCN_1512 | 6280 |
| GTCN_326 | 3190 | ATCN_1027 | 6281 |
| CTCN_600 | 3191 | CTCN_1591 | 6282 |
| TTCN_585 | 3192 | ATCN_1028 | 6283 |
| GTCN_327 | 3193 | TTCN_1513 | 6284 |
| GTCN_328 | 3194 | ATCN_1029 | 6285 |
| GTCN_329 | 3195 | TTCN_1514 | 6286 |
| TTCN_586 | 3196 | ATCN_1030 | 6287 |
| GTCN_330 | 3197 | CTCN_1592 | 6288 |
| TTCN_587 | 3198 | ATCN_1031 | 6289 |
| GTCN_331 | 3199 | TTCN_1515 | 6290 |
| TTCN_588 | 3200 | GTCN_826 | 6291 |
| CTCN_601 | 3201 | ATCN_1032 | 6292 |
| ATCN_355 | 3202 | ATCN_1033 | 6293 |
| CTCN_602 | 3203 | GTCN_827 | 6294 |
| ATCN_356 | 3204 | TTCN_1516 | 6295 |
| TTCN_589 | 3205 | GTCN_828 | 6296 |
| TTCN_590 | 3206 | CTCN_1593 | 6297 |
| TTCN_591 | 3207 | GTCN_829 | 6298 |
| CTCN_603 | 3208 | CTCN_1594 | 6299 |
| TTCN_592 | 3209 | GTCN_830 | 6300 |
| TTCN_593 | 3210 | TTCN_1517 | 6301 |
| CTCN_604 | 3211 | CTCN_1595 | 6302 |
| GTCN_332 | 3212 | TTCN_1518 | 6303 |
| TTCN_594 | 3213 | CTCN_1596 | 6304 |
| TTCN_595 | 3214 | ATCN_1034 | 6305 |
| ATCN_357 | 3215 | CTCN_1597 | 6306 |
| TTCN_596 | 3216 | CTCN_1598 | 6307 |
| CTCN_605 | 3217 | TTCN_1519 | 6308 |
| TTCN_597 | 3218 | TTCN_1520 | 6309 |
| TTCN_598 | 3219 | ATCN_1035 | 6310 |
| GTCN_333 | 3220 | ATCN_1036 | 6311 |
| GTCN_334 | 3221 | TTCN_1521 | 6312 |
| ATCN_358 | 3222 | TTCN_1522 | 6313 |
| TTCN_599 | 3223 | CTCN_1599 | 6314 |
| ATCN_359 | 3224 | CTCN_1600 | 6315 |
| CTCN_606 | 3225 | TTCN_1523 | 6316 |
| GTCN_335 | 3226 | TTCN_1524 | 6317 |
| TTCN_600 | 3227 | ATCN_1037 | 6318 |
| GTCN_336 | 3228 | TTCN_1525 | 6319 |
| TTCN_601 | 3229 | CTCN_1601 | 6320 |
| CTCN_607 | 3230 | TTCN_1526 | 6321 |
| TTCN_602 | 3231 | CTCN_1602 | 6322 |
| TTCN_603 | 3232 | CTCN_1603 | 6323 |
| ATCN_360 | 3233 | ATCN_1038 | 6324 |
| TTCN_604 | 3234 | GTCN_831 | 6325 |

FIG. 35 (continued)

| | | | |
|---|---|---|---|
| CTCN_608 | 3235 | CTCN_1604 | 6326 |
| TTCN_605 | 3236 | CTCN_1605 | 6327 |
| TTCN_606 | 3237 | CTCN_1606 | 6328 |
| ATCN_361 | 3238 | CTCN_1607 | 6329 |
| TTCN_607 | 3239 | ATCN_1039 | 6330 |
| TTCN_608 | 3240 | ATCN_1040 | 6331 |
| GTCN_337 | 3241 | CTCN_1608 | 6332 |
| GTCN_338 | 3242 | GTCN_832 | 6333 |
| ATCN_362 | 3243 | CTCN_1609 | 6334 |
| CTCN_609 | 3244 | ATCN_1041 | 6335 |
| CTCN_610 | 3245 | ATCN_1042 | 6336 |
| TTCN_609 | 3246 | CTCN_1610 | 6337 |
| ATCN_363 | 3247 | GTCN_833 | 6338 |
| ATCN_364 | 3248 | CTCN_1611 | 6339 |
| TTCN_610 | 3249 | ATCN_1043 | 6340 |
| TTCN_611 | 3250 | ATCN_1044 | 6341 |
| GTCN_339 | 3251 | GTCN_834 | 6342 |
| CTCN_611 | 3252 | ATCN_1045 | 6343 |
| CTCN_612 | 3253 | CTCN_1612 | 6344 |
| GTCN_340 | 3254 | TTCN_1527 | 6345 |
| ATCN_365 | 3255 | CTCN_1613 | 6346 |
| TTCN_612 | 3256 | CTCN_1614 | 6347 |
| TTCN_613 | 3257 | TTCN_1528 | 6348 |
| TTCN_614 | 3258 | TTCN_1529 | 6349 |
| TTCN_615 | 3259 | CTCN_1615 | 6350 |
| TTCN_616 | 3260 | GTCN_835 | 6351 |
| ATCN_366 | 3261 | CTCN_1616 | 6352 |
| ATCN_367 | 3262 | CTCN_1617 | 6353 |
| TTCN_617 | 3263 | ATCN_1046 | 6354 |
| TTCN_618 | 3264 | CTCN_1618 | 6355 |
| GTCN_341 | 3265 | GTCN_836 | 6356 |
| ATCN_368 | 3266 | CTCN_1619 | 6357 |
| TTCN_619 | 3267 | CTCN_1620 | 6358 |
| TTCN_620 | 3268 | CTCN_1621 | 6359 |
| ATCN_369 | 3269 | TTCN_1530 | 6360 |
| CTCN_613 | 3270 | CTCN_1622 | 6361 |
| CTCN_614 | 3271 | TTCN_1531 | 6362 |
| CTCN_615 | 3272 | CTCN_1623 | 6363 |
| CTCN_616 | 3273 | TTCN_1532 | 6364 |
| CTCN_617 | 3274 | CTCN_1624 | 6365 |
| CTCN_618 | 3275 | TTCN_1533 | 6366 |
| CTCN_619 | 3276 | TTCN_1534 | 6367 |
| TTCN_621 | 3277 | TTCN_1535 | 6368 |
| CTCN_620 | 3278 | ATCN_1047 | 6369 |
| GTCN_342 | 3279 | TTCN_1536 | 6370 |
| CTCN_621 | 3280 | CTCN_1625 | 6371 |
| GTCN_343 | 3281 | TTCN_1537 | 6372 |
| CTCN_622 | 3282 | ATCN_1048 | 6373 |
| GTCN_344 | 3283 | TTCN_1538 | 6374 |
| CTCN_623 | 3284 | CTCN_1626 | 6375 |
| ATCN_370 | 3285 | CTCN_1627 | 6376 |
| ATCN_371 | 3286 | CTCN_1628 | 6377 |
| TTCN_622 | 3287 | ATCN_1049 | 6378 |

| | | | |
|---|---|---|---|
| CTCN_624 | 3288 | GTCN_837 | 6379 |
| TTCN_623 | 3289 | TTCN_1539 | 6380 |
| TTCN_624 | 3290 | CTCN_1629 | 6381 |
| TTCN_625 | 3291 | CTCN_1630 | 6382 |
| CTCN_625 | 3292 | TTCN_1540 | 6383 |
| CTCN_626 | 3293 | CTCN_1631 | 6384 |
| CTCN_627 | 3294 | TTCN_1541 | 6385 |
| CTCN_628 | 3295 | TTCN_1542 | 6386 |
| ATCN_372 | 3296 | CTCN_1632 | 6387 |
| GTCN_345 | 3297 | ATCN_1050 | 6388 |
| CTCN_629 | 3298 | GTCN_838 | 6389 |
| GTCN_346 | 3299 | ATCN_1051 | 6390 |
| TTCN_626 | 3300 | GTCN_839 | 6391 |
| ATCN_373 | 3301 | TTCN_1543 | 6392 |
| CTCN_630 | 3302 | CTCN_1633 | 6393 |
| CTCN_631 | 3303 | CTCN_1634 | 6394 |
| CTCN_632 | 3304 | TTCN_1544 | 6395 |
| TTCN_627 | 3305 | TTCN_1545 | 6396 |
| CTCN_633 | 3306 | ATCN_1052 | 6397 |
| GTCN_347 | 3307 | TTCN_1546 | 6398 |
| CTCN_634 | 3308 | ATCN_1053 | 6399 |
| ATCN_374 | 3309 | CTCN_1635 | 6400 |
| ATCN_375 | 3310 | TTCN_1547 | 6401 |
| CTCN_635 | 3311 | ATCN_1054 | 6402 |
| ATCN_376 | 3312 | ATCN_1055 | 6403 |
| CTCN_636 | 3313 | CTCN_1636 | 6404 |
| CTCN_637 | 3314 | TTCN_1548 | 6405 |
| CTCN_638 | 3315 | TTCN_1549 | 6406 |
| CTCN_639 | 3316 | TTCN_1550 | 6407 |
| TTCN_628 | 3317 | GTCN_840 | 6408 |
| ATCN_377 | 3318 | GTCN_841 | 6409 |
| ATCN_378 | 3319 | GTCN_842 | 6410 |
| TTCN_629 | 3320 | TTCN_1551 | 6411 |
| TTCN_630 | 3321 | TTCN_1552 | 6412 |
| TTCN_631 | 3322 | TTCN_1553 | 6413 |
| TTCN_632 | 3323 | ATCN_1056 | 6414 |
| GTCN_348 | 3324 | GTCN_843 | 6415 |
| CTCN_640 | 3325 | CTCN_1637 | 6416 |
| TTCN_633 | 3326 | TTCN_1554 | 6417 |
| ATCN_379 | 3327 | GTCN_844 | 6418 |
| TTCN_634 | 3328 | CTCN_1638 | 6419 |
| GTCN_349 | 3329 | CTCN_1639 | 6420 |
| TTCN_635 | 3330 | GTCN_845 | 6421 |
| CTCN_641 | 3331 | TTCN_1555 | 6422 |
| TTCN_636 | 3332 | CTCN_1640 | 6423 |
| TTCN_637 | 3333 | GTCN_846 | 6424 |
| TTCN_638 | 3334 | ATCN_1057 | 6425 |
| ATCN_380 | 3335 | TTCN_1556 | 6426 |
| ATCN_381 | 3336 | CTCN_1641 | 6427 |
| TTCN_639 | 3337 | ATCN_1058 | 6428 |
| ATCN_382 | 3338 | ATCN_1059 | 6429 |
| CTCN_642 | 3339 | ATCN_1060 | 6430 |
| CTCN_643 | 3340 | TTCN_1557 | 6431 |

FIG. 35 (continued)

| | | | |
|---|---|---|---|
| GTCN_350 | 3341 | CTCN_1642 | 6432 |
| ATCN_383 | 3342 | GTCN_847 | 6433 |
| GTCN_351 | 3343 | TTCN_1558 | 6434 |
| ATCN_384 | 3344 | ATCN_1061 | 6435 |
| TTCN_640 | 3345 | TTCN_1559 | 6436 |
| CTCN_644 | 3346 | CTCN_1643 | 6437 |
| ATCN_385 | 3347 | GTCN_848 | 6438 |
| TTCN_641 | 3348 | TTCN_1560 | 6439 |
| ATCN_386 | 3349 | TTCN_1561 | 6440 |
| CTCN_645 | 3350 | GTCN_849 | 6441 |
| ATCN_387 | 3351 | CTCN_1644 | 6442 |
| ATCN_388 | 3352 | TTCN_1562 | 6443 |
| TTCN_642 | 3353 | CTCN_1645 | 6444 |
| TTCN_643 | 3354 | TTCN_1563 | 6445 |
| TTCN_644 | 3355 | CTCN_1646 | 6446 |
| TTCN_645 | 3356 | ATCN_1062 | 6447 |
| CTCN_646 | 3357 | TTCN_1564 | 6448 |
| TTCN_646 | 3358 | ATCN_1063 | 6449 |
| CTCN_647 | 3359 | TTCN_1565 | 6450 |
| TTCN_647 | 3360 | TTCN_1566 | 6451 |
| CTCN_648 | 3361 | ATCN_1064 | 6452 |
| GTCN_352 | 3362 | TTCN_1567 | 6453 |
| CTCN_649 | 3363 | GTCN_850 | 6454 |
| GTCN_353 | 3364 | CTCN_1647 | 6455 |
| CTCN_650 | 3365 | TTCN_1568 | 6456 |
| CTCN_651 | 3366 | ATCN_1065 | 6457 |
| ATCN_389 | 3367 | CTCN_1648 | 6458 |
| ATCN_390 | 3368 | ATCN_1066 | 6459 |
| CTCN_652 | 3369 | GTCN_851 | 6460 |
| TTCN_648 | 3370 | CTCN_1649 | 6461 |
| ATCN_391 | 3371 | GTCN_852 | 6462 |
| CTCN_653 | 3372 | CTCN_1650 | 6463 |
| CTCN_654 | 3373 | ATCN_1067 | 6464 |
| TTCN_649 | 3374 | TTCN_1569 | 6465 |
| CTCN_655 | 3375 | CTCN_1651 | 6466 |
| CTCN_656 | 3376 | CTCN_1652 | 6467 |
| CTCN_657 | 3377 | CTCN_1653 | 6468 |
| CTCN_658 | 3378 | CTCN_1654 | 6469 |
| ATCN_392 | 3379 | GTCN_853 | 6470 |
| CTCN_659 | 3380 | TTCN_1570 | 6471 |
| ATCN_393 | 3381 | ATCN_1068 | 6472 |
| TTCN_650 | 3382 | CTCN_1655 | 6473 |
| GTCN_354 | 3383 | CTCN_1656 | 6474 |
| TTCN_651 | 3384 | CTCN_1657 | 6475 |
| CTCN_660 | 3385 | TTCN_1571 | 6476 |
| CTCN_661 | 3386 | GTCN_854 | 6477 |
| CTCN_662 | 3387 | CTCN_1658 | 6478 |
| ATCN_394 | 3388 | ATCN_1069 | 6479 |
| ATCN_395 | 3389 | TTCN_1572 | 6480 |
| CTCN_663 | 3390 | GTCN_855 | 6481 |
| TTCN_652 | 3391 | TTCN_1573 | 6482 |
| ATCN_396 | 3392 | GTCN_856 | 6483 |
| CTCN_664 | 3393 | ATCN_1070 | 6484 |

| | | | |
|---|---|---|---|
| GTCN_355 | 3394 | ATCN_1071 | 6485 |
| TTCN_653 | 3395 | CTCN_1659 | 6486 |
| TTCN_654 | 3396 | CTCN_1660 | 6487 |
| TTCN_655 | 3397 | ATCN_1072 | 6488 |
| GTCN_356 | 3398 | TTCN_1574 | 6489 |
| ATCN_397 | 3399 | ATCN_1073 | 6490 |
| CTCN_665 | 3400 | CTCN_1661 | 6491 |
| TTCN_656 | 3401 | TTCN_1575 | 6492 |
| CTCN_666 | 3402 | ATCN_1074 | 6493 |
| ATCN_398 | 3403 | GTCN_857 | 6494 |
| CTCN_667 | 3404 | TTCN_1576 | 6495 |
| TTCN_657 | 3405 | TTCN_1577 | 6496 |
| ATCN_399 | 3406 | TTCN_1578 | 6497 |
| CTCN_668 | 3407 | ATCN_1075 | 6498 |
| GTCN_357 | 3408 | CTCN_1662 | 6499 |
| TTCN_658 | 3409 | ATCN_1076 | 6500 |
| GTCN_358 | 3410 | ATCN_1077 | 6501 |
| ATCN_400 | 3411 | ATCN_1078 | 6502 |
| ATCN_401 | 3412 | CTCN_1663 | 6503 |
| TTCN_659 | 3413 | GTCN_858 | 6504 |
| ATCN_402 | 3414 | ATCN_1079 | 6505 |
| GTCN_359 | 3415 | ATCN_1080 | 6506 |
| CTCN_669 | 3416 | ATCN_1081 | 6507 |
| GTCN_360 | 3417 | TTCN_1579 | 6508 |
| GTCN_361 | 3418 | GTCN_859 | 6509 |
| ATCN_403 | 3419 | TTCN_1580 | 6510 |
| GTCN_362 | 3420 | ATCN_1082 | 6511 |
| TTCN_660 | 3421 | CTCN_1664 | 6512 |
| TTCN_661 | 3422 | CTCN_1665 | 6513 |
| TTCN_662 | 3423 | ATCN_1083 | 6514 |
| TTCN_663 | 3424 | ATCN_1084 | 6515 |
| TTCN_664 | 3425 | TTCN_1581 | 6516 |
| TTCN_665 | 3426 | CTCN_1666 | 6517 |
| ATCN_404 | 3427 | ATCN_1085 | 6518 |
| ATCN_405 | 3428 | TTCN_1582 | 6519 |
| GTCN_363 | 3429 | CTCN_1667 | 6520 |
| ATCN_406 | 3430 | CTCN_1668 | 6521 |
| CTCN_670 | 3431 | CTCN_1669 | 6522 |
| TTCN_666 | 3432 | GTCN_860 | 6523 |
| CTCN_671 | 3433 | TTCN_1583 | 6524 |
| TTCN_667 | 3434 | TTCN_1584 | 6525 |
| GTCN_364 | 3435 | CTCN_1670 | 6526 |
| ATCN_407 | 3436 | GTCN_861 | 6527 |
| ATCN_408 | 3437 | TTCN_1585 | 6528 |
| CTCN_672 | 3438 | CTCN_1671 | 6529 |
| CTCN_673 | 3439 | ATCN_1086 | 6530 |
| ATCN_409 | 3440 | GTCN_862 | 6531 |
| ATCN_410 | 3441 | GTCN_863 | 6532 |
| CTCN_674 | 3442 | TTCN_1586 | 6533 |
| GTCN_365 | 3443 | TTCN_1587 | 6534 |
| ATCN_411 | 3444 | GTCN_864 | 6535 |
| CTCN_675 | 3445 | ATCN_1087 | 6536 |
| CTCN_676 | 3446 | GTCN_865 | 6537 |

FIG. 35 (continued)

| | | | |
|---|---|---|---|
| GTCN_366 | 3447 | TTCN_1588 | 6538 |
| ATCN_412 | 3448 | GTCN_866 | 6539 |
| ATCN_413 | 3449 | GTCN_867 | 6540 |
| ATCN_414 | 3450 | CTCN_1672 | 6541 |
| TTCN_668 | 3451 | ATCN_1088 | 6542 |
| TTCN_669 | 3452 | TTCN_1589 | 6543 |
| TTCN_670 | 3453 | ATCN_1089 | 6544 |
| CTCN_677 | 3454 | GTCN_868 | 6545 |
| ATCN_415 | 3455 | TTCN_1590 | 6546 |
| CTCN_678 | 3456 | TTCN_1591 | 6547 |
| GTCN_367 | 3457 | CTCN_1673 | 6548 |
| CTCN_679 | 3458 | GTCN_869 | 6549 |
| GTCN_368 | 3459 | GTCN_870 | 6550 |
| TTCN_671 | 3460 | TTCN_1592 | 6551 |
| TTCN_672 | 3461 | CTCN_1674 | 6552 |
| GTCN_369 | 3462 | TTCN_1593 | 6553 |
| GTCN_370 | 3463 | GTCN_871 | 6554 |
| TTCN_673 | 3464 | ATCN_1090 | 6555 |
| ATCN_416 | 3465 | CTCN_1675 | 6556 |
| ATCN_417 | 3466 | GTCN_872 | 6557 |
| CTCN_680 | 3467 | GTCN_873 | 6558 |
| CTCN_681 | 3468 | TTCN_1594 | 6559 |
| TTCN_674 | 3469 | ATCN_1091 | 6560 |
| GTCN_371 | 3470 | CTCN_1676 | 6561 |
| GTCN_372 | 3471 | GTCN_874 | 6562 |
| GTCN_373 | 3472 | CTCN_1677 | 6563 |
| GTCN_374 | 3473 | GTCN_875 | 6564 |
| GTCN_375 | 3474 | GTCN_876 | 6565 |
| TTCN_675 | 3475 | GTCN_877 | 6566 |
| GTCN_376 | 3476 | ATCN_1092 | 6567 |
| TTCN_676 | 3477 | ATCN_1093 | 6568 |
| CTCN_682 | 3478 | GTCN_878 | 6569 |
| CTCN_683 | 3479 | TTCN_1595 | 6570 |
| ATCN_418 | 3480 | GTCN_879 | 6571 |
| GTCN_377 | 3481 | CTCN_1678 | 6572 |
| CTCN_684 | 3482 | TTCN_1596 | 6573 |
| CTCN_685 | 3483 | TTCN_1597 | 6574 |
| TTCN_677 | 3484 | TTCN_1598 | 6575 |
| TTCN_678 | 3485 | TTCN_1599 | 6576 |
| ATCN_419 | 3486 | TTCN_1600 | 6577 |
| CTCN_686 | 3487 | GTCN_880 | 6578 |
| ATCN_420 | 3488 | ATCN_1094 | 6579 |
| TTCN_679 | 3489 | TTCN_1601 | 6580 |
| TTCN_680 | 3490 | ATCN_1095 | 6581 |
| GTCN_378 | 3491 | ATCN_1096 | 6582 |
| TTCN_681 | 3492 | GTCN_881 | 6583 |
| TTCN_682 | 3493 | ATCN_1097 | 6584 |
| ATCN_421 | 3494 | ATCN_1098 | 6585 |
| CTCN_687 | 3495 | CTCN_1679 | 6586 |
| CTCN_688 | 3496 | TTCN_1602 | 6587 |
| TTCN_683 | 3497 | CTCN_1680 | 6588 |
| GTCN_379 | 3498 | CTCN_1681 | 6589 |
| GTCN_380 | 3499 | CTCN_1682 | 6590 |

| | | | |
|---|---|---|---|
| TTCN_684 | 3500 | TTCN_1603 | 6591 |
| TTCN_685 | 3501 | GTCN_882 | 6592 |
| CTCN_689 | 3502 | TTCN_1604 | 6593 |
| TTCN_686 | 3503 | TTCN_1605 | 6594 |
| CTCN_690 | 3504 | ATCN_1099 | 6595 |
| CTCN_691 | 3505 | TTCN_1606 | 6596 |
| GTCN_381 | 3506 | GTCN_883 | 6597 |
| CTCN_692 | 3507 | TTCN_1607 | 6598 |
| TTCN_687 | 3508 | CTCN_1683 | 6599 |
| GTCN_382 | 3509 | TTCN_1608 | 6600 |
| ATCN_422 | 3510 | ATCN_1100 | 6601 |
| CTCN_693 | 3511 | ATCN_1101 | 6602 |
| CTCN_694 | 3512 | TTCN_1609 | 6603 |
| TTCN_688 | 3513 | CTCN_1684 | 6604 |
| GTCN_383 | 3514 | CTCN_1685 | 6605 |
| CTCN_695 | 3515 | TTCN_1610 | 6606 |
| TTCN_689 | 3516 | GTCN_884 | 6607 |
| TTCN_690 | 3517 | ATCN_1102 | 6608 |
| CTCN_696 | 3518 | ATCN_1103 | 6609 |
| CTCN_697 | 3519 | GTCN_885 | 6610 |
| CTCN_698 | 3520 | CTCN_1686 | 6611 |
| GTCN_384 | 3521 | CTCN_1687 | 6612 |
| TTCN_691 | 3522 | CTCN_1688 | 6613 |
| ATCN_423 | 3523 | GTCN_886 | 6614 |
| CTCN_699 | 3524 | CTCN_1689 | 6615 |
| TTCN_692 | 3525 | CTCN_1690 | 6616 |
| ATCN_424 | 3526 | CTCN_1691 | 6617 |
| GTCN_385 | 3527 | GTCN_887 | 6618 |
| CTCN_700 | 3528 | GTCN_888 | 6619 |
| TTCN_693 | 3529 | GTCN_889 | 6620 |
| GTCN_386 | 3530 | TTCN_1611 | 6621 |
| CTCN_701 | 3531 | CTCN_1692 | 6622 |
| TTCN_694 | 3532 | CTCN_1693 | 6623 |
| TTCN_695 | 3533 | CTCN_1694 | 6624 |
| TTCN_696 | 3534 | CTCN_1695 | 6625 |
| CTCN_702 | 3535 | CTCN_1696 | 6626 |
| TTCN_697 | 3536 | ATCN_1104 | 6627 |
| TTCN_698 | 3537 | ATCN_1105 | 6628 |
| TTCN_699 | 3538 | TTCN_1612 | 6629 |
| CTCN_703 | 3539 | GTCN_890 | 6630 |
| GTCN_387 | 3540 | GTCN_891 | 6631 |
| GTCN_388 | 3541 | CTCN_1697 | 6632 |
| CTCN_704 | 3542 | TTCN_1613 | 6633 |
| CTCN_705 | 3543 | TTCN_1614 | 6634 |
| GTCN_389 | 3544 | GTCN_892 | 6635 |
| CTCN_706 | 3545 | GTCN_893 | 6636 |
| ATCN_425 | 3546 | GTCN_894 | 6637 |
| CTCN_707 | 3547 | CTCN_1698 | 6638 |
| TTCN_700 | 3548 | GTCN_895 | 6639 |
| ATCN_426 | 3549 | GTCN_896 | 6640 |
| TTCN_701 | 3550 | TTCN_1615 | 6641 |
| CTCN_708 | 3551 | CTCN_1699 | 6642 |
| GTCN_390 | 3552 | ATCN_1106 | 6643 |

FIG. 35 (continued)

| | | | |
|---|---|---|---|
| CTCN_709 | 3553 | CTCN_1700 | 6644 |
| TTCN_702 | 3554 | CTCN_1701 | 6645 |
| ATCN_427 | 3555 | GTCN_897 | 6646 |
| GTCN_391 | 3556 | ATCN_1107 | 6647 |
| GTCN_392 | 3557 | CTCN_1702 | 6648 |
| TTCN_703 | 3558 | ATCN_1108 | 6649 |
| TTCN_704 | 3559 | ATCN_1109 | 6650 |
| TTCN_705 | 3560 | GTCN_898 | 6651 |
| TTCN_706 | 3561 | CTCN_1703 | 6652 |
| TTCN_707 | 3562 | GTCN_899 | 6653 |
| GTCN_393 | 3563 | GTCN_900 | 6654 |
| CTCN_710 | 3564 | GTCN_901 | 6655 |
| TTCN_708 | 3565 | TTCN_1616 | 6656 |
| CTCN_711 | 3566 | CTCN_1704 | 6657 |
| GTCN_394 | 3567 | CTCN_1705 | 6658 |
| ATCN_428 | 3568 | CTCN_1706 | 6659 |
| CTCN_712 | 3569 | CTCN_1707 | 6660 |
| ATCN_429 | 3570 | CTCN_1708 | 6661 |
| GTCN_395 | 3571 | TTCN_1617 | 6662 |
| CTCN_713 | 3572 | GTCN_902 | 6663 |
| ATCN_430 | 3573 | TTCN_1618 | 6664 |
| TTCN_709 | 3574 | TTCN_1619 | 6665 |
| TTCN_710 | 3575 | CTCN_1709 | 6666 |
| CTCN_714 | 3576 | TTCN_1620 | 6667 |
| CTCN_715 | 3577 | TTCN_1621 | 6668 |
| CTCN_716 | 3578 | ATCN_1110 | 6669 |
| TTCN_711 | 3579 | ATCN_1111 | 6670 |
| CTCN_717 | 3580 | GTCN_903 | 6671 |
| CTCN_718 | 3581 | TTCN_1622 | 6672 |
| TTCN_712 | 3582 | ATCN_1112 | 6673 |
| TTCN_713 | 3583 | ATCN_1113 | 6674 |
| GTCN_396 | 3584 | CTCN_1710 | 6675 |
| CTCN_719 | 3585 | CTCN_1711 | 6676 |
| CTCN_720 | 3586 | CTCN_1712 | 6677 |
| CTCN_721 | 3587 | TTCN_1623 | 6678 |
| CTCN_722 | 3588 | TTCN_1624 | 6679 |
| CTCN_723 | 3589 | TTCN_1625 | 6680 |
| CTCN_724 | 3590 | CTCN_1713 | 6681 |
| CTCN_725 | 3591 | CTCN_1714 | 6682 |
| ATCN_431 | 3592 | GTCN_904 | 6683 |
| ATCN_432 | 3593 | TTCN_1626 | 6684 |
| GTCN_397 | 3594 | ATCN_1114 | 6685 |
| CTCN_726 | 3595 | CTCN_1715 | 6686 |
| TTCN_714 | 3596 | GTCN_905 | 6687 |
| CTCN_727 | 3597 | CTCN_1716 | 6688 |
| CTCN_728 | 3598 | ATCN_1115 | 6689 |
| GTCN_398 | 3599 | GTCN_906 | 6690 |
| TTCN_715 | 3600 | CTCN_1717 | 6691 |
| ATCN_433 | 3601 | CTCN_1718 | 6692 |
| GTCN_399 | 3602 | CTCN_1719 | 6693 |
| TTCN_716 | 3603 | CTCN_1720 | 6694 |
| TTCN_717 | 3604 | GTCN_907 | 6695 |
| CTCN_729 | 3605 | TTCN_1627 | 6696 |

| | | | |
|---|---|---|---|
| CTCN_730 | 3606 | CTCN_1721 | 6697 |
| TTCN_718 | 3607 | CTCN_1722 | 6698 |
| CTCN_731 | 3608 | TTCN_1628 | 6699 |
| TTCN_719 | 3609 | CTCN_1723 | 6700 |
| CTCN_732 | 3610 | GTCN_908 | 6701 |
| TTCN_720 | 3611 | CTCN_1724 | 6702 |
| ATCN_434 | 3612 | TTCN_1629 | 6703 |
| ATCN_435 | 3613 | GTCN_909 | 6704 |
| CTCN_733 | 3614 | TTCN_1630 | 6705 |
| GTCN_400 | 3615 | GTCN_910 | 6706 |
| ATCN_436 | 3616 | GTCN_911 | 6707 |
| ATCN_437 | 3617 | GTCN_912 | 6708 |
| CTCN_734 | 3618 | GTCN_913 | 6709 |
| GTCN_401 | 3619 | TTCN_1631 | 6710 |
| CTCN_735 | 3620 | GTCN_914 | 6711 |
| TTCN_721 | 3621 | CTCN_1725 | 6712 |
| TTCN_722 | 3622 | CTCN_1726 | 6713 |
| GTCN_402 | 3623 | GTCN_915 | 6714 |
| CTCN_736 | 3624 | TTCN_1632 | 6715 |
| TTCN_723 | 3625 | CTCN_1727 | 6716 |
| GTCN_403 | 3626 | GTCN_916 | 6717 |
| TTCN_724 | 3627 | TTCN_1633 | 6718 |
| ATCN_438 | 3628 | GTCN_917 | 6719 |
| CTCN_737 | 3629 | TTCN_1634 | 6720 |
| TTCN_725 | 3630 | CTCN_1728 | 6721 |
| CTCN_738 | 3631 | GTCN_918 | 6722 |
| CTCN_739 | 3632 | TTCN_1635 | 6723 |
| TTCN_726 | 3633 | CTCN_1729 | 6724 |
| TTCN_727 | 3634 | ATCN_1116 | 6725 |
| CTCN_740 | 3635 | CTCN_1730 | 6726 |
| CTCN_741 | 3636 | TTCN_1636 | 6727 |
| CTCN_742 | 3637 | ATCN_1117 | 6728 |
| TTCN_728 | 3638 | CTCN_1731 | 6729 |
| CTCN_743 | 3639 | TTCN_1637 | 6730 |
| CTCN_744 | 3640 | ATCN_1118 | 6731 |
| ATCN_439 | 3641 | TTCN_1638 | 6732 |
| TTCN_729 | 3642 | CTCN_1732 | 6733 |
| GTCN_404 | 3643 | ATCN_1119 | 6734 |
| GTCN_405 | 3644 | ATCN_1120 | 6735 |
| CTCN_745 | 3645 | TTCN_1639 | 6736 |
| TTCN_730 | 3646 | ATCN_1121 | 6737 |
| CTCN_746 | 3647 | ATCN_1122 | 6738 |
| TTCN_731 | 3648 | ATCN_1123 | 6739 |
| ATCN_440 | 3649 | ATCN_1124 | 6740 |
| TTCN_732 | 3650 | ATCN_1125 | 6741 |
| ATCN_441 | 3651 | TTCN_1640 | 6742 |
| ATCN_442 | 3652 | TTCN_1641 | 6743 |
| CTCN_747 | 3653 | TTCN_1642 | 6744 |
| ATCN_443 | 3654 | CTCN_1733 | 6745 |
| TTCN_733 | 3655 | GTCN_919 | 6746 |
| TTCN_734 | 3656 | CTCN_1734 | 6747 |
| ATCN_444 | 3657 | CTCN_1735 | 6748 |
| ATCN_445 | 3658 | CTCN_1736 | 6749 |

FIG. 35 (continued)

| | | | |
|---|---|---|---|
| TTCN_735 | 3659 | CTCN_1737 | 6750 |
| TTCN_736 | 3660 | GTCN_920 | 6751 |
| CTCN_748 | 3661 | TTCN_1643 | 6752 |
| ATCN_446 | 3662 | TTCN_1644 | 6753 |
| CTCN_749 | 3663 | CTCN_1738 | 6754 |
| GTCN_406 | 3664 | CTCN_1739 | 6755 |
| TTCN_737 | 3665 | CTCN_1740 | 6756 |
| ATCN_447 | 3666 | TTCN_1645 | 6757 |
| CTCN_750 | 3667 | GTCN_921 | 6758 |
| CTCN_751 | 3668 | CTCN_1741 | 6759 |
| GTCN_407 | 3669 | ATCN_1126 | 6760 |
| ATCN_448 | 3670 | CTCN_1742 | 6761 |
| GTCN_408 | 3671 | GTCN_922 | 6762 |
| TTCN_738 | 3672 | GTCN_923 | 6763 |
| TTCN_739 | 3673 | CTCN_1743 | 6764 |
| ATCN_449 | 3674 | TTCN_1646 | 6765 |
| ATCN_450 | 3675 | GTCN_924 | 6766 |
| ATCN_451 | 3676 | GTCN_925 | 6767 |
| TTCN_740 | 3677 | ATCN_1127 | 6768 |
| CTCN_752 | 3678 | GTCN_926 | 6769 |
| ATCN_452 | 3679 | TTCN_1647 | 6770 |
| ATCN_453 | 3680 | CTCN_1744 | 6771 |
| ATCN_454 | 3681 | ATCN_1128 | 6772 |
| TTCN_741 | 3682 | ATCN_1129 | 6773 |
| CTCN_753 | 3683 | GTCN_927 | 6774 |
| ATCN_455 | 3684 | TTCN_1648 | 6775 |
| ATCN_456 | 3685 | ATCN_1130 | 6776 |
| ATCN_457 | 3686 | ATCN_1131 | 6777 |
| CTCN_754 | 3687 | CTCN_1745 | 6778 |
| TTCN_742 | 3688 | TTCN_1649 | 6779 |
| CTCN_755 | 3689 | GTCN_928 | 6780 |
| TTCN_743 | 3690 | CTCN_1746 | 6781 |
| CTCN_756 | 3691 | TTCN_1650 | 6782 |
| ATCN_458 | 3692 | CTCN_1747 | 6783 |
| TTCN_744 | 3693 | GTCN_929 | 6784 |
| GTCN_409 | 3694 | CTCN_1748 | 6785 |
| ATCN_459 | 3695 | CTCN_1749 | 6786 |
| TTCN_745 | 3696 | TTCN_1651 | 6787 |
| CTCN_757 | 3697 | CTCN_1750 | 6788 |
| TTCN_746 | 3698 | TTCN_1652 | 6789 |
| ATCN_460 | 3699 | CTCN_1751 | 6790 |
| TTCN_747 | 3700 | GTCN_930 | 6791 |
| TTCN_748 | 3701 | ATCN_1132 | 6792 |
| GTCN_410 | 3702 | ATCN_1133 | 6793 |
| GTCN_411 | 3703 | GTCN_931 | 6794 |
| TTCN_749 | 3704 | TTCN_1653 | 6795 |
| ATCN_461 | 3705 | TTCN_1654 | 6796 |
| TTCN_750 | 3706 | CTCN_1752 | 6797 |
| ATCN_462 | 3707 | ATCN_1134 | 6798 |
| ATCN_463 | 3708 | GTCN_932 | 6799 |
| TTCN_751 | 3709 | TTCN_1655 | 6800 |
| ATCN_464 | 3710 | CTCN_1753 | 6801 |
| ATCN_465 | 3711 | TTCN_1656 | 6802 |

| | | | |
|---|---|---|---|
| TTCN_752 | 3712 | CTCN_1754 | 6803 |
| ATCN_466 | 3713 | TTCN_1657 | 6804 |
| CTCN_758 | 3714 | GTCN_933 | 6805 |
| TTCN_753 | 3715 | CTCN_1755 | 6806 |
| ATCN_467 | 3716 | TTCN_1658 | 6807 |
| ATCN_468 | 3717 | TTCN_1659 | 6808 |
| ATCN_469 | 3718 | CTCN_1756 | 6809 |
| TTCN_754 | 3719 | ATCN_1135 | 6810 |
| TTCN_755 | 3720 | TTCN_1660 | 6811 |
| ATCN_470 | 3721 | TTCN_1661 | 6812 |
| GTCN_412 | 3722 | CTCN_1757 | 6813 |
| GTCN_413 | 3723 | CTCN_1758 | 6814 |
| GTCN_414 | 3724 | GTCN_934 | 6815 |
| TTCN_756 | 3725 | CTCN_1759 | 6816 |
| TTCN_757 | 3726 | GTCN_935 | 6817 |
| CTCN_759 | 3727 | TTCN_1662 | 6818 |
| CTCN_760 | 3728 | GTCN_936 | 6819 |
| ATCN_471 | 3729 | CTCN_1760 | 6820 |
| CTCN_761 | 3730 | ATCN_1136 | 6821 |
| GTCN_415 | 3731 | TTCN_1663 | 6822 |
| TTCN_758 | 3732 | GTCN_937 | 6823 |
| TTCN_759 | 3733 | CTCN_1761 | 6824 |
| TTCN_760 | 3734 | ATCN_1137 | 6825 |
| TTCN_761 | 3735 | TTCN_1664 | 6826 |
| CTCN_762 | 3736 | GTCN_938 | 6827 |
| ATCN_472 | 3737 | CTCN_1762 | 6828 |
| TTCN_762 | 3738 | ATCN_1138 | 6829 |
| GTCN_416 | 3739 | ATCN_1139 | 6830 |
| CTCN_763 | 3740 | ATCN_1140 | 6831 |
| CTCN_764 | 3741 | ATCN_1141 | 6832 |
| ATCN_473 | 3742 | ATCN_1142 | 6833 |
| CTCN_765 | 3743 | TTCN_1665 | 6834 |
| CTCN_766 | 3744 | TTCN_1666 | 6835 |
| CTCN_767 | 3745 | CTCN_1763 | 6836 |
| CTCN_768 | 3746 | GTCN_939 | 6837 |
| TTCN_763 | 3747 | CTCN_1764 | 6838 |
| TTCN_764 | 3748 | TTCN_1667 | 6839 |
| CTCN_769 | 3749 | ATCN_1143 | 6840 |
| CTCN_770 | 3750 | TTCN_1668 | 6841 |
| CTCN_771 | 3751 | ATCN_1144 | 6842 |
| CTCN_772 | 3752 | TTCN_1669 | 6843 |
| ATCN_474 | 3753 | ATCN_1145 | 6844 |
| CTCN_773 | 3754 | ATCN_1146 | 6845 |
| GTCN_417 | 3755 | CTCN_1765 | 6846 |
| TTCN_765 | 3756 | ATCN_1147 | 6847 |
| GTCN_418 | 3757 | GTCN_940 | 6848 |
| CTCN_774 | 3758 | CTCN_1766 | 6849 |
| CTCN_775 | 3759 | TTCN_1670 | 6850 |
| ATCN_475 | 3760 | GTCN_941 | 6851 |
| ATCN_476 | 3761 | CTCN_1767 | 6852 |
| CTCN_776 | 3762 | TTCN_1671 | 6853 |
| ATCN_477 | 3763 | TTCN_1672 | 6854 |
| ATCN_478 | 3764 | GTCN_942 | 6855 |

FIG. 35 (continued)

| | | | |
|---|---|---|---|
| GTCN_419 | 3765 | GTCN_943 | 6856 |
| CTCN_777 | 3766 | TTCN_1673 | 6857 |
| CTCN_778 | 3767 | TTCN_1674 | 6858 |
| ATCN_479 | 3768 | TTCN_1675 | 6859 |
| CTCN_779 | 3769 | ATCN_1148 | 6860 |
| ATCN_480 | 3770 | GTCN_944 | 6861 |
| TTCN_766 | 3771 | GTCN_945 | 6862 |
| ATCN_481 | 3772 | TTCN_1676 | 6863 |
| CTCN_780 | 3773 | ATCN_1149 | 6864 |
| CTCN_781 | 3774 | TTCN_1677 | 6865 |
| TTCN_767 | 3775 | GTCN_946 | 6866 |
| TTCN_768 | 3776 | GTCN_947 | 6867 |
| TTCN_769 | 3777 | TTCN_1678 | 6868 |
| TTCN_770 | 3778 | CTCN_1768 | 6869 |
| TTCN_771 | 3779 | TTCN_1679 | 6870 |
| TTCN_772 | 3780 | GTCN_948 | 6871 |
| CTCN_782 | 3781 | GTCN_949 | 6872 |
| TTCN_773 | 3782 | ATCN_1150 | 6873 |
| ATCN_482 | 3783 | CTCN_1769 | 6874 |
| CTCN_783 | 3784 | TTCN_1680 | 6875 |
| ATCN_483 | 3785 | ATCN_1151 | 6876 |
| GTCN_420 | 3786 | ATCN_1152 | 6877 |
| ATCN_484 | 3787 | CTCN_1770 | 6878 |
| ATCN_485 | 3788 | CTCN_1771 | 6879 |
| CTCN_784 | 3789 | GTCN_950 | 6880 |
| TTCN_774 | 3790 | TTCN_1681 | 6881 |
| CTCN_785 | 3791 | CTCN_1772 | 6882 |
| ATCN_486 | 3792 | ATCN_1153 | 6883 |
| ATCN_487 | 3793 | GTCN_951 | 6884 |
| CTCN_786 | 3794 | ATCN_1154 | 6885 |
| GTCN_421 | 3795 | CTCN_1773 | 6886 |
| CTCN_787 | 3796 | CTCN_1774 | 6887 |
| TTCN_775 | 3797 | ATCN_1155 | 6888 |
| CTCN_788 | 3798 | CTCN_1775 | 6889 |
| GTCN_422 | 3799 | CTCN_1776 | 6890 |
| GTCN_423 | 3800 | GTCN_952 | 6891 |
| CTCN_789 | 3801 | ATCN_1156 | 6892 |
| GTCN_424 | 3802 | CTCN_1777 | 6893 |
| CTCN_790 | 3803 | GTCN_953 | 6894 |
| TTCN_776 | 3804 | ATCN_1157 | 6895 |
| GTCN_425 | 3805 | TTCN_1682 | 6896 |
| GTCN_426 | 3806 | GTCN_954 | 6897 |
| TTCN_777 | 3807 | CTCN_1778 | 6898 |
| ATCN_488 | 3808 | ATCN_1158 | 6899 |
| CTCN_791 | 3809 | GTCN_955 | 6900 |
| TTCN_778 | 3810 | GTCN_956 | 6901 |
| CTCN_792 | 3811 | GTCN_957 | 6902 |
| TTCN_779 | 3812 | GTCN_958 | 6903 |
| GTCN_427 | 3813 | ATCN_1159 | 6904 |
| GTCN_428 | 3814 | CTCN_1779 | 6905 |
| TTCN_780 | 3815 | GTCN_959 | 6906 |
| TTCN_781 | 3816 | ATCN_1160 | 6907 |
| TTCN_782 | 3817 | CTCN_1780 | 6908 |

| | | | |
|---|---|---|---|
| ATCN_489 | 3818 | TTCN_1683 | 6909 |
| GTCN_429 | 3819 | GTCN_960 | 6910 |
| TTCN_783 | 3820 | CTCN_1781 | 6911 |
| ATCN_490 | 3821 | GTCN_961 | 6912 |
| TTCN_784 | 3822 | TTCN_1684 | 6913 |
| CTCN_793 | 3823 | CTCN_1782 | 6914 |
| ATCN_491 | 3824 | GTCN_962 | 6915 |
| TTCN_785 | 3825 | CTCN_1783 | 6916 |
| ATCN_492 | 3826 | CTCN_1784 | 6917 |
| ATCN_493 | 3827 | TTCN_1685 | 6918 |
| ATCN_494 | 3828 | TTCN_1686 | 6919 |
| TTCN_786 | 3829 | TTCN_1687 | 6920 |
| CTCN_794 | 3830 | TTCN_1688 | 6921 |
| ATCN_495 | 3831 | TTCN_1689 | 6922 |
| TTCN_787 | 3832 | CTCN_1785 | 6923 |
| CTCN_795 | 3833 | CTCN_1786 | 6924 |
| GTCN_430 | 3834 | CTCN_1787 | 6925 |
| TTCN_788 | 3835 | CTCN_1788 | 6926 |
| TTCN_789 | 3836 | CTCN_1789 | 6927 |
| CTCN_796 | 3837 | TTCN_1690 | 6928 |
| TTCN_790 | 3838 | TTCN_1691 | 6929 |
| CTCN_797 | 3839 | TTCN_1692 | 6930 |
| TTCN_791 | 3840 | TTCN_1693 | 6931 |
| CTCN_798 | 3841 | ATCN_1161 | 6932 |
| CTCN_799 | 3842 | TTCN_1694 | 6933 |
| CTCN_800 | 3843 | ATCN_1162 | 6934 |
| GTCN_431 | 3844 | TTCN_1695 | 6935 |
| CTCN_801 | 3845 | ATCN_1163 | 6936 |
| TTCN_792 | 3846 | CTCN_1790 | 6937 |
| CTCN_802 | 3847 | GTCN_963 | 6938 |
| CTCN_803 | 3848 | TTCN_1696 | 6939 |
| CTCN_804 | 3849 | CTCN_1791 | 6940 |
| TTCN_793 | 3850 | TTCN_1697 | 6941 |
| TTCN_794 | 3851 | CTCN_1792 | 6942 |
| CTCN_805 | 3852 | CTCN_1793 | 6943 |
| CTCN_806 | 3853 | TTCN_1698 | 6944 |
| CTCN_807 | 3854 | CTCN_1794 | 6945 |
| CTCN_808 | 3855 | TTCN_1699 | 6946 |
| ATCN_496 | 3856 | CTCN_1795 | 6947 |
| CTCN_809 | 3857 | TTCN_1700 | 6948 |
| TTCN_795 | 3858 | TTCN_1701 | 6949 |
| GTCN_432 | 3859 | CTCN_1796 | 6950 |
| CTCN_810 | 3860 | ATCN_1164 | 6951 |
| CTCN_811 | 3861 | TTCN_1702 | 6952 |
| TTCN_796 | 3862 | TTCN_1703 | 6953 |
| CTCN_812 | 3863 | CTCN_1797 | 6954 |
| ATCN_497 | 3864 | TTCN_1704 | 6955 |
| ATCN_498 | 3865 | TTCN_1705 | 6956 |
| TTCN_797 | 3866 | ATCN_1165 | 6957 |
| TTCN_798 | 3867 | ATCN_1166 | 6958 |
| CTCN_813 | 3868 | TTCN_1706 | 6959 |
| TTCN_799 | 3869 | CTCN_1798 | 6960 |
| ATCN_499 | 3870 | TTCN_1707 | 6961 |

FIG. 35 (continued)

| | | | |
|---|---|---|---|
| TTCN_800 | 3871 | TTCN_1708 | 6962 |
| TTCN_801 | 3872 | GTCN_964 | 6963 |
| GTCN_433 | 3873 | TTCN_1709 | 6964 |
| TTCN_802 | 3874 | TTCN_1710 | 6965 |
| ATCN_500 | 3875 | CTCN_1799 | 6966 |
| ATCN_501 | 3876 | TTCN_1711 | 6967 |
| CTCN_814 | 3877 | CTCN_1800 | 6968 |
| CTCN_815 | 3878 | ATCN_1167 | 6969 |
| ATCN_502 | 3879 | CTCN_1801 | 6970 |
| GTCN_434 | 3880 | CTCN_1802 | 6971 |
| TTCN_803 | 3881 | CTCN_1803 | 6972 |
| CTCN_816 | 3882 | CTCN_1804 | 6973 |
| TTCN_804 | 3883 | GTCN_965 | 6974 |
| CTCN_817 | 3884 | CTCN_1805 | 6975 |
| TTCN_805 | 3885 | CTCN_1806 | 6976 |
| CTCN_818 | 3886 | ATCN_1168 | 6977 |
| TTCN_806 | 3887 | ATCN_1169 | 6978 |
| ATCN_503 | 3888 | CTCN_1807 | 6979 |
| ATCN_504 | 3889 | CTCN_1808 | 6980 |
| GTCN_435 | 3890 | TTCN_1712 | 6981 |
| CTCN_819 | 3891 | CTCN_1809 | 6982 |
| TTCN_807 | 3892 | GTCN_966 | 6983 |
| GTCN_436 | 3893 | TTCN_1713 | 6984 |
| CTCN_820 | 3894 | TTCN_1714 | 6985 |
| TTCN_808 | 3895 | ATCN_1170 | 6986 |
| GTCN_437 | 3896 | GTCN_967 | 6987 |
| GTCN_438 | 3897 | CTCN_1810 | 6988 |
| GTCN_439 | 3898 | TTCN_1715 | 6989 |
| GTCN_440 | 3899 | TTCN_1716 | 6990 |
| ATCN_505 | 3900 | GTCN_968 | 6991 |
| GTCN_441 | 3901 | TTCN_1717 | 6992 |
| CTCN_821 | 3902 | ATCN_1171 | 6993 |
| CTCN_822 | 3903 | CTCN_1811 | 6994 |
| CTCN_823 | 3904 | ATCN_1172 | 6995 |
| GTCN_442 | 3905 | CTCN_1812 | 6996 |
| TTCN_809 | 3906 | CTCN_1813 | 6997 |
| GTCN_443 | 3907 | TTCN_1718 | 6998 |
| GTCN_444 | 3908 | TTCN_1719 | 6999 |
| TTCN_810 | 3909 | GTCN_969 | 7000 |
| ATCN_506 | 3910 | ATCN_1173 | 7001 |
| CTCN_824 | 3911 | GTCN_970 | 7002 |
| TTCN_811 | 3912 | TTCN_1720 | 7003 |
| TTCN_812 | 3913 | CTCN_1814 | 7004 |
| GTCN_445 | 3914 | ATCN_1174 | 7005 |
| CTCN_825 | 3915 | GTCN_971 | 7006 |
| TTCN_813 | 3916 | ATCN_1175 | 7007 |
| GTCN_446 | 3917 | ATCN_1176 | 7008 |
| TTCN_814 | 3918 | GTCN_972 | 7009 |
| TTCN_815 | 3919 | CTCN_1815 | 7010 |
| TTCN_816 | 3920 | GTCN_973 | 7011 |
| CTCN_826 | 3921 | TTCN_1721 | 7012 |
| TTCN_817 | 3922 | TTCN_1722 | 7013 |
| TTCN_818 | 3923 | CTCN_1816 | 7014 |

| | | | |
|---|---|---|---|
| TTCN_819 | 3924 | CTCN_1817 | 7015 |
| TTCN_820 | 3925 | TTCN_1723 | 7016 |
| ATCN_507 | 3926 | TTCN_1724 | 7017 |
| ATCN_508 | 3927 | ATCN_1177 | 7018 |
| TTCN_821 | 3928 | ATCN_1178 | 7019 |
| TTCN_822 | 3929 | ATCN_1179 | 7020 |
| TTCN_823 | 3930 | ATCN_1180 | 7021 |
| CTCN_827 | 3931 | CTCN_1818 | 7022 |
| TTCN_824 | 3932 | TTCN_1725 | 7023 |
| TTCN_825 | 3933 | ATCN_1181 | 7024 |
| CTCN_828 | 3934 | ATCN_1182 | 7025 |
| TTCN_826 | 3935 | ATCN_1183 | 7026 |
| ATCN_509 | 3936 | ATCN_1184 | 7027 |
| CTCN_829 | 3937 | ATCN_1185 | 7028 |
| TTCN_827 | 3938 | CTCN_1819 | 7029 |
| CTCN_830 | 3939 | TTCN_1726 | 7030 |
| GTCN_447 | 3940 | TTCN_1727 | 7031 |
| TTCN_828 | 3941 | CTCN_1820 | 7032 |
| CTCN_831 | 3942 | CTCN_1821 | 7033 |
| GTCN_448 | 3943 | ATCN_1186 | 7034 |
| ATCN_510 | 3944 | ATCN_1187 | 7035 |
| TTCN_829 | 3945 | ATCN_1188 | 7036 |
| TTCN_830 | 3946 | TTCN_1728 | 7037 |
| GTCN_449 | 3947 | TTCN_1729 | 7038 |
| CTCN_832 | 3948 | GTCN_974 | 7039 |
| TTCN_831 | 3949 | CTCN_1822 | 7040 |
| TTCN_832 | 3950 | ATCN_1189 | 7041 |
| TTCN_833 | 3951 | TTCN_1730 | 7042 |
| TTCN_834 | 3952 | GTCN_975 | 7043 |
| TTCN_835 | 3953 | ATCN_1190 | 7044 |
| TTCN_836 | 3954 | TTCN_1731 | 7045 |
| ATCN_511 | 3955 | TTCN_1732 | 7046 |
| TTCN_837 | 3956 | CTCN_1823 | 7047 |
| TTCN_838 | 3957 | GTCN_976 | 7048 |
| CTCN_833 | 3958 | CTCN_1824 | 7049 |
| TTCN_839 | 3959 | GTCN_977 | 7050 |
| GTCN_450 | 3960 | ATCN_1191 | 7051 |
| TTCN_840 | 3961 | GTCN_978 | 7052 |
| CTCN_834 | 3962 | CTCN_1825 | 7053 |
| CTCN_835 | 3963 | GTCN_979 | 7054 |
| GTCN_451 | 3964 | ATCN_1192 | 7055 |
| CTCN_836 | 3965 | TTCN_1733 | 7056 |
| ATCN_512 | 3966 | TTCN_1734 | 7057 |
| GTCN_452 | 3967 | ATCN_1193 | 7058 |
| TTCN_841 | 3968 | TTCN_1735 | 7059 |
| CTCN_837 | 3969 | CTCN_1826 | 7060 |
| TTCN_842 | 3970 | CTCN_1827 | 7061 |
| CTCN_838 | 3971 | TTCN_1736 | 7062 |
| TTCN_843 | 3972 | TTCN_1737 | 7063 |
| TTCN_844 | 3973 | ATCN_1194 | 7064 |
| TTCN_845 | 3974 | GTCN_980 | 7065 |
| TTCN_846 | 3975 | TTCN_1738 | 7066 |
| TTCN_847 | 3976 | CTCN_1828 | 7067 |

FIG. 35 (continued)

| | | | |
|---|---|---|---|
| CTCN_839 | 3977 | GTCN_981 | 7068 |
| TTCN_848 | 3978 | CTCN_1829 | 7069 |
| TTCN_849 | 3979 | GTCN_982 | 7070 |
| ATCN_513 | 3980 | CTCN_1830 | 7071 |
| ATCN_514 | 3981 | CTCN_1831 | 7072 |
| ATCN_515 | 3982 | CTCN_1832 | 7073 |
| TTCN_850 | 3983 | CTCN_1833 | 7074 |
| TTCN_851 | 3984 | ATCN_1195 | 7075 |
| TTCN_852 | 3985 | CTCN_1834 | 7076 |
| CTCN_840 | 3986 | CTCN_1835 | 7077 |
| TTCN_853 | 3987 | CTCN_1836 | 7078 |
| TTCN_854 | 3988 | TTCN_1739 | 7079 |
| GTCN_453 | 3989 | TTCN_1740 | 7080 |
| CTCN_841 | 3990 | CTCN_1837 | 7081 |
| GTCN_454 | 3991 | CTCN_1838 | 7082 |
| ATCN_516 | 3992 | CTCN_1839 | 7083 |
| CTCN_842 | 3993 | CTCN_1840 | 7084 |
| GTCN_455 | 3994 | GTCN_983 | 7085 |
| CTCN_843 | 3995 | | |

FIG. 36: Table 3B: Targeting Sequences for TRAC

| Name | SEQ ID NO. | Name | SEQ ID NO. |
|---|---|---|---|
| GTCN_0 | 7086 | TTCN_3239 | 17273 |
| TTCN_0 | 7087 | CTCN_2822 | 17274 |
| CTCN_0 | 7088 | TTCN_3240 | 17275 |
| ATCN_0 | 7089 | ATCN_2005 | 17276 |
| ATCN_1 | 7090 | TTCN_3241 | 17277 |
| GTCN_1 | 7091 | ATCN_2006 | 17278 |
| GTCN_2 | 7092 | TTCN_3242 | 17279 |
| CTCN_1 | 7093 | ATCN_2007 | 17280 |
| CTCN_2 | 7094 | ATCN_2008 | 17281 |
| CTCN_3 | 7095 | CTCN_2823 | 17282 |
| ATCN_2 | 7096 | ATCN_2009 | 17283 |
| TTCN_1 | 7097 | TTCN_3243 | 17284 |
| TTCN_2 | 7098 | ATCN_2010 | 17285 |
| TTCN_3 | 7099 | GTCN_1701 | 17286 |
| ATCN_3 | 7100 | CTCN_2824 | 17287 |
| TTCN_4 | 7101 | TTCN_3244 | 17288 |
| TTCN_5 | 7102 | TTCN_3245 | 17289 |
| ATCN_4 | 7103 | GTCN_1702 | 17290 |
| TTCN_6 | 7104 | CTCN_2825 | 17291 |
| CTCN_4 | 7105 | TTCN_3246 | 17292 |
| CTCN_5 | 7106 | CTCN_2826 | 17293 |
| GTCN_3 | 7107 | CTCN_2827 | 17294 |
| CTCN_6 | 7108 | TTCN_3247 | 17295 |
| GTCN_4 | 7109 | TTCN_3248 | 17296 |
| TTCN_7 | 7110 | CTCN_2828 | 17297 |
| CTCN_7 | 7111 | TTCN_3249 | 17298 |
| ATCN_5 | 7112 | CTCN_2829 | 17299 |
| TTCN_8 | 7113 | CTCN_2830 | 17300 |
| TTCN_9 | 7114 | CTCN_2831 | 17301 |
| GTCN_5 | 7115 | TTCN_3250 | 17302 |
| CTCN_8 | 7116 | CTCN_2832 | 17303 |
| TTCN_10 | 7117 | GTCN_1703 | 17304 |
| GTCN_6 | 7118 | TTCN_3251 | 17305 |
| TTCN_11 | 7119 | TTCN_3252 | 17306 |
| CTCN_9 | 7120 | TTCN_3252 | 17307 |
| TTCN_12 | 7121 | TTCN_3253 | 17308 |
| CTCN_10 | 7122 | GTCN_1704 | 17309 |
| GTCN_7 | 7123 | TTCN_3254 | 17310 |
| TTCN_13 | 7124 | CTCN_2833 | 17311 |
| ATCN_6 | 7125 | CTCN_2834 | 17312 |
| TTCN_14 | 7126 | GTCN_1705 | 17313 |
| ATCN_7 | 7127 | CTCN_2835 | 17314 |
| ATCN_8 | 7128 | TTCN_3255 | 17315 |
| TTCN_15 | 7129 | TTCN_3256 | 17316 |
| GTCN_8 | 7130 | CTCN_2836 | 17317 |
| TTCN_16 | 7131 | ATCN_2011 | 17318 |
| GTCN_9 | 7132 | GTCN_1706 | 17319 |
| TTCN_17 | 7133 | CTCN_2837 | 17320 |
| CTCN_11 | 7134 | CTCN_2838 | 17321 |
| GTCN_10 | 7135 | GTCN_1707 | 17322 |
| GTCN_11 | 7136 | CTCN_2839 | 17323 |
| GTCN_12 | 7137 | TTCN_3257 | 17324 |
| ATCN_9 | 7138 | GTCN_1708 | 17325 |
| ATCN_10 | 7139 | CTCN_2840 | 17326 |
| CTCN_12 | 7140 | CTCN_2841 | 17327 |
| GTCN_13 | 7141 | GTCN_1709 | 17328 |
| CTCN_13 | 7142 | CTCN_2842 | 17329 |
| TTCN_18 | 7143 | TTCN_3258 | 17330 |
| ATCN_11 | 7144 | CTCN_2843 | 17331 |
| TTCN_19 | 7145 | ATCN_2012 | 17332 |
| ATCN_12 | 7146 | TTCN_3259 | 17333 |
| TTCN_20 | 7147 | TTCN_3260 | 17334 |
| CTCN_14 | 7148 | CTCN_2844 | 17335 |
| TTCN_21 | 7149 | CTCN_2845 | 17336 |
| CTCN_15 | 7150 | CTCN_2846 | 17337 |
| TTCN_22 | 7151 | GTCN_1710 | 17338 |
| CTCN_16 | 7152 | CTCN_2847 | 17339 |
| GTCN_14 | 7153 | CTCN_2848 | 17340 |
| ATCN_13 | 7154 | CTCN_2849 | 17341 |
| CTCN_17 | 7155 | CTCN_2850 | 17342 |
| GTCN_15 | 7156 | GTCN_1711 | 17343 |
| TTCN_23 | 7157 | CTCN_2851 | 17344 |
| ATCN_14 | 7158 | GTCN_1712 | 17345 |
| ATCN_15 | 7159 | TTCN_3261 | 17346 |
| CTCN_18 | 7160 | CTCN_2852 | 17347 |
| CTCN_19 | 7161 | CTCN_2853 | 17348 |
| CTCN_20 | 7162 | CTCN_2854 | 17349 |
| CTCN_21 | 7163 | TTCN_3262 | 17350 |
| CTCN_22 | 7164 | CTCN_2855 | 17351 |
| TTCN_24 | 7165 | TTCN_3263 | 17352 |
| TTCN_25 | 7166 | ATCN_2013 | 17353 |
| TTCN_26 | 7167 | CTCN_2856 | 17354 |
| CTCN_23 | 7168 | CTCN_2857 | 17355 |
| CTCN_24 | 7169 | GTCN_1713 | 17356 |
| CTCN_25 | 7170 | TTCN_3264 | 17357 |
| ATCN_16 | 7171 | ATCN_2014 | 17358 |
| CTCN_26 | 7172 | GTCN_1714 | 17359 |
| TTCN_27 | 7173 | CTCN_2858 | 17360 |
| CTCN_27 | 7174 | ATCN_2015 | 17361 |
| ATCN_17 | 7175 | CTCN_2859 | 17362 |
| TTCN_28 | 7176 | TTCN_3265 | 17363 |
| GTCN_16 | 7177 | TTCN_3266 | 17364 |
| TTCN_29 | 7178 | CTCN_2860 | 17365 |
| GTCN_17 | 7179 | TTCN_3267 | 17366 |
| CTCN_28 | 7180 | TTCN_3268 | 17367 |
| CTCN_29 | 7181 | ATCN_2016 | 17368 |
| GTCN_18 | 7182 | TTCN_3269 | 17369 |
| TTCN_30 | 7183 | ATCN_2017 | 17370 |
| TTCN_31 | 7184 | ATCN_2018 | 17371 |
| CTCN_30 | 7185 | TTCN_3270 | 17372 |
| CTCN_31 | 7186 | GTCN_1715 | 17373 |
| TTCN_32 | 7187 | ATCN_2019 | 17374 |
| GTCN_19 | 7188 | TTCN_3271 | 17375 |
| CTCN_32 | 7189 | ATCN_2020 | 17376 |
| GTCN_20 | 7190 | CTCN_2861 | 17377 |
| ATCN_18 | 7191 | CTCN_2862 | 17378 |

FIG. 36 (continued)

| | | | |
|---|---|---|---|
| CTCN_33 | 7192 | ATCN_2021 | 17379 |
| ATCN_19 | 7193 | ATCN_2022 | 17380 |
| TTCN_33 | 7194 | TTCN_3272 | 17381 |
| TTCN_34 | 7195 | ATCN_2023 | 17382 |
| GTCN_21 | 7196 | CTCN_2863 | 17383 |
| TTCN_35 | 7197 | GTCN_1716 | 17384 |
| CTCN_34 | 7198 | CTCN_2864 | 17385 |
| ATCN_20 | 7199 | ATCN_2024 | 17386 |
| TTCN_36 | 7200 | GTCN_1717 | 17387 |
| TTCN_37 | 7201 | GTCN_1718 | 17388 |
| CTCN_35 | 7202 | ATCN_2025 | 17389 |
| GTCN_22 | 7203 | CTCN_2865 | 17390 |
| CTCN_36 | 7204 | ATCN_2026 | 17391 |
| TTCN_38 | 7205 | ATCN_2027 | 17392 |
| CTCN_37 | 7206 | CTCN_2866 | 17393 |
| TTCN_39 | 7207 | GTCN_1719 | 17394 |
| ATCN_21 | 7208 | ATCN_2028 | 17395 |
| TTCN_40 | 7209 | TTCN_3273 | 17396 |
| CTCN_38 | 7210 | CTCN_2867 | 17397 |
| CTCN_39 | 7211 | GTCN_1720 | 17398 |
| CTCN_40 | 7212 | ATCN_2029 | 17399 |
| TTCN_41 | 7213 | TTCN_3274 | 17400 |
| GTCN_23 | 7214 | GTCN_1721 | 17401 |
| CTCN_41 | 7215 | TTCN_3275 | 17402 |
| TTCN_42 | 7216 | CTCN_2868 | 17403 |
| GTCN_24 | 7217 | TTCN_3276 | 17404 |
| TTCN_43 | 7218 | TTCN_3277 | 17405 |
| CTCN_42 | 7219 | TTCN_3278 | 17406 |
| GTCN_25 | 7220 | TTCN_3279 | 17407 |
| ATCN_22 | 7221 | GTCN_1722 | 17408 |
| TTCN_44 | 7222 | CTCN_2869 | 17409 |
| CTCN_43 | 7223 | CTCN_2870 | 17410 |
| TTCN_45 | 7224 | CTCN_2871 | 17411 |
| TTCN_46 | 7225 | GTCN_1723 | 17412 |
| TTCN_47 | 7226 | CTCN_2872 | 17413 |
| GTCN_26 | 7227 | TTCN_3280 | 17414 |
| TTCN_48 | 7228 | CTCN_2873 | 17415 |
| CTCN_44 | 7229 | GTCN_1724 | 17416 |
| TTCN_49 | 7230 | CTCN_2874 | 17417 |
| CTCN_45 | 7231 | GTCN_1725 | 17418 |
| TTCN_50 | 7232 | CTCN_2875 | 17419 |
| GTCN_27 | 7233 | TTCN_3281 | 17420 |
| TTCN_51 | 7234 | ATCN_2030 | 17421 |
| TTCN_52 | 7235 | CTCN_2876 | 17422 |
| CTCN_46 | 7236 | ATCN_2031 | 17423 |
| GTCN_28 | 7237 | TTCN_3282 | 17424 |
| ATCN_23 | 7238 | TTCN_3283 | 17425 |
| TTCN_53 | 7239 | CTCN_2877 | 17426 |
| GTCN_29 | 7240 | CTCN_2878 | 17427 |
| TTCN_54 | 7241 | CTCN_2879 | 17428 |
| TTCN_55 | 7242 | TTCN_3284 | 17429 |
| TTCN_56 | 7243 | ATCN_2032 | 17430 |
| TTCN_57 | 7244 | ATCN_2033 | 17431 |
| GTCN_30 | 7245 | TTCN_3285 | 17432 |
| CTCN_47 | 7246 | TTCN_3286 | 17433 |

| | | | |
|---|---|---|---|
| GTCN_31 | 7247 | TTCN_3287 | 17434 |
| CTCN_48 | 7248 | CTCN_2880 | 17435 |
| CTCN_49 | 7249 | ATCN_2034 | 17436 |
| TTCN_58 | 7250 | TTCN_3288 | 17437 |
| ATCN_24 | 7251 | TTCN_3289 | 17438 |
| GTCN_32 | 7252 | ATCN_2035 | 17439 |
| TTCN_59 | 7253 | ATCN_2036 | 17440 |
| GTCN_33 | 7254 | CTCN_2881 | 17441 |
| TTCN_60 | 7255 | TTCN_3290 | 17442 |
| TTCN_61 | 7256 | GTCN_1726 | 17443 |
| GTCN_34 | 7257 | TTCN_3291 | 17444 |
| GTCN_35 | 7258 | CTCN_2882 | 17445 |
| ATCN_25 | 7259 | GTCN_1727 | 17446 |
| ATCN_26 | 7260 | ATCN_2037 | 17447 |
| ATCN_27 | 7261 | CTCN_2883 | 17448 |
| ATCN_28 | 7262 | TTCN_3292 | 17449 |
| TTCN_62 | 7263 | ATCN_2038 | 17450 |
| ATCN_29 | 7264 | ATCN_2039 | 17451 |
| ATCN_30 | 7265 | ATCN_2040 | 17452 |
| TTCN_63 | 7266 | CTCN_2884 | 17453 |
| TTCN_64 | 7267 | TTCN_3293 | 17454 |
| TTCN_65 | 7268 | CTCN_2885 | 17455 |
| GTCN_36 | 7269 | ATCN_2041 | 17456 |
| ATCN_31 | 7270 | ATCN_2042 | 17457 |
| GTCN_37 | 7271 | ATCN_2043 | 17458 |
| GTCN_38 | 7272 | TTCN_3294 | 17459 |
| CTCN_50 | 7273 | GTCN_1728 | 17460 |
| ATCN_32 | 7274 | CTCN_2886 | 17461 |
| TTCN_66 | 7275 | CTCN_2887 | 17462 |
| TTCN_67 | 7276 | CTCN_2888 | 17463 |
| TTCN_68 | 7277 | ATCN_2044 | 17464 |
| TTCN_69 | 7278 | GTCN_1729 | 17465 |
| TTCN_70 | 7279 | CTCN_2889 | 17466 |
| ATCN_33 | 7280 | CTCN_2890 | 17467 |
| TTCN_71 | 7281 | TTCN_3295 | 17468 |
| TTCN_72 | 7282 | TTCN_3296 | 17469 |
| ATCN_34 | 7283 | TTCN_3297 | 17470 |
| CTCN_51 | 7284 | GTCN_1730 | 17471 |
| TTCN_73 | 7285 | TTCN_3298 | 17472 |
| ATCN_35 | 7286 | CTCN_2891 | 17473 |
| TTCN_74 | 7287 | ATCN_2045 | 17474 |
| TTCN_75 | 7288 | ATCN_2046 | 17475 |
| ATCN_36 | 7289 | CTCN_2892 | 17476 |
| CTCN_52 | 7290 | TTCN_3299 | 17477 |
| GTCN_39 | 7291 | GTCN_1731 | 17478 |
| ATCN_37 | 7292 | GTCN_1732 | 17479 |
| TTCN_76 | 7293 | CTCN_2893 | 17480 |
| CTCN_53 | 7294 | TTCN_3300 | 17481 |
| TTCN_77 | 7295 | TTCN_3301 | 17482 |
| ATCN_38 | 7296 | CTCN_2894 | 17483 |
| TTCN_78 | 7297 | ATCN_2047 | 17484 |
| CTCN_54 | 7298 | ATCN_2048 | 17485 |
| TTCN_79 | 7299 | CTCN_2895 | 17486 |
| TTCN_80 | 7300 | GTCN_1733 | 17487 |
| TTCN_81 | 7301 | TTCN_3302 | 17488 |

FIG. 36 (continued)

| | | | |
|---|---|---|---|
| CTCN_55 | 7302 | CTCN_2896 | 17489 |
| CTCN_56 | 7303 | TTCN_3303 | 17490 |
| GTCN_40 | 7304 | CTCN_2897 | 17491 |
| CTCN_57 | 7305 | TTCN_3304 | 17492 |
| ATCN_39 | 7306 | GTCN_1734 | 17493 |
| CTCN_58 | 7307 | CTCN_2898 | 17494 |
| CTCN_59 | 7308 | CTCN_2899 | 17495 |
| GTCN_41 | 7309 | TTCN_3305 | 17496 |
| TTCN_82 | 7310 | TTCN_3306 | 17497 |
| TTCN_83 | 7311 | ATCN_2049 | 17498 |
| CTCN_60 | 7312 | TTCN_3307 | 17499 |
| TTCN_84 | 7313 | TTCN_3308 | 17500 |
| GTCN_42 | 7314 | CTCN_2900 | 17501 |
| TTCN_85 | 7315 | TTCN_3309 | 17502 |
| CTCN_61 | 7316 | CTCN_2901 | 17503 |
| GTCN_43 | 7317 | CTCN_2902 | 17504 |
| ATCN_40 | 7318 | GTCN_1735 | 17505 |
| ATCN_41 | 7319 | CTCN_2903 | 17506 |
| TTCN_86 | 7320 | ATCN_2050 | 17507 |
| TTCN_87 | 7321 | ATCN_2051 | 17508 |
| ATCN_42 | 7322 | GTCN_1736 | 17509 |
| TTCN_88 | 7323 | CTCN_2904 | 17510 |
| CTCN_62 | 7324 | CTCN_2905 | 17511 |
| ATCN_43 | 7325 | CTCN_2906 | 17512 |
| ATCN_44 | 7326 | TTCN_3310 | 17513 |
| CTCN_63 | 7327 | GTCN_1737 | 17514 |
| TTCN_89 | 7328 | CTCN_2907 | 17515 |
| CTCN_64 | 7329 | CTCN_2908 | 17516 |
| GTCN_44 | 7330 | GTCN_1738 | 17517 |
| CTCN_65 | 7331 | TTCN_3311 | 17518 |
| TTCN_90 | 7332 | CTCN_2909 | 17519 |
| CTCN_66 | 7333 | TTCN_3312 | 17520 |
| CTCN_67 | 7334 | ATCN_2052 | 17521 |
| CTCN_68 | 7335 | ATCN_2053 | 17522 |
| CTCN_69 | 7336 | TTCN_3313 | 17523 |
| GTCN_45 | 7337 | ATCN_2054 | 17524 |
| CTCN_70 | 7338 | TTCN_3314 | 17525 |
| CTCN_71 | 7339 | TTCN_3315 | 17526 |
| GTCN_46 | 7340 | TTCN_3316 | 17527 |
| TTCN_91 | 7341 | TTCN_3317 | 17528 |
| TTCN_92 | 7342 | CTCN_2910 | 17529 |
| ATCN_45 | 7343 | TTCN_3318 | 17530 |
| TTCN_93 | 7344 | ATCN_2055 | 17531 |
| ATCN_46 | 7345 | TTCN_3319 | 17532 |
| CTCN_72 | 7346 | TTCN_3320 | 17533 |
| TTCN_94 | 7347 | GTCN_1739 | 17534 |
| GTCN_47 | 7348 | TTCN_3321 | 17535 |
| TTCN_95 | 7349 | TTCN_3322 | 17536 |
| TTCN_96 | 7350 | TTCN_3323 | 17537 |
| TTCN_97 | 7351 | ATCN_2056 | 17538 |
| TTCN_98 | 7352 | CTCN_2911 | 17539 |
| CTCN_73 | 7353 | GTCN_1740 | 17540 |
| TTCN_99 | 7354 | ATCN_2057 | 17541 |
| TTCN_100 | 7355 | TTCN_3324 | 17542 |
| ATCN_47 | 7356 | CTCN_2912 | 17543 |

| | | | |
|---|---|---|---|
| GTCN_48 | 7357 | GTCN_1741 | 17544 |
| TTCN_101 | 7358 | ATCN_2058 | 17545 |
| TTCN_102 | 7359 | ATCN_2059 | 17546 |
| TTCN_103 | 7360 | ATCN_2060 | 17547 |
| CTCN_74 | 7361 | TTCN_3325 | 17548 |
| TTCN_104 | 7362 | TTCN_3326 | 17549 |
| GTCN_49 | 7363 | GTCN_1742 | 17550 |
| ATCN_48 | 7364 | ATCN_2061 | 17551 |
| CTCN_75 | 7365 | ATCN_2062 | 17552 |
| GTCN_50 | 7366 | TTCN_3327 | 17553 |
| CTCN_76 | 7367 | TTCN_3328 | 17554 |
| GTCN_51 | 7368 | TTCN_3329 | 17555 |
| TTCN_105 | 7369 | ATCN_2063 | 17556 |
| CTCN_77 | 7370 | TTCN_3330 | 17557 |
| GTCN_52 | 7371 | TTCN_3331 | 17558 |
| TTCN_106 | 7372 | GTCN_1743 | 17559 |
| GTCN_53 | 7373 | CTCN_2913 | 17560 |
| CTCN_78 | 7374 | GTCN_1744 | 17561 |
| TTCN_107 | 7375 | TTCN_3332 | 17562 |
| GTCN_54 | 7376 | CTCN_2914 | 17563 |
| CTCN_79 | 7377 | ATCN_2064 | 17564 |
| CTCN_80 | 7378 | CTCN_2915 | 17565 |
| GTCN_55 | 7379 | CTCN_2916 | 17566 |
| CTCN_81 | 7380 | ATCN_2065 | 17567 |
| CTCN_82 | 7381 | TTCN_3333 | 17568 |
| CTCN_83 | 7382 | TTCN_3334 | 17569 |
| TTCN_108 | 7383 | CTCN_2917 | 17570 |
| ATCN_49 | 7384 | TTCN_3335 | 17571 |
| CTCN_84 | 7385 | TTCN_3336 | 17572 |
| GTCN_56 | 7386 | TTCN_3337 | 17573 |
| CTCN_85 | 7387 | TTCN_3338 | 17574 |
| CTCN_86 | 7388 | TTCN_3339 | 17575 |
| TTCN_109 | 7389 | GTCN_1745 | 17576 |
| ATCN_50 | 7390 | TTCN_3340 | 17577 |
| ATCN_51 | 7391 | TTCN_3341 | 17578 |
| ATCN_52 | 7392 | ATCN_2066 | 17579 |
| TTCN_110 | 7393 | TTCN_3342 | 17580 |
| ATCN_53 | 7394 | TTCN_3343 | 17581 |
| ATCN_54 | 7395 | TTCN_3344 | 17582 |
| CTCN_87 | 7396 | TTCN_3345 | 17583 |
| TTCN_111 | 7397 | CTCN_2918 | 17584 |
| CTCN_88 | 7398 | TTCN_3346 | 17585 |
| TTCN_112 | 7399 | GTCN_1746 | 17586 |
| ATCN_55 | 7400 | TTCN_3347 | 17587 |
| CTCN_89 | 7401 | CTCN_2919 | 17588 |
| CTCN_90 | 7402 | TTCN_3348 | 17589 |
| TTCN_113 | 7403 | TTCN_3349 | 17590 |
| TTCN_114 | 7404 | CTCN_2920 | 17591 |
| GTCN_57 | 7405 | TTCN_3350 | 17592 |
| TTCN_115 | 7406 | TTCN_3351 | 17593 |
| TTCN_116 | 7407 | TTCN_3352 | 17594 |
| ATCN_56 | 7408 | TTCN_3353 | 17595 |
| TTCN_117 | 7409 | TTCN_3354 | 17596 |
| CTCN_91 | 7410 | TTCN_3355 | 17597 |
| ATCN_57 | 7411 | CTCN_2921 | 17598 |

FIG. 36 (continued)

| | | | |
|---|---|---|---|
| ATCN_58 | 7412 | CTCN_2922 | 17599 |
| GTCN_58 | 7413 | TTCN_3356 | 17600 |
| ATCN_59 | 7414 | CTCN_2923 | 17601 |
| ATCN_60 | 7415 | TTCN_3357 | 17602 |
| ATCN_61 | 7416 | GTCN_1747 | 17603 |
| TTCN_118 | 7417 | CTCN_2924 | 17604 |
| ATCN_62 | 7418 | CTCN_2925 | 17605 |
| TTCN_119 | 7419 | TTCN_3358 | 17606 |
| CTCN_92 | 7420 | TTCN_3359 | 17607 |
| CTCN_93 | 7421 | TTCN_3360 | 17608 |
| GTCN_59 | 7422 | TTCN_3361 | 17609 |
| ATCN_63 | 7423 | CTCN_2926 | 17610 |
| CTCN_94 | 7424 | TTCN_3362 | 17611 |
| ATCN_64 | 7425 | CTCN_2927 | 17612 |
| TTCN_120 | 7426 | TTCN_3363 | 17613 |
| ATCN_65 | 7427 | CTCN_2928 | 17614 |
| TTCN_121 | 7428 | CTCN_2929 | 17615 |
| TTCN_122 | 7429 | TTCN_3364 | 17616 |
| GTCN_60 | 7430 | CTCN_2930 | 17617 |
| TTCN_123 | 7431 | TTCN_3365 | 17618 |
| CTCN_95 | 7432 | ATCN_2067 | 17619 |
| CTCN_96 | 7433 | TTCN_3366 | 17620 |
| GTCN_61 | 7434 | CTCN_2931 | 17621 |
| TTCN_124 | 7435 | CTCN_2932 | 17622 |
| ATCN_66 | 7436 | CTCN_2933 | 17623 |
| TTCN_125 | 7437 | GTCN_1748 | 17624 |
| ATCN_67 | 7438 | CTCN_2934 | 17625 |
| TTCN_126 | 7439 | ATCN_2068 | 17626 |
| TTCN_127 | 7440 | CTCN_2935 | 17627 |
| GTCN_62 | 7441 | CTCN_2936 | 17628 |
| CTCN_97 | 7442 | CTCN_2937 | 17629 |
| TTCN_128 | 7443 | GTCN_1749 | 17630 |
| CTCN_98 | 7444 | GTCN_1750 | 17631 |
| TTCN_129 | 7445 | GTCN_1751 | 17632 |
| CTCN_99 | 7446 | CTCN_2938 | 17633 |
| GTCN_63 | 7447 | TTCN_3367 | 17634 |
| TTCN_130 | 7448 | TTCN_3368 | 17635 |
| TTCN_131 | 7449 | GTCN_1752 | 17636 |
| TTCN_132 | 7450 | GTCN_1753 | 17637 |
| GTCN_64 | 7451 | CTCN_2939 | 17638 |
| ATCN_68 | 7452 | TTCN_3369 | 17639 |
| ATCN_69 | 7453 | CTCN_2940 | 17640 |
| TTCN_133 | 7454 | ATCN_2069 | 17641 |
| ATCN_70 | 7455 | CTCN_2941 | 17642 |
| CTCN_100 | 7456 | CTCN_2942 | 17643 |
| GTCN_65 | 7457 | CTCN_2943 | 17644 |
| CTCN_101 | 7458 | GTCN_1754 | 17645 |
| TTCN_134 | 7459 | TTCN_3370 | 17646 |
| ATCN_71 | 7460 | ATCN_2070 | 17647 |
| TTCN_135 | 7461 | CTCN_2944 | 17648 |
| ATCN_72 | 7462 | CTCN_2945 | 17649 |
| GTCN_66 | 7463 | CTCN_2946 | 17650 |
| GTCN_67 | 7464 | GTCN_1755 | 17651 |
| ATCN_73 | 7465 | ATCN_2071 | 17652 |
| ATCN_74 | 7466 | TTCN_3371 | 17653 |

| | | | |
|---|---|---|---|
| TTCN_136 | 7467 | TTCN_3372 | 17654 |
| ATCN_75 | 7468 | ATCN_2072 | 17655 |
| CTCN_102 | 7469 | CTCN_2947 | 17656 |
| TTCN_137 | 7470 | ATCN_2073 | 17657 |
| TTCN_138 | 7471 | TTCN_3373 | 17658 |
| GTCN_68 | 7472 | CTCN_2948 | 17659 |
| TTCN_139 | 7473 | CTCN_2949 | 17660 |
| GTCN_69 | 7474 | CTCN_2950 | 17661 |
| TTCN_140 | 7475 | CTCN_2951 | 17662 |
| ATCN_76 | 7476 | GTCN_1756 | 17663 |
| CTCN_103 | 7477 | CTCN_2952 | 17664 |
| TTCN_141 | 7478 | CTCN_2953 | 17665 |
| ATCN_77 | 7479 | ATCN_2074 | 17666 |
| GTCN_70 | 7480 | TTCN_3374 | 17667 |
| GTCN_71 | 7481 | ATCN_2075 | 17668 |
| GTCN_72 | 7482 | ATCN_2076 | 17669 |
| CTCN_104 | 7483 | ATCN_2077 | 17670 |
| GTCN_73 | 7484 | GTCN_1757 | 17671 |
| TTCN_142 | 7485 | CTCN_2954 | 17672 |
| ATCN_78 | 7486 | TTCN_3375 | 17673 |
| GTCN_74 | 7487 | ATCN_2078 | 17674 |
| TTCN_143 | 7488 | CTCN_2955 | 17675 |
| TTCN_144 | 7489 | CTCN_2956 | 17676 |
| CTCN_105 | 7490 | TTCN_3376 | 17677 |
| TTCN_145 | 7491 | CTCN_2957 | 17678 |
| TTCN_146 | 7492 | CTCN_2958 | 17679 |
| GTCN_75 | 7493 | ATCN_2079 | 17680 |
| GTCN_76 | 7494 | TTCN_3377 | 17681 |
| GTCN_77 | 7495 | TTCN_3378 | 17682 |
| CTCN_106 | 7496 | ATCN_2080 | 17683 |
| ATCN_79 | 7497 | CTCN_2959 | 17684 |
| ATCN_80 | 7498 | TTCN_3379 | 17685 |
| ATCN_81 | 7499 | CTCN_2960 | 17686 |
| ATCN_82 | 7500 | TTCN_3380 | 17687 |
| CTCN_107 | 7501 | TTCN_3381 | 17688 |
| CTCN_108 | 7502 | TTCN_3382 | 17689 |
| TTCN_147 | 7503 | ATCN_2081 | 17690 |
| CTCN_109 | 7504 | TTCN_3383 | 17691 |
| TTCN_148 | 7505 | CTCN_2961 | 17692 |
| TTCN_149 | 7506 | TTCN_3384 | 17693 |
| CTCN_110 | 7507 | ATCN_2082 | 17694 |
| TTCN_150 | 7508 | CTCN_2962 | 17695 |
| ATCN_83 | 7509 | ATCN_2083 | 17696 |
| TTCN_151 | 7510 | ATCN_2084 | 17697 |
| ATCN_84 | 7511 | CTCN_2963 | 17698 |
| ATCN_85 | 7512 | TTCN_3385 | 17699 |
| CTCN_111 | 7513 | ATCN_2085 | 17700 |
| CTCN_112 | 7514 | CTCN_2964 | 17701 |
| ATCN_86 | 7515 | ATCN_2086 | 17702 |
| CTCN_113 | 7516 | CTCN_2965 | 17703 |
| CTCN_114 | 7517 | TTCN_3386 | 17704 |
| ATCN_87 | 7518 | TTCN_3387 | 17705 |
| TTCN_152 | 7519 | CTCN_2966 | 17706 |
| ATCN_88 | 7520 | GTCN_1758 | 17707 |
| GTCN_78 | 7521 | ATCN_2087 | 17708 |

FIG. 36 (continued)

| | | | |
|---|---|---|---|
| GTCN_79 | 7522 | TTCN_3388 | 17709 |
| CTCN_115 | 7523 | GTCN_1759 | 17710 |
| TTCN_153 | 7524 | CTCN_2967 | 17711 |
| ATCN_89 | 7525 | CTCN_2968 | 17712 |
| GTCN_80 | 7526 | CTCN_2969 | 17713 |
| ATCN_90 | 7527 | GTCN_1760 | 17714 |
| CTCN_116 | 7528 | CTCN_2970 | 17715 |
| ATCN_91 | 7529 | TTCN_3389 | 17716 |
| ATCN_92 | 7530 | ATCN_2088 | 17717 |
| CTCN_117 | 7531 | TTCN_3390 | 17718 |
| TTCN_154 | 7532 | TTCN_3391 | 17719 |
| CTCN_118 | 7533 | TTCN_3392 | 17720 |
| GTCN_81 | 7534 | CTCN_2971 | 17721 |
| CTCN_119 | 7535 | CTCN_2972 | 17722 |
| TTCN_155 | 7536 | TTCN_3393 | 17723 |
| CTCN_120 | 7537 | ATCN_2089 | 17724 |
| TTCN_156 | 7538 | ATCN_2090 | 17725 |
| ATCN_93 | 7539 | TTCN_3394 | 17726 |
| TTCN_157 | 7540 | CTCN_2973 | 17727 |
| GTCN_82 | 7541 | TTCN_3395 | 17728 |
| GTCN_83 | 7542 | TTCN_3396 | 17729 |
| CTCN_121 | 7543 | GTCN_1761 | 17730 |
| TTCN_158 | 7544 | TTCN_3397 | 17731 |
| ATCN_94 | 7545 | TTCN_3398 | 17732 |
| GTCN_84 | 7546 | TTCN_3399 | 17733 |
| CTCN_122 | 7547 | TTCN_3400 | 17734 |
| TTCN_159 | 7548 | ATCN_2091 | 17735 |
| TTCN_160 | 7549 | ATCN_2092 | 17736 |
| TTCN_161 | 7550 | ATCN_2093 | 17737 |
| CTCN_123 | 7551 | GTCN_1762 | 17738 |
| ATCN_95 | 7552 | ATCN_2094 | 17739 |
| TTCN_162 | 7553 | CTCN_2974 | 17740 |
| CTCN_124 | 7554 | TTCN_3401 | 17741 |
| TTCN_163 | 7555 | GTCN_1763 | 17742 |
| CTCN_125 | 7556 | CTCN_2975 | 17743 |
| ATCN_96 | 7557 | TTCN_3402 | 17744 |
| TTCN_164 | 7558 | TTCN_3403 | 17745 |
| CTCN_126 | 7559 | TTCN_3404 | 17746 |
| TTCN_165 | 7560 | ATCN_2095 | 17747 |
| TTCN_166 | 7561 | ATCN_2096 | 17748 |
| TTCN_167 | 7562 | TTCN_3405 | 17749 |
| CTCN_127 | 7563 | TTCN_3406 | 17750 |
| TTCN_168 | 7564 | ATCN_2097 | 17751 |
| CTCN_128 | 7565 | ATCN_2098 | 17752 |
| TTCN_169 | 7566 | CTCN_2976 | 17753 |
| GTCN_85 | 7567 | CTCN_2977 | 17754 |
| CTCN_129 | 7568 | ATCN_2099 | 17755 |
| TTCN_170 | 7569 | ATCN_2100 | 17756 |
| TTCN_171 | 7570 | TTCN_3407 | 17757 |
| GTCN_86 | 7571 | CTCN_2978 | 17758 |
| GTCN_87 | 7572 | CTCN_2979 | 17759 |
| CTCN_130 | 7573 | TTCN_3408 | 17760 |
| TTCN_172 | 7574 | TTCN_3409 | 17761 |
| ATCN_97 | 7575 | GTCN_1764 | 17762 |
| TTCN_173 | 7576 | CTCN_2980 | 17763 |

| | | | |
|---|---|---|---|
| GTCN_88 | 7577 | GTCN_1765 | 17764 |
| GTCN_89 | 7578 | TTCN_3410 | 17765 |
| CTCN_131 | 7579 | CTCN_2981 | 17766 |
| TTCN_174 | 7580 | CTCN_2982 | 17767 |
| TTCN_175 | 7581 | GTCN_1766 | 17768 |
| GTCN_90 | 7582 | CTCN_2983 | 17769 |
| TTCN_176 | 7583 | TTCN_3411 | 17770 |
| GTCN_91 | 7584 | GTCN_1767 | 17771 |
| CTCN_132 | 7585 | CTCN_2984 | 17772 |
| CTCN_133 | 7586 | TTCN_3412 | 17773 |
| CTCN_134 | 7587 | GTCN_1768 | 17774 |
| ATCN_98 | 7588 | CTCN_2985 | 17775 |
| ATCN_99 | 7589 | ATCN_2101 | 17776 |
| TTCN_177 | 7590 | CTCN_2986 | 17777 |
| CTCN_135 | 7591 | GTCN_1769 | 17778 |
| TTCN_178 | 7592 | CTCN_2987 | 17779 |
| TTCN_179 | 7593 | TTCN_3413 | 17780 |
| CTCN_136 | 7594 | ATCN_2102 | 17781 |
| CTCN_137 | 7595 | ATCN_2103 | 17782 |
| TTCN_180 | 7596 | TTCN_3414 | 17783 |
| TTCN_181 | 7597 | ATCN_2104 | 17784 |
| CTCN_138 | 7598 | CTCN_2988 | 17785 |
| TTCN_182 | 7599 | GTCN_1770 | 17786 |
| ATCN_100 | 7600 | CTCN_2989 | 17787 |
| CTCN_139 | 7601 | GTCN_1771 | 17788 |
| CTCN_140 | 7602 | GTCN_1772 | 17789 |
| CTCN_141 | 7603 | TTCN_3415 | 17790 |
| CTCN_142 | 7604 | GTCN_1773 | 17791 |
| GTCN_92 | 7605 | GTCN_1774 | 17792 |
| CTCN_143 | 7606 | CTCN_2990 | 17793 |
| TTCN_183 | 7607 | TTCN_3416 | 17794 |
| CTCN_144 | 7608 | ATCN_2105 | 17795 |
| TTCN_184 | 7609 | ATCN_2106 | 17796 |
| TTCN_185 | 7610 | ATCN_2107 | 17797 |
| ATCN_101 | 7611 | ATCN_2108 | 17798 |
| GTCN_93 | 7612 | CTCN_2991 | 17799 |
| ATCN_102 | 7613 | TTCN_3417 | 17800 |
| GTCN_94 | 7614 | CTCN_2992 | 17801 |
| ATCN_103 | 7615 | TTCN_3418 | 17802 |
| ATCN_104 | 7616 | TTCN_3419 | 17803 |
| ATCN_105 | 7617 | CTCN_2993 | 17804 |
| CTCN_145 | 7618 | CTCN_2994 | 17805 |
| TTCN_186 | 7619 | GTCN_1775 | 17806 |
| TTCN_187 | 7620 | TTCN_3420 | 17807 |
| ATCN_106 | 7621 | TTCN_3421 | 17808 |
| TTCN_188 | 7622 | CTCN_2995 | 17809 |
| TTCN_189 | 7623 | TTCN_3422 | 17810 |
| TTCN_190 | 7624 | TTCN_3423 | 17811 |
| ATCN_107 | 7625 | CTCN_2996 | 17812 |
| TTCN_191 | 7626 | TTCN_3424 | 17813 |
| ATCN_108 | 7627 | ATCN_2109 | 17814 |
| ATCN_109 | 7628 | CTCN_2997 | 17815 |
| CTCN_146 | 7629 | TTCN_3425 | 17816 |
| CTCN_147 | 7630 | TTCN_3426 | 17817 |
| GTCN_95 | 7631 | CTCN_2998 | 17818 |

FIG. 36 (continued)

| | | | |
|---|---|---|---|
| TTCN_192 | 7632 | TTCN_3427 | 17819 |
| TTCN_193 | 7633 | CTCN_2999 | 17820 |
| TTCN_194 | 7634 | TTCN_3428 | 17821 |
| ATCN_110 | 7635 | TTCN_3429 | 17822 |
| TTCN_195 | 7636 | ATCN_2110 | 17823 |
| ATCN_111 | 7637 | ATCN_2111 | 17824 |
| CTCN_148 | 7638 | ATCN_2112 | 17825 |
| ATCN_112 | 7639 | ATCN_2113 | 17826 |
| GTCN_96 | 7640 | TTCN_3430 | 17827 |
| CTCN_149 | 7641 | TTCN_3431 | 17828 |
| ATCN_113 | 7642 | TTCN_3432 | 17829 |
| GTCN_97 | 7643 | TTCN_3433 | 17830 |
| CTCN_150 | 7644 | CTCN_3000 | 17831 |
| TTCN_196 | 7645 | ATCN_2114 | 17832 |
| TTCN_197 | 7646 | CTCN_3001 | 17833 |
| CTCN_151 | 7647 | TTCN_3434 | 17834 |
| TTCN_198 | 7648 | CTCN_3002 | 17835 |
| TTCN_199 | 7649 | TTCN_3435 | 17836 |
| CTCN_152 | 7650 | ATCN_2115 | 17837 |
| TTCN_200 | 7651 | ATCN_2116 | 17838 |
| ATCN_114 | 7652 | ATCN_2117 | 17839 |
| ATCN_115 | 7653 | CTCN_3003 | 17840 |
| TTCN_201 | 7654 | TTCN_3436 | 17841 |
| CTCN_153 | 7655 | ATCN_2118 | 17842 |
| ATCN_116 | 7656 | TTCN_3437 | 17843 |
| TTCN_202 | 7657 | CTCN_3004 | 17844 |
| TTCN_203 | 7658 | CTCN_3005 | 17845 |
| ATCN_117 | 7659 | CTCN_3006 | 17846 |
| GTCN_98 | 7660 | CTCN_3007 | 17847 |
| GTCN_99 | 7661 | CTCN_3008 | 17848 |
| TTCN_204 | 7662 | TTCN_3438 | 17849 |
| GTCN_100 | 7663 | TTCN_3439 | 17850 |
| TTCN_205 | 7664 | CTCN_3009 | 17851 |
| CTCN_154 | 7665 | GTCN_1776 | 17852 |
| CTCN_155 | 7666 | TTCN_3440 | 17853 |
| ATCN_118 | 7667 | CTCN_3010 | 17854 |
| ATCN_119 | 7668 | CTCN_3011 | 17855 |
| ATCN_120 | 7669 | CTCN_3012 | 17856 |
| ATCN_121 | 7670 | GTCN_1777 | 17857 |
| CTCN_156 | 7671 | TTCN_3441 | 17858 |
| CTCN_157 | 7672 | ATCN_2119 | 17859 |
| TTCN_206 | 7673 | CTCN_3013 | 17860 |
| GTCN_101 | 7674 | CTCN_3014 | 17861 |
| ATCN_122 | 7675 | CTCN_3015 | 17862 |
| GTCN_102 | 7676 | TTCN_3442 | 17863 |
| CTCN_158 | 7677 | CTCN_3016 | 17864 |
| TTCN_207 | 7678 | TTCN_3443 | 17865 |
| ATCN_123 | 7679 | CTCN_3017 | 17866 |
| ATCN_124 | 7680 | GTCN_1778 | 17867 |
| ATCN_125 | 7681 | ATCN_2120 | 17868 |
| CTCN_159 | 7682 | CTCN_3018 | 17869 |
| GTCN_103 | 7683 | ATCN_2121 | 17870 |
| CTCN_160 | 7684 | TTCN_3444 | 17871 |
| TTCN_208 | 7685 | ATCN_2122 | 17872 |
| TTCN_209 | 7686 | ATCN_2123 | 17873 |

| | | | |
|---|---|---|---|
| CTCN_161 | 7687 | TTCN_3445 | 17874 |
| GTCN_104 | 7688 | CTCN_3019 | 17875 |
| CTCN_162 | 7689 | ATCN_2124 | 17876 |
| CTCN_163 | 7690 | TTCN_3446 | 17877 |
| GTCN_105 | 7691 | CTCN_3020 | 17878 |
| TTCN_210 | 7692 | TTCN_3447 | 17879 |
| TTCN_211 | 7693 | ATCN_2125 | 17880 |
| CTCN_164 | 7694 | TTCN_3448 | 17881 |
| GTCN_106 | 7695 | TTCN_3449 | 17882 |
| TTCN_212 | 7696 | ATCN_2126 | 17883 |
| TTCN_213 | 7697 | GTCN_1779 | 17884 |
| CTCN_165 | 7698 | CTCN_3021 | 17885 |
| TTCN_214 | 7699 | TTCN_3450 | 17886 |
| TTCN_215 | 7700 | CTCN_3022 | 17887 |
| TTCN_216 | 7701 | GTCN_1780 | 17888 |
| CTCN_166 | 7702 | TTCN_3451 | 17889 |
| GTCN_107 | 7703 | ATCN_2127 | 17890 |
| CTCN_167 | 7704 | ATCN_2128 | 17891 |
| GTCN_108 | 7705 | TTCN_3452 | 17892 |
| CTCN_168 | 7706 | ATCN_2129 | 17893 |
| ATCN_126 | 7707 | CTCN_3023 | 17894 |
| TTCN_217 | 7708 | GTCN_1781 | 17895 |
| TTCN_218 | 7709 | TTCN_3453 | 17896 |
| ATCN_127 | 7710 | ATCN_2130 | 17897 |
| TTCN_219 | 7711 | ATCN_2131 | 17898 |
| GTCN_109 | 7712 | ATCN_2132 | 17899 |
| CTCN_169 | 7713 | ATCN_2133 | 17900 |
| TTCN_220 | 7714 | GTCN_1782 | 17901 |
| TTCN_221 | 7715 | GTCN_1783 | 17902 |
| CTCN_170 | 7716 | CTCN_3024 | 17903 |
| TTCN_222 | 7717 | ATCN_2134 | 17904 |
| TTCN_223 | 7718 | TTCN_3454 | 17905 |
| CTCN_171 | 7719 | TTCN_3455 | 17906 |
| TTCN_224 | 7720 | CTCN_3025 | 17907 |
| CTCN_172 | 7721 | CTCN_3026 | 17908 |
| CTCN_173 | 7722 | CTCN_3027 | 17909 |
| CTCN_174 | 7723 | GTCN_1784 | 17910 |
| CTCN_175 | 7724 | GTCN_1785 | 17911 |
| TTCN_225 | 7725 | TTCN_3456 | 17912 |
| GTCN_110 | 7726 | TTCN_3457 | 17913 |
| ATCN_128 | 7727 | GTCN_1786 | 17914 |
| ATCN_129 | 7728 | TTCN_3458 | 17915 |
| TTCN_226 | 7729 | TTCN_3459 | 17916 |
| ATCN_130 | 7730 | CTCN_3028 | 17917 |
| TTCN_227 | 7731 | CTCN_3029 | 17918 |
| GTCN_111 | 7732 | TTCN_3460 | 17919 |
| CTCN_176 | 7733 | TTCN_3461 | 17920 |
| TTCN_228 | 7734 | ATCN_2135 | 17921 |
| CTCN_177 | 7735 | TTCN_3462 | 17922 |
| CTCN_178 | 7736 | ATCN_2136 | 17923 |
| GTCN_112 | 7737 | CTCN_3030 | 17924 |
| CTCN_179 | 7738 | ATCN_2137 | 17925 |
| ATCN_131 | 7739 | CTCN_3031 | 17926 |
| ATCN_132 | 7740 | CTCN_3032 | 17927 |
| ATCN_133 | 7741 | CTCN_3033 | 17928 |

FIG. 36 (continued)

| | | | |
|---|---|---|---|
| CTCN_180 | 7742 | GTCN_1787 | 17929 |
| ATCN_134 | 7743 | ATCN_2138 | 17930 |
| CTCN_181 | 7744 | ATCN_2139 | 17931 |
| ATCN_135 | 7745 | GTCN_1788 | 17932 |
| TTCN_229 | 7746 | TTCN_3463 | 17933 |
| TTCN_230 | 7747 | CTCN_3034 | 17934 |
| TTCN_231 | 7748 | CTCN_3035 | 17935 |
| CTCN_182 | 7749 | CTCN_3036 | 17936 |
| GTCN_113 | 7750 | CTCN_3037 | 17937 |
| CTCN_183 | 7751 | TTCN_3464 | 17938 |
| CTCN_184 | 7752 | TTCN_3465 | 17939 |
| GTCN_114 | 7753 | ATCN_2140 | 17940 |
| CTCN_185 | 7754 | ATCN_2141 | 17941 |
| ATCN_136 | 7755 | TTCN_3466 | 17942 |
| CTCN_186 | 7756 | CTCN_3038 | 17943 |
| TTCN_232 | 7757 | TTCN_3467 | 17944 |
| CTCN_187 | 7758 | TTCN_3468 | 17945 |
| CTCN_188 | 7759 | TTCN_3469 | 17946 |
| GTCN_115 | 7760 | ATCN_2142 | 17947 |
| CTCN_189 | 7761 | TTCN_3470 | 17948 |
| CTCN_190 | 7762 | GTCN_1789 | 17949 |
| TTCN_233 | 7763 | CTCN_3039 | 17950 |
| CTCN_191 | 7764 | TTCN_3471 | 17951 |
| CTCN_192 | 7765 | ATCN_2143 | 17952 |
| ATCN_137 | 7766 | TTCN_3472 | 17953 |
| CTCN_193 | 7767 | TTCN_3473 | 17954 |
| CTCN_194 | 7768 | CTCN_3040 | 17955 |
| CTCN_195 | 7769 | CTCN_3041 | 17956 |
| GTCN_116 | 7770 | TTCN_3474 | 17957 |
| CTCN_196 | 7771 | ATCN_2144 | 17958 |
| GTCN_117 | 7772 | TTCN_3475 | 17959 |
| GTCN_118 | 7773 | TTCN_3476 | 17960 |
| ATCN_138 | 7774 | TTCN_3477 | 17961 |
| TTCN_234 | 7775 | CTCN_3042 | 17962 |
| TTCN_235 | 7776 | TTCN_3478 | 17963 |
| ATCN_139 | 7777 | CTCN_3043 | 17964 |
| CTCN_197 | 7778 | ATCN_2145 | 17965 |
| TTCN_236 | 7779 | CTCN_3044 | 17966 |
| CTCN_198 | 7780 | CTCN_3045 | 17967 |
| CTCN_199 | 7781 | CTCN_3046 | 17968 |
| ATCN_140 | 7782 | ATCN_2146 | 17969 |
| ATCN_141 | 7783 | ATCN_2147 | 17970 |
| TTCN_237 | 7784 | GTCN_1790 | 17971 |
| TTCN_238 | 7785 | CTCN_3047 | 17972 |
| ATCN_142 | 7786 | ATCN_2148 | 17973 |
| CTCN_200 | 7787 | ATCN_2149 | 17974 |
| GTCN_119 | 7788 | GTCN_1791 | 17975 |
| ATCN_143 | 7789 | ATCN_2150 | 17976 |
| TTCN_239 | 7790 | TTCN_3479 | 17977 |
| CTCN_201 | 7791 | ATCN_2151 | 17978 |
| GTCN_120 | 7792 | CTCN_3048 | 17979 |
| CTCN_202 | 7793 | ATCN_2152 | 17980 |
| ATCN_144 | 7794 | GTCN_1792 | 17981 |
| TTCN_240 | 7795 | CTCN_3049 | 17982 |
| GTCN_121 | 7796 | CTCN_3050 | 17983 |

| | | | |
|---|---|---|---|
| TTCN_241 | 7797 | CTCN_3051 | 17984 |
| TTCN_242 | 7798 | GTCN_1793 | 17985 |
| CTCN_203 | 7799 | CTCN_3052 | 17986 |
| GTCN_122 | 7800 | CTCN_3053 | 17987 |
| TTCN_243 | 7801 | TTCN_3480 | 17988 |
| ATCN_145 | 7802 | TTCN_3481 | 17989 |
| ATCN_146 | 7803 | CTCN_3054 | 17990 |
| GTCN_123 | 7804 | CTCN_3055 | 17991 |
| CTCN_204 | 7805 | ATCN_2153 | 17992 |
| TTCN_244 | 7806 | CTCN_3056 | 17993 |
| ATCN_147 | 7807 | CTCN_3057 | 17994 |
| GTCN_124 | 7808 | ATCN_2154 | 17995 |
| TTCN_245 | 7809 | ATCN_2155 | 17996 |
| TTCN_246 | 7810 | ATCN_2156 | 17997 |
| GTCN_125 | 7811 | CTCN_3058 | 17998 |
| TTCN_247 | 7812 | CTCN_3059 | 17999 |
| TTCN_248 | 7813 | GTCN_1794 | 18000 |
| TTCN_249 | 7814 | CTCN_3060 | 18001 |
| CTCN_205 | 7815 | TTCN_3482 | 18002 |
| TTCN_250 | 7816 | CTCN_3061 | 18003 |
| GTCN_126 | 7817 | TTCN_3483 | 18004 |
| GTCN_127 | 7818 | GTCN_1795 | 18005 |
| TTCN_251 | 7819 | CTCN_3062 | 18006 |
| TTCN_252 | 7820 | ATCN_2157 | 18007 |
| TTCN_253 | 7821 | ATCN_2158 | 18008 |
| GTCN_128 | 7822 | TTCN_3484 | 18009 |
| TTCN_254 | 7823 | CTCN_3063 | 18010 |
| GTCN_129 | 7824 | CTCN_3064 | 18011 |
| TTCN_255 | 7825 | ATCN_2159 | 18012 |
| TTCN_256 | 7826 | ATCN_2160 | 18013 |
| ATCN_148 | 7827 | TTCN_3485 | 18014 |
| ATCN_149 | 7828 | CTCN_3065 | 18015 |
| ATCN_150 | 7829 | GTCN_1796 | 18016 |
| ATCN_151 | 7830 | CTCN_3066 | 18017 |
| TTCN_257 | 7831 | GTCN_1797 | 18018 |
| GTCN_130 | 7832 | TTCN_3486 | 18019 |
| TTCN_258 | 7833 | CTCN_3067 | 18020 |
| TTCN_259 | 7834 | TTCN_3487 | 18021 |
| GTCN_131 | 7835 | ATCN_2161 | 18022 |
| TTCN_260 | 7836 | CTCN_3068 | 18023 |
| TTCN_261 | 7837 | TTCN_3488 | 18024 |
| CTCN_206 | 7838 | GTCN_1798 | 18025 |
| ATCN_152 | 7839 | TTCN_3489 | 18026 |
| TTCN_262 | 7840 | ATCN_2162 | 18027 |
| TTCN_263 | 7841 | CTCN_3069 | 18028 |
| ATCN_153 | 7842 | GTCN_1799 | 18029 |
| ATCN_154 | 7843 | ATCN_2163 | 18030 |
| CTCN_207 | 7844 | GTCN_1800 | 18031 |
| ATCN_155 | 7845 | ATCN_2164 | 18032 |
| TTCN_264 | 7846 | TTCN_3490 | 18033 |
| GTCN_132 | 7847 | CTCN_3070 | 18034 |
| CTCN_208 | 7848 | CTCN_3071 | 18035 |
| GTCN_133 | 7849 | ATCN_2165 | 18036 |
| CTCN_209 | 7850 | ATCN_2166 | 18037 |
| ATCN_156 | 7851 | CTCN_3072 | 18038 |

FIG. 36 (continued)

| | | | | | | | |
|---|---|---|---|---|---|---|---|
| GTCN_134 | 7852 | ATCN_2167 | 18039 | TTCN_284 | 7907 | ATCN_2181 | 18094 |
| TTCN_265 | 7853 | TTCN_3491 | 18040 | GTCN_143 | 7908 | ATCN_2182 | 18095 |
| TTCN_266 | 7854 | CTCN_3073 | 18041 | ATCN_170 | 7909 | CTCN_3084 | 18096 |
| GTCN_135 | 7855 | GTCN_1801 | 18042 | TTCN_285 | 7910 | TTCN_3509 | 18097 |
| ATCN_157 | 7856 | TTCN_3492 | 18043 | TTCN_286 | 7911 | CTCN_3085 | 18098 |
| GTCN_136 | 7857 | TTCN_3493 | 18044 | TTCN_287 | 7912 | CTCN_3086 | 18099 |
| TTCN_267 | 7858 | ATCN_2168 | 18045 | CTCN_224 | 7913 | TTCN_3510 | 18100 |
| TTCN_268 | 7859 | ATCN_2169 | 18046 | GTCN_144 | 7914 | TTCN_3511 | 18101 |
| CTCN_210 | 7860 | TTCN_3494 | 18047 | TTCN_288 | 7915 | TTCN_3512 | 18102 |
| ATCN_158 | 7861 | TTCN_3495 | 18048 | TTCN_289 | 7916 | TTCN_3513 | 18103 |
| CTCN_211 | 7862 | TTCN_3496 | 18049 | ATCN_171 | 7917 | GTCN_1813 | 18104 |
| ATCN_159 | 7863 | CTCN_3074 | 18050 | GTCN_145 | 7918 | TTCN_3514 | 18105 |
| ATCN_160 | 7864 | GTCN_1802 | 18051 | CTCN_225 | 7919 | TTCN_3515 | 18106 |
| GTCN_137 | 7865 | GTCN_1803 | 18052 | TTCN_290 | 7920 | ATCN_2183 | 18107 |
| ATCN_161 | 7866 | ATCN_2170 | 18053 | CTCN_226 | 7921 | ATCN_2184 | 18108 |
| TTCN_269 | 7867 | TTCN_3497 | 18054 | CTCN_227 | 7922 | TTCN_3516 | 18109 |
| TTCN_270 | 7868 | TTCN_3498 | 18055 | TTCN_291 | 7923 | ATCN_2185 | 18110 |
| ATCN_162 | 7869 | GTCN_1804 | 18056 | CTCN_228 | 7924 | ATCN_2186 | 18111 |
| ATCN_163 | 7870 | ATCN_2171 | 18057 | TTCN_292 | 7925 | ATCN_2187 | 18112 |
| GTCN_138 | 7871 | CTCN_3075 | 18058 | ATCN_172 | 7926 | TTCN_3517 | 18113 |
| ATCN_164 | 7872 | GTCN_1805 | 18059 | ATCN_173 | 7927 | GTCN_1814 | 18114 |
| CTCN_212 | 7873 | CTCN_3076 | 18060 | ATCN_174 | 7928 | CTCN_3087 | 18115 |
| ATCN_165 | 7874 | TTCN_3499 | 18061 | TTCN_293 | 7929 | TTCN_3518 | 18116 |
| CTCN_213 | 7875 | CTCN_3077 | 18062 | CTCN_229 | 7930 | ATCN_2188 | 18117 |
| CTCN_214 | 7876 | ATCN_2172 | 18063 | TTCN_294 | 7931 | GTCN_1815 | 18118 |
| ATCN_166 | 7877 | ATCN_2173 | 18064 | ATCN_175 | 7932 | TTCN_3519 | 18119 |
| GTCN_139 | 7878 | TTCN_3500 | 18065 | TTCN_295 | 7933 | TTCN_3520 | 18120 |
| TTCN_271 | 7879 | GTCN_1806 | 18066 | TTCN_296 | 7934 | CTCN_3088 | 18121 |
| CTCN_215 | 7880 | GTCN_1807 | 18067 | ATCN_176 | 7935 | TTCN_3521 | 18122 |
| TTCN_272 | 7881 | CTCN_3078 | 18068 | ATCN_177 | 7936 | TTCN_3522 | 18123 |
| GTCN_140 | 7882 | GTCN_1808 | 18069 | TTCN_297 | 7937 | TTCN_3523 | 18124 |
| CTCN_216 | 7883 | TTCN_3501 | 18070 | TTCN_298 | 7938 | TTCN_3524 | 18125 |
| GTCN_141 | 7884 | TTCN_3502 | 18071 | ATCN_178 | 7939 | CTCN_3089 | 18126 |
| CTCN_217 | 7885 | GTCN_1809 | 18072 | TTCN_299 | 7940 | TTCN_3525 | 18127 |
| GTCN_142 | 7886 | ATCN_2174 | 18073 | ATCN_179 | 7941 | ATCN_2189 | 18128 |
| ATCN_167 | 7887 | ATCN_2175 | 18074 | TTCN_300 | 7942 | ATCN_2190 | 18129 |
| CTCN_218 | 7888 | GTCN_1810 | 18075 | TTCN_301 | 7943 | CTCN_3090 | 18130 |
| TTCN_273 | 7889 | GTCN_1811 | 18076 | TTCN_302 | 7944 | ATCN_2191 | 18131 |
| TTCN_274 | 7890 | CTCN_3079 | 18077 | CTCN_230 | 7945 | GTCN_1816 | 18132 |
| CTCN_219 | 7891 | ATCN_2176 | 18078 | TTCN_303 | 7946 | TTCN_3526 | 18133 |
| CTCN_220 | 7892 | TTCN_3503 | 18079 | GTCN_146 | 7947 | TTCN_3527 | 18134 |
| CTCN_221 | 7893 | CTCN_3080 | 18080 | GTCN_147 | 7948 | CTCN_3091 | 18135 |
| TTCN_275 | 7894 | ATCN_2177 | 18081 | CTCN_231 | 7949 | CTCN_3092 | 18136 |
| CTCN_222 | 7895 | CTCN_3081 | 18082 | TTCN_304 | 7950 | GTCN_1817 | 18137 |
| ATCN_168 | 7896 | TTCN_3504 | 18083 | TTCN_305 | 7951 | CTCN_3093 | 18138 |
| TTCN_276 | 7897 | GTCN_1812 | 18084 | TTCN_306 | 7952 | CTCN_3094 | 18139 |
| ATCN_169 | 7898 | CTCN_3082 | 18085 | TTCN_307 | 7953 | CTCN_3095 | 18140 |
| TTCN_277 | 7899 | TTCN_3505 | 18086 | TTCN_308 | 7954 | TTCN_3528 | 18141 |
| TTCN_278 | 7900 | TTCN_3506 | 18087 | TTCN_309 | 7955 | CTCN_3096 | 18142 |
| TTCN_279 | 7901 | ATCN_2178 | 18088 | ATCN_180 | 7956 | CTCN_3097 | 18143 |
| TTCN_280 | 7902 | TTCN_3507 | 18089 | GTCN_148 | 7957 | CTCN_3098 | 18144 |
| CTCN_223 | 7903 | CTCN_3083 | 18090 | TTCN_310 | 7958 | CTCN_3099 | 18145 |
| TTCN_281 | 7904 | TTCN_3508 | 18091 | TTCN_311 | 7959 | GTCN_1818 | 18146 |
| TTCN_282 | 7905 | ATCN_2179 | 18092 | TTCN_312 | 7960 | ATCN_2192 | 18147 |
| TTCN_283 | 7906 | ATCN_2180 | 18093 | ATCN_181 | 7961 | CTCN_3100 | 18148 |

FIG. 36 (continued)

| | | | |
|---|---|---|---|
| ATCN_182 | 7962 | CTCN_3101 | 18149 |
| TTCN_313 | 7963 | CTCN_3102 | 18150 |
| CTCN_232 | 7964 | TTCN_3529 | 18151 |
| GTCN_149 | 7965 | ATCN_2193 | 18152 |
| ATCN_183 | 7966 | TTCN_3530 | 18153 |
| TTCN_314 | 7967 | CTCN_3103 | 18154 |
| ATCN_184 | 7968 | GTCN_1819 | 18155 |
| GTCN_150 | 7969 | TTCN_3531 | 18156 |
| GTCN_151 | 7970 | CTCN_3104 | 18157 |
| ATCN_185 | 7971 | TTCN_3532 | 18158 |
| TTCN_315 | 7972 | CTCN_3105 | 18159 |
| TTCN_316 | 7973 | TTCN_3533 | 18160 |
| CTCN_233 | 7974 | TTCN_3534 | 18161 |
| TTCN_317 | 7975 | CTCN_3106 | 18162 |
| TTCN_318 | 7976 | GTCN_1820 | 18163 |
| ATCN_186 | 7977 | TTCN_3535 | 18164 |
| ATCN_187 | 7978 | ATCN_2194 | 18165 |
| CTCN_234 | 7979 | CTCN_3107 | 18166 |
| CTCN_235 | 7980 | CTCN_3108 | 18167 |
| CTCN_236 | 7981 | GTCN_1821 | 18168 |
| TTCN_319 | 7982 | CTCN_3109 | 18169 |
| GTCN_152 | 7983 | GTCN_1822 | 18170 |
| GTCN_153 | 7984 | GTCN_1823 | 18171 |
| TTCN_320 | 7985 | TTCN_3536 | 18172 |
| TTCN_321 | 7986 | ATCN_2195 | 18173 |
| GTCN_154 | 7987 | TTCN_3537 | 18174 |
| TTCN_322 | 7988 | GTCN_1824 | 18175 |
| TTCN_323 | 7989 | GTCN_1825 | 18176 |
| TTCN_324 | 7990 | ATCN_2196 | 18177 |
| TTCN_325 | 7991 | TTCN_3538 | 18178 |
| GTCN_155 | 7992 | TTCN_3539 | 18179 |
| TTCN_326 | 7993 | ATCN_2197 | 18180 |
| TTCN_327 | 7994 | GTCN_1826 | 18181 |
| ATCN_188 | 7995 | ATCN_2198 | 18182 |
| ATCN_189 | 7996 | ATCN_2199 | 18183 |
| ATCN_190 | 7997 | CTCN_3110 | 18184 |
| CTCN_237 | 7998 | TTCN_3540 | 18185 |
| ATCN_191 | 7999 | TTCN_3541 | 18186 |
| GTCN_156 | 8000 | TTCN_3542 | 18187 |
| CTCN_238 | 8001 | GTCN_1827 | 18188 |
| TTCN_328 | 8002 | ATCN_2200 | 18189 |
| GTCN_157 | 8003 | ATCN_2201 | 18190 |
| GTCN_158 | 8004 | TTCN_3543 | 18191 |
| TTCN_329 | 8005 | TTCN_3544 | 18192 |
| TTCN_330 | 8006 | TTCN_3545 | 18193 |
| CTCN_239 | 8007 | CTCN_3111 | 18194 |
| ATCN_192 | 8008 | TTCN_3546 | 18195 |
| ATCN_193 | 8009 | GTCN_1828 | 18196 |
| TTCN_331 | 8010 | TTCN_3547 | 18197 |
| ATCN_194 | 8011 | ATCN_2202 | 18198 |
| ATCN_195 | 8012 | ATCN_2203 | 18199 |
| ATCN_196 | 8013 | ATCN_2204 | 18200 |
| TTCN_332 | 8014 | ATCN_2205 | 18201 |
| TTCN_333 | 8015 | ATCN_2206 | 18202 |
| GTCN_159 | 8016 | TTCN_3548 | 18203 |

| | | | |
|---|---|---|---|
| TTCN_334 | 8017 | TTCN_3549 | 18204 |
| ATCN_197 | 8018 | ATCN_2207 | 18205 |
| TTCN_335 | 8019 | GTCN_1829 | 18206 |
| ATCN_198 | 8020 | CTCN_3112 | 18207 |
| CTCN_240 | 8021 | CTCN_3113 | 18208 |
| CTCN_241 | 8022 | GTCN_1830 | 18209 |
| TTCN_336 | 8023 | CTCN_3114 | 18210 |
| GTCN_160 | 8024 | GTCN_1831 | 18211 |
| TTCN_337 | 8025 | GTCN_1832 | 18212 |
| TTCN_338 | 8026 | CTCN_3115 | 18213 |
| CTCN_242 | 8027 | CTCN_3116 | 18214 |
| GTCN_161 | 8028 | ATCN_2208 | 18215 |
| TTCN_339 | 8029 | TTCN_3550 | 18216 |
| CTCN_243 | 8030 | GTCN_1833 | 18217 |
| TTCN_340 | 8031 | ATCN_2209 | 18218 |
| ATCN_199 | 8032 | TTCN_3551 | 18219 |
| ATCN_200 | 8033 | TTCN_3552 | 18220 |
| CTCN_244 | 8034 | ATCN_2210 | 18221 |
| ATCN_201 | 8035 | CTCN_3117 | 18222 |
| TTCN_341 | 8036 | CTCN_3118 | 18223 |
| GTCN_162 | 8037 | TTCN_3553 | 18224 |
| CTCN_245 | 8038 | CTCN_3119 | 18225 |
| ATCN_202 | 8039 | CTCN_3120 | 18226 |
| GTCN_163 | 8040 | GTCN_1834 | 18227 |
| TTCN_342 | 8041 | TTCN_3554 | 18228 |
| TTCN_343 | 8042 | TTCN_3555 | 18229 |
| GTCN_164 | 8043 | GTCN_1835 | 18230 |
| GTCN_165 | 8044 | GTCN_1836 | 18231 |
| TTCN_344 | 8045 | TTCN_3556 | 18232 |
| TTCN_345 | 8046 | TTCN_3557 | 18233 |
| TTCN_346 | 8047 | TTCN_3558 | 18234 |
| ATCN_203 | 8048 | GTCN_1837 | 18235 |
| TTCN_347 | 8049 | GTCN_1838 | 18236 |
| ATCN_204 | 8050 | ATCN_2211 | 18237 |
| CTCN_246 | 8051 | GTCN_1839 | 18238 |
| GTCN_166 | 8052 | CTCN_3121 | 18239 |
| ATCN_205 | 8053 | CTCN_3122 | 18240 |
| TTCN_348 | 8054 | TTCN_3559 | 18241 |
| ATCN_206 | 8055 | TTCN_3560 | 18242 |
| CTCN_247 | 8056 | TTCN_3561 | 18243 |
| ATCN_207 | 8057 | TTCN_3562 | 18244 |
| ATCN_208 | 8058 | TTCN_3563 | 18245 |
| GTCN_167 | 8059 | GTCN_1840 | 18246 |
| ATCN_209 | 8060 | TTCN_3564 | 18247 |
| CTCN_248 | 8061 | CTCN_3123 | 18248 |
| CTCN_249 | 8062 | GTCN_1841 | 18249 |
| TTCN_349 | 8063 | GTCN_1842 | 18250 |
| GTCN_168 | 8064 | CTCN_3124 | 18251 |
| TTCN_350 | 8065 | ATCN_2212 | 18252 |
| ATCN_210 | 8066 | ATCN_2213 | 18253 |
| TTCN_351 | 8067 | TTCN_3565 | 18254 |
| TTCN_352 | 8068 | CTCN_3125 | 18255 |
| GTCN_169 | 8069 | GTCN_1843 | 18256 |
| TTCN_353 | 8070 | GTCN_1844 | 18257 |
| TTCN_354 | 8071 | GTCN_1845 | 18258 |

FIG. 36 (continued)

| | | | |
|---|---|---|---|
| GTCN_170 | 8072 | CTCN_3126 | 18259 |
| CTCN_250 | 8073 | CTCN_3127 | 18260 |
| GTCN_171 | 8074 | GTCN_1846 | 18261 |
| TTCN_355 | 8075 | CTCN_3128 | 18262 |
| TTCN_356 | 8076 | TTCN_3566 | 18263 |
| GTCN_172 | 8077 | TTCN_3567 | 18264 |
| ATCN_211 | 8078 | CTCN_3129 | 18265 |
| TTCN_357 | 8079 | ATCN_2214 | 18266 |
| TTCN_358 | 8080 | ATCN_2215 | 18267 |
| TTCN_359 | 8081 | ATCN_2216 | 18268 |
| CTCN_251 | 8082 | CTCN_3130 | 18269 |
| CTCN_252 | 8083 | ATCN_2217 | 18270 |
| ATCN_212 | 8084 | ATCN_2218 | 18271 |
| TTCN_360 | 8085 | TTCN_3568 | 18272 |
| TTCN_361 | 8086 | GTCN_1847 | 18273 |
| GTCN_173 | 8087 | CTCN_3131 | 18274 |
| TTCN_362 | 8088 | CTCN_3132 | 18275 |
| GTCN_174 | 8089 | CTCN_3133 | 18276 |
| ATCN_213 | 8090 | CTCN_3134 | 18277 |
| CTCN_253 | 8091 | GTCN_1848 | 18278 |
| GTCN_175 | 8092 | ATCN_2219 | 18279 |
| CTCN_254 | 8093 | GTCN_1849 | 18280 |
| TTCN_363 | 8094 | ATCN_2220 | 18281 |
| CTCN_255 | 8095 | ATCN_2221 | 18282 |
| GTCN_176 | 8096 | CTCN_3135 | 18283 |
| CTCN_256 | 8097 | TTCN_3569 | 18284 |
| CTCN_257 | 8098 | GTCN_1850 | 18285 |
| ATCN_214 | 8099 | GTCN_1851 | 18286 |
| CTCN_258 | 8100 | TTCN_3570 | 18287 |
| CTCN_259 | 8101 | TTCN_3571 | 18288 |
| TTCN_364 | 8102 | TTCN_3572 | 18289 |
| TTCN_365 | 8103 | CTCN_3136 | 18290 |
| GTCN_177 | 8104 | ATCN_2222 | 18291 |
| TTCN_366 | 8105 | GTCN_1852 | 18292 |
| ATCN_215 | 8106 | CTCN_3137 | 18293 |
| ATCN_216 | 8107 | CTCN_3138 | 18294 |
| TTCN_367 | 8108 | TTCN_3573 | 18295 |
| TTCN_368 | 8109 | TTCN_3574 | 18296 |
| TTCN_369 | 8110 | ATCN_2223 | 18297 |
| CTCN_260 | 8111 | CTCN_3139 | 18298 |
| TTCN_370 | 8112 | CTCN_3140 | 18299 |
| ATCN_217 | 8113 | CTCN_3141 | 18300 |
| TTCN_371 | 8114 | ATCN_2224 | 18301 |
| TTCN_372 | 8115 | GTCN_1853 | 18302 |
| ATCN_218 | 8116 | CTCN_3142 | 18303 |
| CTCN_261 | 8117 | CTCN_3143 | 18304 |
| GTCN_178 | 8118 | CTCN_3144 | 18305 |
| ATCN_219 | 8119 | GTCN_1854 | 18306 |
| ATCN_220 | 8120 | CTCN_3145 | 18307 |
| TTCN_373 | 8121 | CTCN_3146 | 18308 |
| TTCN_374 | 8122 | CTCN_3147 | 18309 |
| CTCN_262 | 8123 | GTCN_1855 | 18310 |
| TTCN_375 | 8124 | CTCN_3148 | 18311 |
| CTCN_263 | 8125 | CTCN_3149 | 18312 |
| CTCN_264 | 8126 | ATCN_2225 | 18313 |

| | | | |
|---|---|---|---|
| TTCN_376 | 8127 | ATCN_2226 | 18314 |
| CTCN_265 | 8128 | TTCN_3575 | 18315 |
| TTCN_377 | 8129 | ATCN_2227 | 18316 |
| TTCN_378 | 8130 | ATCN_2228 | 18317 |
| CTCN_266 | 8131 | ATCN_2229 | 18318 |
| TTCN_379 | 8132 | GTCN_1856 | 18319 |
| TTCN_380 | 8133 | CTCN_3150 | 18320 |
| ATCN_221 | 8134 | CTCN_3151 | 18321 |
| GTCN_179 | 8135 | GTCN_1857 | 18322 |
| CTCN_267 | 8136 | TTCN_3576 | 18323 |
| TTCN_381 | 8137 | ATCN_2230 | 18324 |
| GTCN_180 | 8138 | GTCN_1858 | 18325 |
| GTCN_181 | 8139 | CTCN_3152 | 18326 |
| TTCN_382 | 8140 | TTCN_3577 | 18327 |
| CTCN_268 | 8141 | ATCN_2231 | 18328 |
| GTCN_182 | 8142 | CTCN_3153 | 18329 |
| TTCN_383 | 8143 | CTCN_3154 | 18330 |
| TTCN_384 | 8144 | CTCN_3155 | 18331 |
| TTCN_385 | 8145 | TTCN_3578 | 18332 |
| TTCN_386 | 8146 | TTCN_3579 | 18333 |
| ATCN_222 | 8147 | TTCN_3580 | 18334 |
| CTCN_269 | 8148 | ATCN_2232 | 18335 |
| TTCN_387 | 8149 | TTCN_3581 | 18336 |
| ATCN_223 | 8150 | CTCN_3156 | 18337 |
| TTCN_388 | 8151 | CTCN_3157 | 18338 |
| TTCN_389 | 8152 | ATCN_2233 | 18339 |
| TTCN_390 | 8153 | CTCN_3158 | 18340 |
| TTCN_391 | 8154 | CTCN_3159 | 18341 |
| TTCN_392 | 8155 | TTCN_3582 | 18342 |
| CTCN_270 | 8156 | CTCN_3160 | 18343 |
| TTCN_393 | 8157 | CTCN_3161 | 18344 |
| ATCN_224 | 8158 | CTCN_3162 | 18345 |
| TTCN_394 | 8159 | GTCN_1859 | 18346 |
| CTCN_271 | 8160 | TTCN_3583 | 18347 |
| GTCN_183 | 8161 | TTCN_3584 | 18348 |
| GTCN_184 | 8162 | CTCN_3163 | 18349 |
| TTCN_395 | 8163 | CTCN_3164 | 18350 |
| CTCN_272 | 8164 | GTCN_1860 | 18351 |
| TTCN_396 | 8165 | ATCN_2234 | 18352 |
| CTCN_273 | 8166 | TTCN_3585 | 18353 |
| CTCN_274 | 8167 | TTCN_3586 | 18354 |
| TTCN_397 | 8168 | TTCN_3587 | 18355 |
| TTCN_398 | 8169 | CTCN_3165 | 18356 |
| ATCN_225 | 8170 | GTCN_1861 | 18357 |
| CTCN_275 | 8171 | CTCN_3166 | 18358 |
| TTCN_399 | 8172 | TTCN_3588 | 18359 |
| TTCN_400 | 8173 | CTCN_3167 | 18360 |
| ATCN_226 | 8174 | CTCN_3168 | 18361 |
| TTCN_401 | 8175 | TTCN_3589 | 18362 |
| TTCN_402 | 8176 | CTCN_3169 | 18363 |
| ATCN_227 | 8177 | TTCN_3590 | 18364 |
| GTCN_185 | 8178 | ATCN_2235 | 18365 |
| TTCN_403 | 8179 | GTCN_1862 | 18366 |
| GTCN_186 | 8180 | CTCN_3170 | 18367 |
| ATCN_228 | 8181 | GTCN_1863 | 18368 |

FIG. 36 (continued)

| | | | |
|---|---|---|---|
| CTCN_276 | 8182 | CTCN_3171 | 18369 |
| TTCN_404 | 8183 | CTCN_3172 | 18370 |
| TTCN_405 | 8184 | ATCN_2236 | 18371 |
| ATCN_229 | 8185 | TTCN_3591 | 18372 |
| GTCN_187 | 8186 | GTCN_1864 | 18373 |
| ATCN_230 | 8187 | CTCN_3173 | 18374 |
| CTCN_277 | 8188 | ATCN_2237 | 18375 |
| GTCN_188 | 8189 | CTCN_3174 | 18376 |
| TTCN_406 | 8190 | TTCN_3592 | 18377 |
| ATCN_231 | 8191 | CTCN_3175 | 18378 |
| ATCN_232 | 8192 | CTCN_3176 | 18379 |
| ATCN_233 | 8193 | TTCN_3593 | 18380 |
| ATCN_234 | 8194 | TTCN_3594 | 18381 |
| GTCN_189 | 8195 | CTCN_3177 | 18382 |
| TTCN_407 | 8196 | TTCN_3595 | 18383 |
| TTCN_408 | 8197 | CTCN_3178 | 18384 |
| TTCN_409 | 8198 | TTCN_3596 | 18385 |
| CTCN_278 | 8199 | ATCN_2238 | 18386 |
| ATCN_235 | 8200 | CTCN_3179 | 18387 |
| ATCN_236 | 8201 | TTCN_3597 | 18388 |
| GTCN_190 | 8202 | TTCN_3598 | 18389 |
| TTCN_410 | 8203 | TTCN_3599 | 18390 |
| GTCN_191 | 8204 | CTCN_3180 | 18391 |
| TTCN_411 | 8205 | ATCN_2239 | 18392 |
| TTCN_412 | 8206 | CTCN_3181 | 18393 |
| TTCN_413 | 8207 | GTCN_1865 | 18394 |
| GTCN_192 | 8208 | CTCN_3182 | 18395 |
| CTCN_279 | 8209 | ATCN_2240 | 18396 |
| TTCN_414 | 8210 | CTCN_3183 | 18397 |
| CTCN_280 | 8211 | GTCN_1866 | 18398 |
| TTCN_415 | 8212 | TTCN_3600 | 18399 |
| TTCN_416 | 8213 | ATCN_2241 | 18400 |
| ATCN_237 | 8214 | TTCN_3601 | 18401 |
| CTCN_281 | 8215 | CTCN_3184 | 18402 |
| TTCN_417 | 8216 | ATCN_2242 | 18403 |
| GTCN_193 | 8217 | CTCN_3185 | 18404 |
| TTCN_418 | 8218 | CTCN_3186 | 18405 |
| ATCN_238 | 8219 | CTCN_3187 | 18406 |
| TTCN_419 | 8220 | ATCN_2243 | 18407 |
| GTCN_194 | 8221 | CTCN_3188 | 18408 |
| GTCN_195 | 8222 | ATCN_2244 | 18409 |
| GTCN_196 | 8223 | ATCN_2245 | 18410 |
| CTCN_282 | 8224 | TTCN_3602 | 18411 |
| CTCN_283 | 8225 | CTCN_3189 | 18412 |
| ATCN_239 | 8226 | TTCN_3603 | 18413 |
| TTCN_420 | 8227 | CTCN_3190 | 18414 |
| ATCN_240 | 8228 | GTCN_1867 | 18415 |
| TTCN_421 | 8229 | CTCN_3191 | 18416 |
| GTCN_197 | 8230 | ATCN_2246 | 18417 |
| TTCN_422 | 8231 | TTCN_3604 | 18418 |
| TTCN_423 | 8232 | ATCN_2247 | 18419 |
| TTCN_424 | 8233 | TTCN_3605 | 18420 |
| TTCN_425 | 8234 | CTCN_3192 | 18421 |
| GTCN_198 | 8235 | CTCN_3193 | 18422 |
| TTCN_426 | 8236 | TTCN_3606 | 18423 |

| | | | |
|---|---|---|---|
| TTCN_427 | 8237 | TTCN_3607 | 18424 |
| CTCN_284 | 8238 | ATCN_2248 | 18425 |
| CTCN_285 | 8239 | ATCN_2249 | 18426 |
| CTCN_286 | 8240 | TTCN_3608 | 18427 |
| ATCN_241 | 8241 | TTCN_3609 | 18428 |
| TTCN_428 | 8242 | TTCN_3610 | 18429 |
| CTCN_287 | 8243 | CTCN_3194 | 18430 |
| CTCN_288 | 8244 | TTCN_3611 | 18431 |
| TTCN_429 | 8245 | TTCN_3612 | 18432 |
| ATCN_242 | 8246 | TTCN_3613 | 18433 |
| CTCN_289 | 8247 | ATCN_2250 | 18434 |
| ATCN_243 | 8248 | CTCN_3195 | 18435 |
| CTCN_290 | 8249 | ATCN_2251 | 18436 |
| CTCN_291 | 8250 | ATCN_2252 | 18437 |
| ATCN_244 | 8251 | GTCN_1868 | 18438 |
| ATCN_245 | 8252 | CTCN_3196 | 18439 |
| CTCN_292 | 8253 | GTCN_1869 | 18440 |
| CTCN_293 | 8254 | GTCN_1870 | 18441 |
| TTCN_430 | 8255 | ATCN_2253 | 18442 |
| TTCN_431 | 8256 | CTCN_3197 | 18443 |
| ATCN_246 | 8257 | TTCN_3614 | 18444 |
| TTCN_432 | 8258 | ATCN_2254 | 18445 |
| TTCN_433 | 8259 | TTCN_3615 | 18446 |
| TTCN_434 | 8260 | CTCN_3198 | 18447 |
| CTCN_294 | 8261 | GTCN_1871 | 18448 |
| CTCN_295 | 8262 | GTCN_1872 | 18449 |
| CTCN_296 | 8263 | CTCN_3199 | 18450 |
| CTCN_297 | 8264 | GTCN_1873 | 18451 |
| CTCN_298 | 8265 | ATCN_2255 | 18452 |
| CTCN_299 | 8266 | ATCN_2256 | 18453 |
| TTCN_435 | 8267 | GTCN_1874 | 18454 |
| GTCN_199 | 8268 | CTCN_3200 | 18455 |
| TTCN_436 | 8269 | CTCN_3201 | 18456 |
| CTCN_300 | 8270 | TTCN_3616 | 18457 |
| CTCN_301 | 8271 | CTCN_3202 | 18458 |
| CTCN_302 | 8272 | ATCN_2257 | 18459 |
| GTCN_200 | 8273 | ATCN_2258 | 18460 |
| CTCN_303 | 8274 | GTCN_1875 | 18461 |
| TTCN_437 | 8275 | ATCN_2259 | 18462 |
| CTCN_304 | 8276 | ATCN_2260 | 18463 |
| ATCN_247 | 8277 | CTCN_3203 | 18464 |
| CTCN_305 | 8278 | GTCN_1876 | 18465 |
| GTCN_201 | 8279 | ATCN_2261 | 18466 |
| CTCN_306 | 8280 | ATCN_2262 | 18467 |
| TTCN_438 | 8281 | TTCN_3617 | 18468 |
| TTCN_439 | 8282 | GTCN_1877 | 18469 |
| CTCN_307 | 8283 | CTCN_3204 | 18470 |
| CTCN_308 | 8284 | CTCN_3205 | 18471 |
| CTCN_309 | 8285 | GTCN_1878 | 18472 |
| TTCN_440 | 8286 | CTCN_3206 | 18473 |
| CTCN_310 | 8287 | ATCN_2263 | 18474 |
| CTCN_311 | 8288 | GTCN_1879 | 18475 |
| CTCN_312 | 8289 | GTCN_1880 | 18476 |
| CTCN_313 | 8290 | GTCN_1881 | 18477 |
| TTCN_441 | 8291 | TTCN_3618 | 18478 |

FIG. 36 (continued)

| | | | |
|---|---|---|---|
| TTCN_442 | 8292 | ATCN_2264 | 18479 |
| ATCN_248 | 8293 | ATCN_2265 | 18480 |
| ATCN_249 | 8294 | TTCN_3619 | 18481 |
| TTCN_443 | 8295 | CTCN_3207 | 18482 |
| CTCN_314 | 8296 | GTCN_1882 | 18483 |
| TTCN_444 | 8297 | ATCN_2266 | 18484 |
| ATCN_250 | 8298 | TTCN_3620 | 18485 |
| CTCN_315 | 8299 | ATCN_2267 | 18486 |
| CTCN_316 | 8300 | ATCN_2268 | 18487 |
| CTCN_317 | 8301 | GTCN_1883 | 18488 |
| CTCN_318 | 8302 | GTCN_1884 | 18489 |
| TTCN_445 | 8303 | CTCN_3208 | 18490 |
| CTCN_319 | 8304 | GTCN_1885 | 18491 |
| GTCN_202 | 8305 | GTCN_1886 | 18492 |
| TTCN_446 | 8306 | TTCN_3621 | 18493 |
| TTCN_447 | 8307 | CTCN_3209 | 18494 |
| TTCN_448 | 8308 | CTCN_3210 | 18495 |
| GTCN_203 | 8309 | ATCN_2269 | 18496 |
| TTCN_449 | 8310 | GTCN_1887 | 18497 |
| CTCN_320 | 8311 | TTCN_3622 | 18498 |
| CTCN_321 | 8312 | TTCN_3623 | 18499 |
| CTCN_322 | 8313 | TTCN_3624 | 18500 |
| TTCN_450 | 8314 | GTCN_1888 | 18501 |
| TTCN_451 | 8315 | TTCN_3625 | 18502 |
| GTCN_204 | 8316 | TTCN_3626 | 18503 |
| GTCN_205 | 8317 | TTCN_3627 | 18504 |
| TTCN_452 | 8318 | TTCN_3628 | 18505 |
| ATCN_251 | 8319 | TTCN_3629 | 18506 |
| GTCN_206 | 8320 | TTCN_3630 | 18507 |
| GTCN_207 | 8321 | TTCN_3631 | 18508 |
| GTCN_208 | 8322 | CTCN_3211 | 18509 |
| CTCN_323 | 8323 | CTCN_3212 | 18510 |
| ATCN_252 | 8324 | GTCN_1889 | 18511 |
| TTCN_453 | 8325 | ATCN_2270 | 18512 |
| CTCN_324 | 8326 | GTCN_1890 | 18513 |
| TTCN_454 | 8327 | CTCN_3213 | 18514 |
| GTCN_209 | 8328 | CTCN_3214 | 18515 |
| GTCN_210 | 8329 | ATCN_2271 | 18516 |
| TTCN_455 | 8330 | GTCN_1891 | 18517 |
| TTCN_456 | 8331 | CTCN_3215 | 18518 |
| CTCN_325 | 8332 | ATCN_2272 | 18519 |
| TTCN_457 | 8333 | CTCN_3216 | 18520 |
| ATCN_253 | 8334 | TTCN_3632 | 18521 |
| GTCN_211 | 8335 | CTCN_3217 | 18522 |
| GTCN_212 | 8336 | TTCN_3633 | 18523 |
| GTCN_213 | 8337 | GTCN_1892 | 18524 |
| CTCN_326 | 8338 | CTCN_3218 | 18525 |
| CTCN_327 | 8339 | TTCN_3634 | 18526 |
| CTCN_328 | 8340 | GTCN_1893 | 18527 |
| CTCN_329 | 8341 | TTCN_3635 | 18528 |
| GTCN_214 | 8342 | ATCN_2273 | 18529 |
| TTCN_458 | 8343 | TTCN_3636 | 18530 |
| ATCN_254 | 8344 | CTCN_3219 | 18531 |
| GTCN_215 | 8345 | TTCN_3637 | 18532 |
| TTCN_459 | 8346 | CTCN_3220 | 18533 |

| | | | |
|---|---|---|---|
| GTCN_216 | 8347 | CTCN_3221 | 18534 |
| CTCN_330 | 8348 | CTCN_3222 | 18535 |
| CTCN_331 | 8349 | GTCN_1894 | 18536 |
| ATCN_255 | 8350 | CTCN_3223 | 18537 |
| ATCN_256 | 8351 | CTCN_3224 | 18538 |
| TTCN_460 | 8352 | CTCN_3225 | 18539 |
| TTCN_461 | 8353 | TTCN_3638 | 18540 |
| GTCN_217 | 8354 | CTCN_3226 | 18541 |
| TTCN_462 | 8355 | GTCN_1895 | 18542 |
| TTCN_463 | 8356 | CTCN_3227 | 18543 |
| TTCN_464 | 8357 | TTCN_3639 | 18544 |
| GTCN_218 | 8358 | CTCN_3228 | 18545 |
| CTCN_332 | 8359 | TTCN_3640 | 18546 |
| ATCN_257 | 8360 | TTCN_3641 | 18547 |
| TTCN_465 | 8361 | CTCN_3229 | 18548 |
| ATCN_258 | 8362 | CTCN_3230 | 18549 |
| ATCN_259 | 8363 | CTCN_3231 | 18550 |
| ATCN_260 | 8364 | TTCN_3642 | 18551 |
| GTCN_219 | 8365 | CTCN_3232 | 18552 |
| TTCN_466 | 8366 | GTCN_1896 | 18553 |
| TTCN_467 | 8367 | ATCN_2274 | 18554 |
| ATCN_261 | 8368 | TTCN_3643 | 18555 |
| ATCN_262 | 8369 | CTCN_3233 | 18556 |
| TTCN_468 | 8370 | GTCN_1897 | 18557 |
| ATCN_263 | 8371 | GTCN_1898 | 18558 |
| ATCN_264 | 8372 | CTCN_3234 | 18559 |
| TTCN_469 | 8373 | GTCN_1899 | 18560 |
| GTCN_220 | 8374 | CTCN_3235 | 18561 |
| CTCN_333 | 8375 | ATCN_2275 | 18562 |
| CTCN_334 | 8376 | ATCN_2276 | 18563 |
| CTCN_335 | 8377 | TTCN_3644 | 18564 |
| GTCN_221 | 8378 | TTCN_3645 | 18565 |
| GTCN_222 | 8379 | CTCN_3236 | 18566 |
| TTCN_470 | 8380 | TTCN_3646 | 18567 |
| CTCN_336 | 8381 | GTCN_1900 | 18568 |
| GTCN_223 | 8382 | ATCN_2277 | 18569 |
| GTCN_224 | 8383 | CTCN_3237 | 18570 |
| TTCN_471 | 8384 | CTCN_3238 | 18571 |
| GTCN_225 | 8385 | TTCN_3647 | 18572 |
| CTCN_337 | 8386 | TTCN_3648 | 18573 |
| TTCN_472 | 8387 | CTCN_3239 | 18574 |
| TTCN_473 | 8388 | ATCN_2278 | 18575 |
| TTCN_474 | 8389 | GTCN_1901 | 18576 |
| CTCN_338 | 8390 | TTCN_3649 | 18577 |
| TTCN_475 | 8391 | GTCN_1902 | 18578 |
| TTCN_476 | 8392 | TTCN_3650 | 18579 |
| TTCN_477 | 8393 | ATCN_2279 | 18580 |
| TTCN_478 | 8394 | TTCN_3651 | 18581 |
| ATCN_265 | 8395 | CTCN_3240 | 18582 |
| ATCN_266 | 8396 | CTCN_3241 | 18583 |
| TTCN_479 | 8397 | TTCN_3652 | 18584 |
| TTCN_480 | 8398 | TTCN_3653 | 18585 |
| ATCN_267 | 8399 | GTCN_1903 | 18586 |
| CTCN_339 | 8400 | GTCN_1904 | 18587 |
| ATCN_268 | 8401 | TTCN_3654 | 18588 |

FIG. 36 (continued)

| | | | |
|---|---|---|---|
| CTCN_340 | 8402 | CTCN_3242 | 18589 |
| GTCN_226 | 8403 | CTCN_3243 | 18590 |
| ATCN_269 | 8404 | TTCN_3655 | 18591 |
| GTCN_227 | 8405 | TTCN_3656 | 18592 |
| TTCN_481 | 8406 | TTCN_3657 | 18593 |
| TTCN_482 | 8407 | ATCN_2280 | 18594 |
| TTCN_483 | 8408 | CTCN_3244 | 18595 |
| GTCN_228 | 8409 | CTCN_3245 | 18596 |
| CTCN_341 | 8410 | GTCN_1905 | 18597 |
| TTCN_484 | 8411 | CTCN_3246 | 18598 |
| CTCN_342 | 8412 | GTCN_1906 | 18599 |
| CTCN_343 | 8413 | CTCN_3247 | 18600 |
| GTCN_229 | 8414 | CTCN_3248 | 18601 |
| GTCN_230 | 8415 | CTCN_3249 | 18602 |
| GTCN_231 | 8416 | TTCN_3658 | 18603 |
| GTCN_232 | 8417 | CTCN_3250 | 18604 |
| ATCN_270 | 8418 | TTCN_3659 | 18605 |
| TTCN_485 | 8419 | CTCN_3251 | 18606 |
| GTCN_233 | 8420 | CTCN_3252 | 18607 |
| TTCN_486 | 8421 | TTCN_3660 | 18608 |
| CTCN_344 | 8422 | TTCN_3661 | 18609 |
| ATCN_271 | 8423 | CTCN_3253 | 18610 |
| CTCN_345 | 8424 | GTCN_1907 | 18611 |
| TTCN_487 | 8425 | TTCN_3662 | 18612 |
| TTCN_488 | 8426 | CTCN_3254 | 18613 |
| CTCN_346 | 8427 | CTCN_3255 | 18614 |
| ATCN_272 | 8428 | GTCN_1908 | 18615 |
| ATCN_273 | 8429 | TTCN_3663 | 18616 |
| TTCN_489 | 8430 | GTCN_1909 | 18617 |
| ATCN_274 | 8431 | TTCN_3664 | 18618 |
| ATCN_275 | 8432 | ATCN_2281 | 18619 |
| ATCN_276 | 8433 | ATCN_2282 | 18620 |
| TTCN_490 | 8434 | TTCN_3665 | 18621 |
| GTCN_234 | 8435 | CTCN_3256 | 18622 |
| CTCN_347 | 8436 | GTCN_1910 | 18623 |
| CTCN_348 | 8437 | TTCN_3666 | 18624 |
| ATCN_277 | 8438 | CTCN_3257 | 18625 |
| CTCN_349 | 8439 | ATCN_2283 | 18626 |
| CTCN_350 | 8440 | CTCN_3258 | 18627 |
| CTCN_351 | 8441 | CTCN_3259 | 18628 |
| ATCN_278 | 8442 | TTCN_3307 | 18629 |
| TTCN_491 | 8443 | TTCN_3308 | 18630 |
| CTCN_352 | 8444 | CTCN_2900 | 18631 |
| TTCN_492 | 8445 | TTCN_3309 | 18632 |
| ATCN_279 | 8446 | CTCN_2901 | 18633 |
| TTCN_493 | 8447 | CTCN_2902 | 18634 |
| GTCN_235 | 8448 | GTCN_1735 | 18635 |
| TTCN_494 | 8449 | CTCN_2903 | 18636 |
| TTCN_495 | 8450 | ATCN_2050 | 18637 |
| GTCN_236 | 8451 | ATCN_2051 | 18638 |
| TTCN_496 | 8452 | GTCN_1736 | 18639 |
| TTCN_497 | 8453 | CTCN_2904 | 18640 |
| ATCN_280 | 8454 | CTCN_2905 | 18641 |
| TTCN_498 | 8455 | CTCN_2906 | 18642 |
| TTCN_499 | 8456 | TTCN_3310 | 18643 |
| TTCN_500 | 8457 | GTCN_1737 | 18644 |
| GTCN_237 | 8458 | CTCN_2907 | 18645 |
| GTCN_238 | 8459 | CTCN_2908 | 18646 |
| CTCN_353 | 8460 | GTCN_1738 | 18647 |
| GTCN_239 | 8461 | TTCN_3311 | 18648 |
| ATCN_281 | 8462 | CTCN_2909 | 18649 |
| TTCN_501 | 8463 | TTCN_3312 | 18650 |
| CTCN_354 | 8464 | ATCN_2052 | 18651 |
| GTCN_240 | 8465 | ATCN_2053 | 18652 |
| TTCN_502 | 8466 | TTCN_3313 | 18653 |
| CTCN_355 | 8467 | ATCN_2054 | 18654 |
| GTCN_241 | 8468 | TTCN_3314 | 18655 |
| ATCN_282 | 8469 | TTCN_3315 | 18656 |
| ATCN_283 | 8470 | TTCN_3316 | 18657 |
| CTCN_356 | 8471 | TTCN_3317 | 18658 |
| TTCN_503 | 8472 | CTCN_2910 | 18659 |
| CTCN_357 | 8473 | TTCN_3318 | 18660 |
| CTCN_358 | 8474 | ATCN_2055 | 18661 |
| CTCN_359 | 8475 | TTCN_3319 | 18662 |
| ATCN_284 | 8476 | TTCN_3320 | 18663 |
| CTCN_360 | 8477 | GTCN_1739 | 18664 |
| TTCN_504 | 8478 | TTCN_3321 | 18665 |
| ATCN_285 | 8479 | TTCN_3322 | 18666 |
| CTCN_361 | 8480 | TTCN_3323 | 18667 |
| ATCN_286 | 8481 | ATCN_2056 | 18668 |
| ATCN_287 | 8482 | CTCN_2911 | 18669 |
| ATCN_288 | 8483 | GTCN_1740 | 18670 |
| ATCN_289 | 8484 | ATCN_2057 | 18671 |
| ATCN_290 | 8485 | TTCN_3324 | 18672 |
| ATCN_291 | 8486 | CTCN_2912 | 18673 |
| GTCN_242 | 8487 | GTCN_1741 | 18674 |
| GTCN_243 | 8488 | ATCN_2058 | 18675 |
| ATCN_292 | 8489 | ATCN_2059 | 18676 |
| TTCN_505 | 8490 | ATCN_2060 | 18677 |
| GTCN_244 | 8491 | TTCN_3325 | 18678 |
| CTCN_362 | 8492 | TTCN_3326 | 18679 |
| CTCN_363 | 8493 | GTCN_1742 | 18680 |
| ATCN_293 | 8494 | ATCN_2061 | 18681 |
| ATCN_294 | 8495 | ATCN_2062 | 18682 |
| CTCN_364 | 8496 | TTCN_3327 | 18683 |
| GTCN_245 | 8497 | TTCN_3328 | 18684 |
| ATCN_295 | 8498 | TTCN_3329 | 18685 |
| ATCN_296 | 8499 | ATCN_2063 | 18686 |
| CTCN_365 | 8500 | TTCN_3330 | 18687 |
| CTCN_366 | 8501 | TTCN_3331 | 18688 |
| GTCN_246 | 8502 | GTCN_1743 | 18689 |
| CTCN_367 | 8503 | CTCN_2913 | 18690 |
| CTCN_368 | 8504 | GTCN_1744 | 18691 |
| CTCN_369 | 8505 | TTCN_3332 | 18692 |
| GTCN_247 | 8506 | CTCN_2914 | 18693 |
| CTCN_370 | 8507 | ATCN_2064 | 18694 |
| CTCN_371 | 8508 | CTCN_2915 | 18695 |
| CTCN_372 | 8509 | CTCN_2916 | 18696 |
| TTCN_506 | 8510 | ATCN_2065 | 18697 |
| CTCN_373 | 8511 | TTCN_3333 | 18698 |

FIG. 36 (continued)

| | | | |
|---|---|---|---|
| TTCN_507 | 8512 | TTCN_3334 | 18699 |
| TTCN_508 | 8513 | CTCN_2917 | 18700 |
| GTCN_248 | 8514 | TTCN_3335 | 18701 |
| TTCN_509 | 8515 | TTCN_3336 | 18702 |
| TTCN_510 | 8516 | TTCN_3337 | 18703 |
| CTCN_374 | 8517 | TTCN_3338 | 18704 |
| CTCN_375 | 8518 | TTCN_3339 | 18705 |
| ATCN_297 | 8519 | GTCN_1745 | 18706 |
| ATCN_298 | 8520 | TTCN_3340 | 18707 |
| GTCN_249 | 8521 | TTCN_3341 | 18708 |
| CTCN_376 | 8522 | ATCN_2066 | 18709 |
| TTCN_511 | 8523 | TTCN_3342 | 18710 |
| CTCN_377 | 8524 | TTCN_3343 | 18711 |
| TTCN_512 | 8525 | TTCN_3344 | 18712 |
| CTCN_378 | 8526 | TTCN_3345 | 18713 |
| ATCN_299 | 8527 | CTCN_2918 | 18714 |
| TTCN_513 | 8528 | TTCN_3346 | 18715 |
| GTCN_250 | 8529 | GTCN_1746 | 18716 |
| TTCN_514 | 8530 | TTCN_3347 | 18717 |
| CTCN_379 | 8531 | CTCN_2919 | 18718 |
| ATCN_300 | 8532 | TTCN_3348 | 18719 |
| TTCN_515 | 8533 | TTCN_3349 | 18720 |
| ATCN_301 | 8534 | CTCN_2920 | 18721 |
| CTCN_380 | 8535 | TTCN_3350 | 18722 |
| GTCN_251 | 8536 | TTCN_3351 | 18723 |
| CTCN_381 | 8537 | TTCN_3352 | 18724 |
| TTCN_516 | 8538 | TTCN_3353 | 18725 |
| CTCN_382 | 8539 | TTCN_3354 | 18726 |
| GTCN_252 | 8540 | TTCN_3355 | 18727 |
| TTCN_517 | 8541 | CTCN_2921 | 18728 |
| TTCN_518 | 8542 | CTCN_2922 | 18729 |
| TTCN_519 | 8543 | TTCN_3356 | 18730 |
| CTCN_383 | 8544 | CTCN_2923 | 18731 |
| CTCN_384 | 8545 | TTCN_3357 | 18732 |
| GTCN_253 | 8546 | GTCN_1747 | 18733 |
| CTCN_385 | 8547 | CTCN_2924 | 18734 |
| GTCN_254 | 8548 | CTCN_2925 | 18735 |
| CTCN_386 | 8549 | TTCN_3358 | 18736 |
| CTCN_387 | 8550 | TTCN_3359 | 18737 |
| ATCN_302 | 8551 | TTCN_3360 | 18738 |
| TTCN_520 | 8552 | TTCN_3361 | 18739 |
| GTCN_255 | 8553 | CTCN_2926 | 18740 |
| GTCN_256 | 8554 | TTCN_3362 | 18741 |
| ATCN_303 | 8555 | CTCN_2927 | 18742 |
| ATCN_304 | 8556 | TTCN_3363 | 18743 |
| ATCN_305 | 8557 | CTCN_2928 | 18744 |
| ATCN_306 | 8558 | CTCN_2929 | 18745 |
| CTCN_388 | 8559 | TTCN_3364 | 18746 |
| ATCN_307 | 8560 | CTCN_2930 | 18747 |
| CTCN_389 | 8561 | TTCN_3365 | 18748 |
| TTCN_521 | 8562 | ATCN_2067 | 18749 |
| CTCN_390 | 8563 | TTCN_3366 | 18750 |
| GTCN_257 | 8564 | CTCN_2931 | 18751 |
| TTCN_522 | 8565 | CTCN_2932 | 18752 |
| CTCN_391 | 8566 | CTCN_2933 | 18753 |

| | | | |
|---|---|---|---|
| CTCN_392 | 8567 | GTCN_1748 | 18754 |
| TTCN_523 | 8568 | CTCN_2934 | 18755 |
| CTCN_393 | 8569 | ATCN_2068 | 18756 |
| GTCN_258 | 8570 | CTCN_2935 | 18757 |
| CTCN_394 | 8571 | CTCN_2936 | 18758 |
| ATCN_308 | 8572 | CTCN_2937 | 18759 |
| ATCN_309 | 8573 | GTCN_1749 | 18760 |
| CTCN_395 | 8574 | GTCN_1750 | 18761 |
| GTCN_259 | 8575 | GTCN_1751 | 18762 |
| CTCN_396 | 8576 | CTCN_2938 | 18763 |
| ATCN_310 | 8577 | TTCN_3367 | 18764 |
| TTCN_524 | 8578 | TTCN_3368 | 18765 |
| ATCN_311 | 8579 | GTCN_1752 | 18766 |
| ATCN_312 | 8580 | GTCN_1753 | 18767 |
| TTCN_525 | 8581 | CTCN_2939 | 18768 |
| TTCN_526 | 8582 | TTCN_3369 | 18769 |
| TTCN_527 | 8583 | CTCN_2940 | 18770 |
| TTCN_528 | 8584 | ATCN_2069 | 18771 |
| TTCN_529 | 8585 | CTCN_2941 | 18772 |
| GTCN_260 | 8586 | CTCN_2942 | 18773 |
| TTCN_530 | 8587 | CTCN_2943 | 18774 |
| GTCN_261 | 8588 | GTCN_1754 | 18775 |
| CTCN_397 | 8589 | TTCN_3370 | 18776 |
| TTCN_531 | 8590 | ATCN_2070 | 18777 |
| TTCN_532 | 8591 | CTCN_2944 | 18778 |
| CTCN_398 | 8592 | CTCN_2945 | 18779 |
| CTCN_399 | 8593 | CTCN_2946 | 18780 |
| GTCN_262 | 8594 | GTCN_1755 | 18781 |
| TTCN_533 | 8595 | ATCN_2071 | 18782 |
| CTCN_400 | 8596 | TTCN_3371 | 18783 |
| GTCN_263 | 8597 | TTCN_3372 | 18784 |
| ATCN_313 | 8598 | ATCN_2072 | 18785 |
| CTCN_401 | 8599 | CTCN_2947 | 18786 |
| GTCN_264 | 8600 | ATCN_2073 | 18787 |
| CTCN_402 | 8601 | TTCN_3373 | 18788 |
| GTCN_265 | 8602 | CTCN_2948 | 18789 |
| GTCN_266 | 8603 | CTCN_2949 | 18790 |
| ATCN_314 | 8604 | CTCN_2950 | 18791 |
| CTCN_403 | 8605 | CTCN_2951 | 18792 |
| ATCN_315 | 8606 | GTCN_1756 | 18793 |
| CTCN_404 | 8607 | CTCN_2952 | 18794 |
| ATCN_316 | 8608 | CTCN_2953 | 18795 |
| GTCN_267 | 8609 | ATCN_2074 | 18796 |
| TTCN_534 | 8610 | TTCN_3374 | 18797 |
| GTCN_268 | 8611 | ATCN_2075 | 18798 |
| CTCN_405 | 8612 | ATCN_2076 | 18799 |
| GTCN_269 | 8613 | ATCN_2077 | 18800 |
| TTCN_535 | 8614 | GTCN_1757 | 18801 |
| TTCN_536 | 8615 | CTCN_2954 | 18802 |
| ATCN_317 | 8616 | TTCN_3375 | 18803 |
| ATCN_318 | 8617 | ATCN_2078 | 18804 |
| CTCN_406 | 8618 | CTCN_2955 | 18805 |
| GTCN_270 | 8619 | CTCN_2956 | 18806 |
| ATCN_319 | 8620 | TTCN_3376 | 18807 |
| CTCN_407 | 8621 | CTCN_2957 | 18808 |

FIG. 36 (continued)

| | | | |
|---|---|---|---|
| TTCN_537 | 8622 | CTCN_2958 | 18809 |
| TTCN_538 | 8623 | ATCN_2079 | 18810 |
| TTCN_539 | 8624 | TTCN_3377 | 18811 |
| TTCN_540 | 8625 | TTCN_3378 | 18812 |
| ATCN_320 | 8626 | ATCN_2080 | 18813 |
| TTCN_541 | 8627 | CTCN_2959 | 18814 |
| TTCN_542 | 8628 | TTCN_3379 | 18815 |
| ATCN_321 | 8629 | CTCN_2960 | 18816 |
| TTCN_543 | 8630 | TTCN_3380 | 18817 |
| TTCN_544 | 8631 | TTCN_3381 | 18818 |
| CTCN_408 | 8632 | TTCN_3382 | 18819 |
| CTCN_409 | 8633 | ATCN_2081 | 18820 |
| TTCN_545 | 8634 | TTCN_3383 | 18821 |
| ATCN_322 | 8635 | CTCN_2961 | 18822 |
| TTCN_546 | 8636 | TTCN_3384 | 18823 |
| ATCN_323 | 8637 | ATCN_2082 | 18824 |
| TTCN_547 | 8638 | CTCN_2962 | 18825 |
| TTCN_548 | 8639 | ATCN_2083 | 18826 |
| TTCN_549 | 8640 | ATCN_2084 | 18827 |
| ATCN_324 | 8641 | CTCN_2963 | 18828 |
| CTCN_410 | 8642 | TTCN_3385 | 18829 |
| ATCN_325 | 8643 | ATCN_2085 | 18830 |
| ATCN_326 | 8644 | CTCN_2964 | 18831 |
| GTCN_271 | 8645 | ATCN_2086 | 18832 |
| GTCN_272 | 8646 | CTCN_2965 | 18833 |
| ATCN_327 | 8647 | TTCN_3386 | 18834 |
| TTCN_550 | 8648 | TTCN_3387 | 18835 |
| TTCN_551 | 8649 | CTCN_2966 | 18836 |
| CTCN_411 | 8650 | GTCN_1758 | 18837 |
| GTCN_273 | 8651 | ATCN_2087 | 18838 |
| GTCN_274 | 8652 | TTCN_3388 | 18839 |
| GTCN_275 | 8653 | GTCN_1759 | 18840 |
| TTCN_552 | 8654 | CTCN_2967 | 18841 |
| GTCN_276 | 8655 | CTCN_2968 | 18842 |
| GTCN_277 | 8656 | CTCN_2969 | 18843 |
| CTCN_412 | 8657 | GTCN_1760 | 18844 |
| TTCN_553 | 8658 | CTCN_2970 | 18845 |
| GTCN_278 | 8659 | TTCN_3389 | 18846 |
| CTCN_413 | 8660 | ATCN_2088 | 18847 |
| TTCN_554 | 8661 | TTCN_3390 | 18848 |
| TTCN_555 | 8662 | TTCN_3391 | 18849 |
| TTCN_556 | 8663 | TTCN_3392 | 18850 |
| CTCN_414 | 8664 | CTCN_2971 | 18851 |
| TTCN_557 | 8665 | CTCN_2972 | 18852 |
| TTCN_558 | 8666 | TTCN_3393 | 18853 |
| CTCN_415 | 8667 | ATCN_2089 | 18854 |
| TTCN_559 | 8668 | ATCN_2090 | 18855 |
| TTCN_560 | 8669 | TTCN_3394 | 18856 |
| GTCN_279 | 8670 | CTCN_2973 | 18857 |
| CTCN_416 | 8671 | TTCN_3395 | 18858 |
| CTCN_417 | 8672 | TTCN_3396 | 18859 |
| TTCN_561 | 8673 | GTCN_1761 | 18860 |
| GTCN_280 | 8674 | TTCN_3397 | 18861 |
| GTCN_281 | 8675 | TTCN_3398 | 18862 |
| GTCN_282 | 8676 | TTCN_3399 | 18863 |

| | | | |
|---|---|---|---|
| ATCN_328 | 8677 | TTCN_3400 | 18864 |
| ATCN_329 | 8678 | ATCN_2091 | 18865 |
| GTCN_283 | 8679 | ATCN_2092 | 18866 |
| GTCN_284 | 8680 | ATCN_2093 | 18867 |
| GTCN_285 | 8681 | GTCN_1762 | 18868 |
| CTCN_418 | 8682 | ATCN_2094 | 18869 |
| ATCN_330 | 8683 | CTCN_2974 | 18870 |
| TTCN_562 | 8684 | TTCN_3401 | 18871 |
| ATCN_331 | 8685 | GTCN_1763 | 18872 |
| GTCN_286 | 8686 | CTCN_2975 | 18873 |
| TTCN_563 | 8687 | TTCN_3402 | 18874 |
| CTCN_419 | 8688 | TTCN_3403 | 18875 |
| TTCN_564 | 8689 | TTCN_3404 | 18876 |
| CTCN_420 | 8690 | ATCN_2095 | 18877 |
| ATCN_332 | 8691 | ATCN_2096 | 18878 |
| ATCN_333 | 8692 | TTCN_3405 | 18879 |
| CTCN_421 | 8693 | TTCN_3406 | 18880 |
| ATCN_334 | 8694 | ATCN_2097 | 18881 |
| CTCN_422 | 8695 | ATCN_2098 | 18882 |
| CTCN_423 | 8696 | CTCN_2976 | 18883 |
| GTCN_287 | 8697 | CTCN_2977 | 18884 |
| CTCN_424 | 8698 | ATCN_2099 | 18885 |
| TTCN_565 | 8699 | ATCN_2100 | 18886 |
| ATCN_335 | 8700 | TTCN_3407 | 18887 |
| TTCN_566 | 8701 | CTCN_2978 | 18888 |
| CTCN_425 | 8702 | CTCN_2979 | 18889 |
| ATCN_336 | 8703 | TTCN_3408 | 18890 |
| CTCN_426 | 8704 | TTCN_3409 | 18891 |
| CTCN_427 | 8705 | GTCN_1764 | 18892 |
| TTCN_567 | 8706 | CTCN_2980 | 18893 |
| CTCN_428 | 8707 | GTCN_1765 | 18894 |
| CTCN_429 | 8708 | TTCN_3410 | 18895 |
| ATCN_337 | 8709 | CTCN_2981 | 18896 |
| CTCN_430 | 8710 | CTCN_2982 | 18897 |
| TTCN_568 | 8711 | GTCN_1766 | 18898 |
| CTCN_431 | 8712 | CTCN_2983 | 18899 |
| TTCN_569 | 8713 | TTCN_3411 | 18900 |
| TTCN_570 | 8714 | GTCN_1767 | 18901 |
| CTCN_432 | 8715 | CTCN_2984 | 18902 |
| CTCN_433 | 8716 | TTCN_3412 | 18903 |
| ATCN_338 | 8717 | GTCN_1768 | 18904 |
| GTCN_288 | 8718 | CTCN_2985 | 18905 |
| TTCN_571 | 8719 | ATCN_2101 | 18906 |
| TTCN_572 | 8720 | CTCN_2986 | 18907 |
| CTCN_434 | 8721 | GTCN_1769 | 18908 |
| GTCN_289 | 8722 | CTCN_2987 | 18909 |
| CTCN_435 | 8723 | TTCN_3413 | 18910 |
| TTCN_573 | 8724 | ATCN_2102 | 18911 |
| TTCN_574 | 8725 | ATCN_2103 | 18912 |
| ATCN_339 | 8726 | TTCN_3414 | 18913 |
| CTCN_436 | 8727 | ATCN_2104 | 18914 |
| TTCN_575 | 8728 | CTCN_2988 | 18915 |
| CTCN_437 | 8729 | GTCN_1770 | 18916 |
| ATCN_340 | 8730 | CTCN_2989 | 18917 |
| GTCN_290 | 8731 | GTCN_1771 | 18918 |

FIG. 36 (continued)

| | | | |
|---|---|---|---|
| TTCN_576 | 8732 | GTCN_1772 | 18919 |
| TTCN_577 | 8733 | TTCN_3415 | 18920 |
| GTCN_291 | 8734 | GTCN_1773 | 18921 |
| TTCN_578 | 8735 | GTCN_1774 | 18922 |
| GTCN_292 | 8736 | CTCN_2990 | 18923 |
| TTCN_579 | 8737 | TTCN_3416 | 18924 |
| ATCN_341 | 8738 | ATCN_2105 | 18925 |
| TTCN_580 | 8739 | ATCN_2106 | 18926 |
| CTCN_438 | 8740 | ATCN_2107 | 18927 |
| TTCN_581 | 8741 | ATCN_2108 | 18928 |
| TTCN_582 | 8742 | CTCN_2991 | 18929 |
| TTCN_583 | 8743 | TTCN_3417 | 18930 |
| CTCN_439 | 8744 | CTCN_2992 | 18931 |
| CTCN_440 | 8745 | TTCN_3418 | 18932 |
| ATCN_342 | 8746 | TTCN_3419 | 18933 |
| GTCN_293 | 8747 | CTCN_2993 | 18934 |
| TTCN_584 | 8748 | CTCN_2994 | 18935 |
| ATCN_343 | 8749 | GTCN_1775 | 18936 |
| TTCN_585 | 8750 | TTCN_3420 | 18937 |
| GTCN_294 | 8751 | TTCN_3421 | 18938 |
| CTCN_441 | 8752 | CTCN_2995 | 18939 |
| ATCN_344 | 8753 | TTCN_3422 | 18940 |
| TTCN_586 | 8754 | TTCN_3423 | 18941 |
| ATCN_345 | 8755 | CTCN_2996 | 18942 |
| CTCN_442 | 8756 | TTCN_3424 | 18943 |
| CTCN_443 | 8757 | ATCN_2109 | 18944 |
| GTCN_295 | 8758 | CTCN_2997 | 18945 |
| CTCN_444 | 8759 | TTCN_3425 | 18946 |
| GTCN_296 | 8760 | TTCN_3426 | 18947 |
| TTCN_587 | 8761 | CTCN_2998 | 18948 |
| GTCN_297 | 8762 | TTCN_3427 | 18949 |
| TTCN_588 | 8763 | CTCN_2999 | 18950 |
| CTCN_445 | 8764 | TTCN_3428 | 18951 |
| CTCN_446 | 8765 | TTCN_3429 | 18952 |
| GTCN_298 | 8766 | ATCN_2110 | 18953 |
| CTCN_447 | 8767 | ATCN_2111 | 18954 |
| GTCN_299 | 8768 | ATCN_2112 | 18955 |
| CTCN_448 | 8769 | ATCN_2113 | 18956 |
| TTCN_589 | 8770 | TTCN_3430 | 18957 |
| CTCN_449 | 8771 | TTCN_3431 | 18958 |
| GTCN_300 | 8772 | TTCN_3432 | 18959 |
| CTCN_450 | 8773 | TTCN_3433 | 18960 |
| TTCN_590 | 8774 | CTCN_3000 | 18961 |
| GTCN_301 | 8775 | ATCN_2114 | 18962 |
| CTCN_451 | 8776 | CTCN_3001 | 18963 |
| TTCN_591 | 8777 | TTCN_3434 | 18964 |
| ATCN_346 | 8778 | CTCN_3002 | 18965 |
| GTCN_302 | 8779 | TTCN_3435 | 18966 |
| CTCN_452 | 8780 | ATCN_2115 | 18967 |
| ATCN_347 | 8781 | ATCN_2116 | 18968 |
| CTCN_453 | 8782 | ATCN_2117 | 18969 |
| TTCN_592 | 8783 | CTCN_3003 | 18970 |
| TTCN_593 | 8784 | TTCN_3436 | 18971 |
| ATCN_348 | 8785 | ATCN_2118 | 18972 |
| CTCN_454 | 8786 | TTCN_3437 | 18973 |
| CTCN_455 | 8787 | CTCN_3004 | 18974 |
| TTCN_594 | 8788 | CTCN_3005 | 18975 |
| TTCN_595 | 8789 | CTCN_3006 | 18976 |
| GTCN_303 | 8790 | CTCN_3007 | 18977 |
| CTCN_456 | 8791 | CTCN_3008 | 18978 |
| TTCN_596 | 8792 | TTCN_3438 | 18979 |
| ATCN_349 | 8793 | TTCN_3439 | 18980 |
| TTCN_597 | 8794 | CTCN_3009 | 18981 |
| GTCN_304 | 8795 | GTCN_1776 | 18982 |
| CTCN_457 | 8796 | TTCN_3440 | 18983 |
| TTCN_598 | 8797 | CTCN_3010 | 18984 |
| ATCN_350 | 8798 | CTCN_3011 | 18985 |
| TTCN_599 | 8799 | CTCN_3012 | 18986 |
| CTCN_458 | 8800 | GTCN_1777 | 18987 |
| CTCN_459 | 8801 | TTCN_3441 | 18988 |
| CTCN_460 | 8802 | ATCN_2119 | 18989 |
| TTCN_600 | 8803 | CTCN_3013 | 18990 |
| TTCN_601 | 8804 | CTCN_3014 | 18991 |
| TTCN_602 | 8805 | CTCN_3015 | 18992 |
| TTCN_603 | 8806 | TTCN_3442 | 18993 |
| TTCN_604 | 8807 | CTCN_3016 | 18994 |
| GTCN_305 | 8808 | TTCN_3443 | 18995 |
| GTCN_306 | 8809 | CTCN_3017 | 18996 |
| CTCN_461 | 8810 | GTCN_1778 | 18997 |
| ATCN_351 | 8811 | ATCN_2120 | 18998 |
| CTCN_462 | 8812 | CTCN_3018 | 18999 |
| GTCN_307 | 8813 | ATCN_2121 | 19000 |
| TTCN_605 | 8814 | TTCN_3444 | 19001 |
| ATCN_352 | 8815 | ATCN_2122 | 19002 |
| ATCN_353 | 8816 | ATCN_2123 | 19003 |
| CTCN_463 | 8817 | TTCN_3445 | 19004 |
| CTCN_464 | 8818 | CTCN_3019 | 19005 |
| CTCN_465 | 8819 | ATCN_2124 | 19006 |
| TTCN_606 | 8820 | TTCN_3446 | 19007 |
| TTCN_607 | 8821 | CTCN_3020 | 19008 |
| GTCN_308 | 8822 | TTCN_3447 | 19009 |
| ATCN_354 | 8823 | ATCN_2125 | 19010 |
| ATCN_355 | 8824 | TTCN_3448 | 19011 |
| TTCN_608 | 8825 | TTCN_3449 | 19012 |
| TTCN_609 | 8826 | ATCN_2126 | 19013 |
| TTCN_610 | 8827 | GTCN_1779 | 19014 |
| TTCN_611 | 8828 | CTCN_3021 | 19015 |
| TTCN_612 | 8829 | TTCN_3450 | 19016 |
| CTCN_466 | 8830 | CTCN_3022 | 19017 |
| GTCN_309 | 8831 | GTCN_1780 | 19018 |
| ATCN_356 | 8832 | TTCN_3451 | 19019 |
| ATCN_357 | 8833 | ATCN_2127 | 19020 |
| TTCN_613 | 8834 | ATCN_2128 | 19021 |
| GTCN_310 | 8835 | TTCN_3452 | 19022 |
| TTCN_614 | 8836 | ATCN_2129 | 19023 |
| ATCN_358 | 8837 | CTCN_3023 | 19024 |
| TTCN_615 | 8838 | GTCN_1781 | 19025 |
| CTCN_467 | 8839 | TTCN_3453 | 19026 |
| CTCN_468 | 8840 | ATCN_2130 | 19027 |
| CTCN_469 | 8841 | ATCN_2131 | 19028 |

FIG. 36 (continued)

| | | | |
|---|---|---|---|
| CTCN_470 | 8842 | ATCN_2132 | 19029 |
| ATCN_359 | 8843 | ATCN_2133 | 19030 |
| CTCN_471 | 8844 | GTCN_1782 | 19031 |
| CTCN_472 | 8845 | GTCN_1783 | 19032 |
| TTCN_616 | 8846 | CTCN_3024 | 19033 |
| TTCN_617 | 8847 | ATCN_2134 | 19034 |
| CTCN_473 | 8848 | TTCN_3454 | 19035 |
| CTCN_474 | 8849 | TTCN_3455 | 19036 |
| CTCN_475 | 8850 | CTCN_3025 | 19037 |
| CTCN_476 | 8851 | CTCN_3026 | 19038 |
| TTCN_618 | 8852 | CTCN_3027 | 19039 |
| CTCN_477 | 8853 | GTCN_1784 | 19040 |
| CTCN_478 | 8854 | GTCN_1785 | 19041 |
| GTCN_311 | 8855 | TTCN_3456 | 19042 |
| ATCN_360 | 8856 | TTCN_3457 | 19043 |
| ATCN_361 | 8857 | GTCN_1786 | 19044 |
| TTCN_619 | 8858 | TTCN_3458 | 19045 |
| GTCN_312 | 8859 | TTCN_3459 | 19046 |
| CTCN_479 | 8860 | CTCN_3028 | 19047 |
| CTCN_480 | 8861 | CTCN_3029 | 19048 |
| TTCN_620 | 8862 | TTCN_3460 | 19049 |
| GTCN_313 | 8863 | TTCN_3461 | 19050 |
| CTCN_481 | 8864 | ATCN_2135 | 19051 |
| CTCN_482 | 8865 | TTCN_3462 | 19052 |
| TTCN_621 | 8866 | ATCN_2136 | 19053 |
| ATCN_362 | 8867 | CTCN_3030 | 19054 |
| TTCN_622 | 8868 | ATCN_2137 | 19055 |
| CTCN_483 | 8869 | CTCN_3031 | 19056 |
| TTCN_623 | 8870 | CTCN_3032 | 19057 |
| TTCN_624 | 8871 | CTCN_3033 | 19058 |
| ATCN_363 | 8872 | GTCN_1787 | 19059 |
| TTCN_625 | 8873 | ATCN_2138 | 19060 |
| ATCN_364 | 8874 | ATCN_2139 | 19061 |
| CTCN_484 | 8875 | GTCN_1788 | 19062 |
| CTCN_485 | 8876 | TTCN_3463 | 19063 |
| ATCN_365 | 8877 | CTCN_3034 | 19064 |
| TTCN_626 | 8878 | CTCN_3035 | 19065 |
| TTCN_627 | 8879 | CTCN_3036 | 19066 |
| ATCN_366 | 8880 | CTCN_3037 | 19067 |
| CTCN_486 | 8881 | TTCN_3464 | 19068 |
| TTCN_628 | 8882 | TTCN_3465 | 19069 |
| CTCN_487 | 8883 | ATCN_2140 | 19070 |
| TTCN_629 | 8884 | ATCN_2141 | 19071 |
| ATCN_367 | 8885 | TTCN_3466 | 19072 |
| ATCN_368 | 8886 | CTCN_3038 | 19073 |
| ATCN_369 | 8887 | TTCN_3467 | 19074 |
| CTCN_488 | 8888 | TTCN_3468 | 19075 |
| GTCN_314 | 8889 | TTCN_3469 | 19076 |
| TTCN_630 | 8890 | ATCN_2142 | 19077 |
| CTCN_489 | 8891 | TTCN_3470 | 19078 |
| TTCN_631 | 8892 | GTCN_1789 | 19079 |
| ATCN_370 | 8893 | CTCN_3039 | 19080 |
| CTCN_490 | 8894 | TTCN_3471 | 19081 |
| GTCN_315 | 8895 | ATCN_2143 | 19082 |
| CTCN_491 | 8896 | TTCN_3472 | 19083 |

| | | | |
|---|---|---|---|
| ATCN_371 | 8897 | TTCN_3473 | 19084 |
| TTCN_632 | 8898 | CTCN_3040 | 19085 |
| GTCN_316 | 8899 | CTCN_3041 | 19086 |
| ATCN_372 | 8900 | TTCN_3474 | 19087 |
| CTCN_492 | 8901 | ATCN_2144 | 19088 |
| GTCN_317 | 8902 | TTCN_3475 | 19089 |
| GTCN_318 | 8903 | TTCN_3476 | 19090 |
| TTCN_633 | 8904 | TTCN_3477 | 19091 |
| TTCN_634 | 8905 | CTCN_3042 | 19092 |
| TTCN_635 | 8906 | TTCN_3478 | 19093 |
| ATCN_373 | 8907 | CTCN_3043 | 19094 |
| TTCN_636 | 8908 | ATCN_2145 | 19095 |
| ATCN_374 | 8909 | CTCN_3044 | 19096 |
| TTCN_637 | 8910 | CTCN_3045 | 19097 |
| ATCN_375 | 8911 | CTCN_3046 | 19098 |
| CTCN_493 | 8912 | ATCN_2146 | 19099 |
| TTCN_638 | 8913 | ATCN_2147 | 19100 |
| GTCN_319 | 8914 | GTCN_1790 | 19101 |
| ATCN_376 | 8915 | CTCN_3047 | 19102 |
| TTCN_639 | 8916 | ATCN_2148 | 19103 |
| TTCN_640 | 8917 | ATCN_2149 | 19104 |
| TTCN_641 | 8918 | GTCN_1791 | 19105 |
| CTCN_494 | 8919 | ATCN_2150 | 19106 |
| GTCN_320 | 8920 | TTCN_3479 | 19107 |
| TTCN_642 | 8921 | ATCN_2151 | 19108 |
| GTCN_321 | 8922 | CTCN_3048 | 19109 |
| TTCN_643 | 8923 | ATCN_2152 | 19110 |
| ATCN_377 | 8924 | GTCN_1792 | 19111 |
| TTCN_644 | 8925 | CTCN_3049 | 19112 |
| TTCN_645 | 8926 | CTCN_3050 | 19113 |
| ATCN_378 | 8927 | CTCN_3051 | 19114 |
| GTCN_322 | 8928 | GTCN_1793 | 19115 |
| CTCN_495 | 8929 | CTCN_3052 | 19116 |
| TTCN_646 | 8930 | CTCN_3053 | 19117 |
| GTCN_323 | 8931 | TTCN_3480 | 19118 |
| TTCN_647 | 8932 | TTCN_3481 | 19119 |
| ATCN_379 | 8933 | CTCN_3054 | 19120 |
| ATCN_380 | 8934 | CTCN_3055 | 19121 |
| TTCN_648 | 8935 | ATCN_2153 | 19122 |
| ATCN_381 | 8936 | CTCN_3056 | 19123 |
| CTCN_496 | 8937 | CTCN_3057 | 19124 |
| GTCN_324 | 8938 | ATCN_2154 | 19125 |
| TTCN_649 | 8939 | ATCN_2155 | 19126 |
| TTCN_650 | 8940 | ATCN_2156 | 19127 |
| CTCN_497 | 8941 | CTCN_3058 | 19128 |
| TTCN_651 | 8942 | CTCN_3059 | 19129 |
| CTCN_498 | 8943 | GTCN_1794 | 19130 |
| TTCN_652 | 8944 | CTCN_3060 | 19131 |
| GTCN_325 | 8945 | TTCN_3482 | 19132 |
| ATCN_382 | 8946 | CTCN_3061 | 19133 |
| GTCN_326 | 8947 | TTCN_3483 | 19134 |
| GTCN_327 | 8948 | GTCN_1795 | 19135 |
| GTCN_328 | 8949 | CTCN_3062 | 19136 |
| CTCN_499 | 8950 | ATCN_2157 | 19137 |
| TTCN_653 | 8951 | ATCN_2158 | 19138 |

FIG. 36 (continued)

| | | | |
|---|---|---|---|
| ATCN_383 | 8952 | TTCN_3484 | 19139 |
| TTCN_654 | 8953 | CTCN_3063 | 19140 |
| CTCN_500 | 8954 | CTCN_3064 | 19141 |
| CTCN_501 | 8955 | ATCN_2159 | 19142 |
| TTCN_655 | 8956 | ATCN_2160 | 19143 |
| GTCN_329 | 8957 | TTCN_3485 | 19144 |
| ATCN_384 | 8958 | CTCN_3065 | 19145 |
| GTCN_330 | 8959 | GTCN_1796 | 19146 |
| TTCN_656 | 8960 | CTCN_3066 | 19147 |
| ATCN_385 | 8961 | GTCN_1797 | 19148 |
| GTCN_331 | 8962 | TTCN_3486 | 19149 |
| ATCN_386 | 8963 | CTCN_3067 | 19150 |
| ATCN_387 | 8964 | TTCN_3487 | 19151 |
| CTCN_502 | 8965 | ATCN_2161 | 19152 |
| GTCN_332 | 8966 | CTCN_3068 | 19153 |
| GTCN_333 | 8967 | TTCN_3488 | 19154 |
| GTCN_334 | 8968 | GTCN_1798 | 19155 |
| CTCN_503 | 8969 | TTCN_3489 | 19156 |
| CTCN_504 | 8970 | ATCN_2162 | 19157 |
| CTCN_505 | 8971 | CTCN_3069 | 19158 |
| TTCN_657 | 8972 | GTCN_1799 | 19159 |
| TTCN_658 | 8973 | ATCN_2163 | 19160 |
| ATCN_388 | 8974 | GTCN_1800 | 19161 |
| ATCN_389 | 8975 | ATCN_2164 | 19162 |
| ATCN_390 | 8976 | TTCN_3490 | 19163 |
| CTCN_506 | 8977 | CTCN_3070 | 19164 |
| TTCN_659 | 8978 | CTCN_3071 | 19165 |
| GTCN_335 | 8979 | ATCN_2165 | 19166 |
| CTCN_507 | 8980 | ATCN_2166 | 19167 |
| CTCN_508 | 8981 | CTCN_3072 | 19168 |
| CTCN_509 | 8982 | ATCN_2167 | 19169 |
| CTCN_510 | 8983 | TTCN_3491 | 19170 |
| CTCN_511 | 8984 | CTCN_3073 | 19171 |
| CTCN_512 | 8985 | GTCN_1801 | 19172 |
| TTCN_660 | 8986 | TTCN_3492 | 19173 |
| CTCN_513 | 8987 | TTCN_3493 | 19174 |
| ATCN_391 | 8988 | ATCN_2168 | 19175 |
| CTCN_514 | 8989 | ATCN_2169 | 19176 |
| TTCN_661 | 8990 | TTCN_3494 | 19177 |
| ATCN_392 | 8991 | TTCN_3495 | 19178 |
| TTCN_662 | 8992 | TTCN_3496 | 19179 |
| TTCN_663 | 8993 | CTCN_3074 | 19180 |
| CTCN_515 | 8994 | GTCN_1802 | 19181 |
| ATCN_393 | 8995 | GTCN_1803 | 19182 |
| TTCN_664 | 8996 | ATCN_2170 | 19183 |
| ATCN_394 | 8997 | TTCN_3497 | 19184 |
| ATCN_395 | 8998 | TTCN_3498 | 19185 |
| TTCN_665 | 8999 | GTCN_1804 | 19186 |
| CTCN_516 | 9000 | ATCN_2171 | 19187 |
| GTCN_336 | 9001 | CTCN_3075 | 19188 |
| CTCN_517 | 9002 | GTCN_1805 | 19189 |
| TTCN_666 | 9003 | CTCN_3076 | 19190 |
| TTCN_667 | 9004 | TTCN_3499 | 19191 |
| TTCN_668 | 9005 | CTCN_3077 | 19192 |
| TTCN_669 | 9006 | ATCN_2172 | 19193 |

| | | | |
|---|---|---|---|
| TTCN_670 | 9007 | ATCN_2173 | 19194 |
| GTCN_337 | 9008 | TTCN_3500 | 19195 |
| CTCN_518 | 9009 | GTCN_1806 | 19196 |
| CTCN_519 | 9010 | GTCN_1807 | 19197 |
| TTCN_671 | 9011 | CTCN_3078 | 19198 |
| ATCN_396 | 9012 | GTCN_1808 | 19199 |
| GTCN_338 | 9013 | TTCN_3501 | 19200 |
| TTCN_672 | 9014 | TTCN_3502 | 19201 |
| ATCN_397 | 9015 | GTCN_1809 | 19202 |
| TTCN_673 | 9016 | ATCN_2174 | 19203 |
| TTCN_674 | 9017 | ATCN_2175 | 19204 |
| TTCN_675 | 9018 | GTCN_1810 | 19205 |
| TTCN_676 | 9019 | GTCN_1811 | 19206 |
| TTCN_677 | 9020 | CTCN_3079 | 19207 |
| CTCN_520 | 9021 | ATCN_2176 | 19208 |
| CTCN_521 | 9022 | TTCN_3503 | 19209 |
| ATCN_398 | 9023 | CTCN_3080 | 19210 |
| ATCN_399 | 9024 | ATCN_2177 | 19211 |
| TTCN_678 | 9025 | CTCN_3081 | 19212 |
| GTCN_339 | 9026 | TTCN_3504 | 19213 |
| TTCN_679 | 9027 | GTCN_1812 | 19214 |
| TTCN_680 | 9028 | CTCN_3082 | 19215 |
| ATCN_400 | 9029 | TTCN_3505 | 19216 |
| ATCN_401 | 9030 | TTCN_3506 | 19217 |
| ATCN_402 | 9031 | ATCN_2178 | 19218 |
| ATCN_403 | 9032 | TTCN_3507 | 19219 |
| TTCN_681 | 9033 | CTCN_3083 | 19220 |
| CTCN_522 | 9034 | TTCN_3508 | 19221 |
| TTCN_682 | 9035 | ATCN_2179 | 19222 |
| CTCN_523 | 9036 | ATCN_2180 | 19223 |
| CTCN_524 | 9037 | ATCN_2181 | 19224 |
| TTCN_683 | 9038 | ATCN_2182 | 19225 |
| TTCN_684 | 9039 | CTCN_3084 | 19226 |
| ATCN_404 | 9040 | TTCN_3509 | 19227 |
| ATCN_405 | 9041 | CTCN_3085 | 19228 |
| TTCN_685 | 9042 | CTCN_3086 | 19229 |
| CTCN_525 | 9043 | TTCN_3510 | 19230 |
| ATCN_406 | 9044 | TTCN_3511 | 19231 |
| ATCN_407 | 9045 | TTCN_3512 | 19232 |
| CTCN_526 | 9046 | TTCN_3513 | 19233 |
| CTCN_527 | 9047 | GTCN_1813 | 19234 |
| GTCN_340 | 9048 | TTCN_3514 | 19235 |
| TTCN_686 | 9049 | TTCN_3515 | 19236 |
| ATCN_408 | 9050 | ATCN_2183 | 19237 |
| ATCN_409 | 9051 | ATCN_2184 | 19238 |
| ATCN_410 | 9052 | TTCN_3516 | 19239 |
| ATCN_411 | 9053 | ATCN_2185 | 19240 |
| ATCN_412 | 9054 | ATCN_2186 | 19241 |
| GTCN_341 | 9055 | ATCN_2187 | 19242 |
| CTCN_528 | 9056 | TTCN_3517 | 19243 |
| CTCN_529 | 9057 | GTCN_1814 | 19244 |
| CTCN_530 | 9058 | CTCN_3087 | 19245 |
| TTCN_687 | 9059 | TTCN_3518 | 19246 |
| ATCN_413 | 9060 | ATCN_2188 | 19247 |
| ATCN_414 | 9061 | GTCN_1815 | 19248 |

FIG. 36 (continued)

| | | | |
|---|---|---|---|
| CTCN_531 | 9062 | TTCN_3519 | 19249 |
| CTCN_532 | 9063 | TTCN_3520 | 19250 |
| CTCN_533 | 9064 | CTCN_3088 | 19251 |
| TTCN_688 | 9065 | TTCN_3521 | 19252 |
| GTCN_342 | 9066 | TTCN_3522 | 19253 |
| TTCN_689 | 9067 | TTCN_3523 | 19254 |
| CTCN_534 | 9068 | TTCN_3524 | 19255 |
| CTCN_535 | 9069 | CTCN_3089 | 19256 |
| CTCN_536 | 9070 | TTCN_3525 | 19257 |
| TTCN_690 | 9071 | ATCN_2189 | 19258 |
| CTCN_537 | 9072 | ATCN_2190 | 19259 |
| GTCN_343 | 9073 | CTCN_3090 | 19260 |
| ATCN_415 | 9074 | ATCN_2191 | 19261 |
| ATCN_416 | 9075 | GTCN_1816 | 19262 |
| ATCN_417 | 9076 | TTCN_3526 | 19263 |
| ATCN_418 | 9077 | TTCN_3527 | 19264 |
| GTCN_344 | 9078 | CTCN_3091 | 19265 |
| GTCN_345 | 9079 | CTCN_3092 | 19266 |
| CTCN_538 | 9080 | GTCN_1817 | 19267 |
| TTCN_691 | 9081 | CTCN_3093 | 19268 |
| CTCN_539 | 9082 | CTCN_3094 | 19269 |
| GTCN_346 | 9083 | CTCN_3095 | 19270 |
| CTCN_540 | 9084 | TTCN_3528 | 19271 |
| TTCN_692 | 9085 | CTCN_3096 | 19272 |
| ATCN_419 | 9086 | CTCN_3097 | 19273 |
| GTCN_347 | 9087 | CTCN_3098 | 19274 |
| ATCN_420 | 9088 | CTCN_3099 | 19275 |
| ATCN_421 | 9089 | GTCN_1818 | 19276 |
| TTCN_693 | 9090 | ATCN_2192 | 19277 |
| GTCN_348 | 9091 | CTCN_3100 | 19278 |
| TTCN_694 | 9092 | CTCN_3101 | 19279 |
| CTCN_541 | 9093 | CTCN_3102 | 19280 |
| TTCN_695 | 9094 | TTCN_3529 | 19281 |
| ATCN_422 | 9095 | ATCN_2193 | 19282 |
| CTCN_542 | 9096 | TTCN_3530 | 19283 |
| TTCN_696 | 9097 | CTCN_3103 | 19284 |
| TTCN_697 | 9098 | GTCN_1819 | 19285 |
| ATCN_423 | 9099 | TTCN_3531 | 19286 |
| TTCN_698 | 9100 | CTCN_3104 | 19287 |
| GTCN_349 | 9101 | TTCN_3532 | 19288 |
| TTCN_699 | 9102 | CTCN_3105 | 19289 |
| TTCN_700 | 9103 | TTCN_3533 | 19290 |
| TTCN_701 | 9104 | TTCN_3534 | 19291 |
| ATCN_424 | 9105 | CTCN_3106 | 19292 |
| TTCN_702 | 9106 | GTCN_1820 | 19293 |
| ATCN_425 | 9107 | TTCN_3535 | 19294 |
| GTCN_350 | 9108 | ATCN_2194 | 19295 |
| CTCN_543 | 9109 | CTCN_3107 | 19296 |
| CTCN_544 | 9110 | CTCN_3108 | 19297 |
| TTCN_703 | 9111 | GTCN_1821 | 19298 |
| TTCN_704 | 9112 | CTCN_3109 | 19299 |
| TTCN_705 | 9113 | GTCN_1822 | 19300 |
| GTCN_351 | 9114 | GTCN_1823 | 19301 |
| TTCN_706 | 9115 | TTCN_3536 | 19302 |
| GTCN_352 | 9116 | ATCN_2195 | 19303 |
| ATCN_426 | 9117 | TTCN_3537 | 19304 |
| GTCN_353 | 9118 | GTCN_1824 | 19305 |
| TTCN_707 | 9119 | GTCN_1825 | 19306 |
| TTCN_708 | 9120 | ATCN_2196 | 19307 |
| CTCN_545 | 9121 | TTCN_3538 | 19308 |
| TTCN_709 | 9122 | TTCN_3539 | 19309 |
| TTCN_710 | 9123 | ATCN_2197 | 19310 |
| ATCN_427 | 9124 | GTCN_1826 | 19311 |
| TTCN_711 | 9125 | ATCN_2198 | 19312 |
| ATCN_428 | 9126 | ATCN_2199 | 19313 |
| ATCN_429 | 9127 | CTCN_3110 | 19314 |
| ATCN_430 | 9128 | TTCN_3540 | 19315 |
| ATCN_431 | 9129 | TTCN_3541 | 19316 |
| GTCN_354 | 9130 | TTCN_3542 | 19317 |
| TTCN_712 | 9131 | GTCN_1827 | 19318 |
| TTCN_713 | 9132 | ATCN_2200 | 19319 |
| CTCN_546 | 9133 | ATCN_2201 | 19320 |
| TTCN_714 | 9134 | TTCN_3543 | 19321 |
| GTCN_355 | 9135 | TTCN_3544 | 19322 |
| TTCN_715 | 9136 | TTCN_3545 | 19323 |
| TTCN_716 | 9137 | CTCN_3111 | 19324 |
| ATCN_432 | 9138 | TTCN_3546 | 19325 |
| ATCN_433 | 9139 | GTCN_1828 | 19326 |
| CTCN_547 | 9140 | TTCN_3547 | 19327 |
| GTCN_356 | 9141 | ATCN_2202 | 19328 |
| ATCN_434 | 9142 | ATCN_2203 | 19329 |
| GTCN_357 | 9143 | ATCN_2204 | 19330 |
| TTCN_717 | 9144 | ATCN_2205 | 19331 |
| TTCN_718 | 9145 | ATCN_2206 | 19332 |
| TTCN_719 | 9146 | TTCN_3548 | 19333 |
| ATCN_435 | 9147 | TTCN_3549 | 19334 |
| GTCN_358 | 9148 | ATCN_2207 | 19335 |
| ATCN_436 | 9149 | GTCN_1829 | 19336 |
| TTCN_720 | 9150 | CTCN_3112 | 19337 |
| CTCN_548 | 9151 | CTCN_3113 | 19338 |
| TTCN_721 | 9152 | GTCN_1830 | 19339 |
| CTCN_549 | 9153 | CTCN_3114 | 19340 |
| TTCN_722 | 9154 | GTCN_1831 | 19341 |
| TTCN_723 | 9155 | GTCN_1832 | 19342 |
| TTCN_724 | 9156 | CTCN_3115 | 19343 |
| TTCN_725 | 9157 | CTCN_3116 | 19344 |
| CTCN_550 | 9158 | ATCN_2208 | 19345 |
| TTCN_726 | 9159 | TTCN_3550 | 19346 |
| ATCN_437 | 9160 | GTCN_1833 | 19347 |
| CTCN_551 | 9161 | ATCN_2209 | 19348 |
| TTCN_727 | 9162 | TTCN_3551 | 19349 |
| CTCN_552 | 9163 | TTCN_3552 | 19350 |
| GTCN_359 | 9164 | ATCN_2210 | 19351 |
| TTCN_728 | 9165 | CTCN_3117 | 19352 |
| TTCN_729 | 9166 | CTCN_3118 | 19353 |
| CTCN_553 | 9167 | TTCN_3553 | 19354 |
| TTCN_730 | 9168 | CTCN_3119 | 19355 |
| ATCN_438 | 9169 | CTCN_3120 | 19356 |
| CTCN_554 | 9170 | GTCN_1834 | 19357 |
| CTCN_555 | 9171 | TTCN_3554 | 19358 |

FIG. 36 (continued)

| | | | |
|---|---|---|---|
| TTCN_731 | 9172 | TTCN_3555 | 19359 |
| ATCN_439 | 9173 | GTCN_1835 | 19360 |
| CTCN_556 | 9174 | GTCN_1836 | 19361 |
| TTCN_732 | 9175 | TTCN_3556 | 19362 |
| ATCN_440 | 9176 | TTCN_3557 | 19363 |
| TTCN_733 | 9177 | TTCN_3558 | 19364 |
| CTCN_557 | 9178 | GTCN_1837 | 19365 |
| ATCN_441 | 9179 | GTCN_1838 | 19366 |
| TTCN_734 | 9180 | ATCN_2211 | 19367 |
| ATCN_442 | 9181 | GTCN_1839 | 19368 |
| CTCN_558 | 9182 | CTCN_3121 | 19369 |
| TTCN_735 | 9183 | CTCN_3122 | 19370 |
| GTCN_360 | 9184 | TTCN_3559 | 19371 |
| CTCN_559 | 9185 | TTCN_3560 | 19372 |
| ATCN_443 | 9186 | TTCN_3561 | 19373 |
| ATCN_444 | 9187 | TTCN_3562 | 19374 |
| TTCN_736 | 9188 | TTCN_3563 | 19375 |
| CTCN_560 | 9189 | GTCN_1840 | 19376 |
| CTCN_561 | 9190 | TTCN_3564 | 19377 |
| ATCN_445 | 9191 | CTCN_3123 | 19378 |
| TTCN_737 | 9192 | GTCN_1841 | 19379 |
| CTCN_562 | 9193 | GTCN_1842 | 19380 |
| TTCN_738 | 9194 | CTCN_3124 | 19381 |
| CTCN_563 | 9195 | ATCN_2212 | 19382 |
| TTCN_739 | 9196 | ATCN_2213 | 19383 |
| CTCN_564 | 9197 | TTCN_3565 | 19384 |
| TTCN_740 | 9198 | CTCN_3125 | 19385 |
| GTCN_361 | 9199 | GTCN_1843 | 19386 |
| TTCN_741 | 9200 | GTCN_1844 | 19387 |
| CTCN_565 | 9201 | GTCN_1845 | 19388 |
| GTCN_362 | 9202 | CTCN_3126 | 19389 |
| TTCN_742 | 9203 | CTCN_3127 | 19390 |
| CTCN_566 | 9204 | GTCN_1846 | 19391 |
| TTCN_743 | 9205 | CTCN_3128 | 19392 |
| ATCN_446 | 9206 | TTCN_3566 | 19393 |
| CTCN_567 | 9207 | TTCN_3567 | 19394 |
| TTCN_744 | 9208 | CTCN_3129 | 19395 |
| ATCN_447 | 9209 | ATCN_2214 | 19396 |
| ATCN_448 | 9210 | ATCN_2215 | 19397 |
| CTCN_568 | 9211 | ATCN_2216 | 19398 |
| TTCN_745 | 9212 | CTCN_3130 | 19399 |
| ATCN_449 | 9213 | ATCN_2217 | 19400 |
| TTCN_746 | 9214 | ATCN_2218 | 19401 |
| TTCN_747 | 9215 | TTCN_3568 | 19402 |
| CTCN_569 | 9216 | GTCN_1847 | 19403 |
| ATCN_450 | 9217 | CTCN_3131 | 19404 |
| ATCN_451 | 9218 | CTCN_3132 | 19405 |
| GTCN_363 | 9219 | CTCN_3133 | 19406 |
| CTCN_570 | 9220 | CTCN_3134 | 19407 |
| ATCN_452 | 9221 | GTCN_1848 | 19408 |
| CTCN_571 | 9222 | ATCN_2219 | 19409 |
| TTCN_748 | 9223 | GTCN_1849 | 19410 |
| CTCN_572 | 9224 | ATCN_2220 | 19411 |
| ATCN_453 | 9225 | ATCN_2221 | 19412 |
| TTCN_749 | 9226 | CTCN_3135 | 19413 |

| | | | |
|---|---|---|---|
| TTCN_750 | 9227 | TTCN_3569 | 19414 |
| CTCN_573 | 9228 | GTCN_1850 | 19415 |
| ATCN_454 | 9229 | GTCN_1851 | 19416 |
| TTCN_751 | 9230 | TTCN_3570 | 19417 |
| TTCN_752 | 9231 | TTCN_3571 | 19418 |
| ATCN_455 | 9232 | TTCN_3572 | 19419 |
| TTCN_753 | 9233 | CTCN_3136 | 19420 |
| TTCN_754 | 9234 | ATCN_2222 | 19421 |
| CTCN_574 | 9235 | GTCN_1852 | 19422 |
| TTCN_755 | 9236 | CTCN_3137 | 19423 |
| CTCN_575 | 9237 | CTCN_3138 | 19424 |
| TTCN_756 | 9238 | TTCN_3573 | 19425 |
| CTCN_576 | 9239 | TTCN_3574 | 19426 |
| ATCN_456 | 9240 | ATCN_2223 | 19427 |
| TTCN_757 | 9241 | CTCN_3139 | 19428 |
| CTCN_577 | 9242 | CTCN_3140 | 19429 |
| TTCN_758 | 9243 | CTCN_3141 | 19430 |
| CTCN_578 | 9244 | ATCN_2224 | 19431 |
| ATCN_457 | 9245 | GTCN_1853 | 19432 |
| GTCN_364 | 9246 | CTCN_3142 | 19433 |
| CTCN_579 | 9247 | CTCN_3143 | 19434 |
| TTCN_759 | 9248 | CTCN_3144 | 19435 |
| GTCN_365 | 9249 | GTCN_1854 | 19436 |
| ATCN_458 | 9250 | CTCN_3145 | 19437 |
| CTCN_580 | 9251 | CTCN_3146 | 19438 |
| GTCN_366 | 9252 | CTCN_3147 | 19439 |
| CTCN_581 | 9253 | GTCN_1855 | 19440 |
| ATCN_459 | 9254 | CTCN_3148 | 19441 |
| ATCN_460 | 9255 | CTCN_3149 | 19442 |
| TTCN_760 | 9256 | ATCN_2225 | 19443 |
| CTCN_582 | 9257 | ATCN_2226 | 19444 |
| CTCN_583 | 9258 | TTCN_3575 | 19445 |
| GTCN_367 | 9259 | ATCN_2227 | 19446 |
| GTCN_368 | 9260 | ATCN_2228 | 19447 |
| GTCN_369 | 9261 | ATCN_2229 | 19448 |
| TTCN_761 | 9262 | GTCN_1856 | 19449 |
| ATCN_461 | 9263 | CTCN_3150 | 19450 |
| ATCN_462 | 9264 | CTCN_3151 | 19451 |
| ATCN_463 | 9265 | GTCN_1857 | 19452 |
| TTCN_762 | 9266 | TTCN_3576 | 19453 |
| CTCN_584 | 9267 | ATCN_2230 | 19454 |
| TTCN_763 | 9268 | GTCN_1858 | 19455 |
| CTCN_585 | 9269 | CTCN_3152 | 19456 |
| TTCN_764 | 9270 | TTCN_3577 | 19457 |
| GTCN_370 | 9271 | ATCN_2231 | 19458 |
| CTCN_586 | 9272 | CTCN_3153 | 19459 |
| CTCN_587 | 9273 | CTCN_3154 | 19460 |
| CTCN_588 | 9274 | CTCN_3155 | 19461 |
| CTCN_589 | 9275 | TTCN_3578 | 19462 |
| GTCN_371 | 9276 | TTCN_3579 | 19463 |
| ATCN_464 | 9277 | TTCN_3580 | 19464 |
| ATCN_465 | 9278 | ATCN_2232 | 19465 |
| ATCN_466 | 9279 | TTCN_3581 | 19466 |
| ATCN_467 | 9280 | CTCN_3156 | 19467 |
| TTCN_765 | 9281 | CTCN_3157 | 19468 |

FIG. 36 (continued)

| | | | |
|---|---|---|---|
| GTCN_372 | 9282 | ATCN_2233 | 19469 |
| CTCN_590 | 9283 | CTCN_3158 | 19470 |
| TTCN_766 | 9284 | CTCN_3159 | 19471 |
| TTCN_767 | 9285 | TTCN_3582 | 19472 |
| TTCN_768 | 9286 | CTCN_3160 | 19473 |
| CTCN_591 | 9287 | CTCN_3161 | 19474 |
| CTCN_592 | 9288 | CTCN_3162 | 19475 |
| CTCN_593 | 9289 | GTCN_1859 | 19476 |
| CTCN_594 | 9290 | TTCN_3583 | 19477 |
| ATCN_468 | 9291 | TTCN_3584 | 19478 |
| TTCN_769 | 9292 | CTCN_3163 | 19479 |
| GTCN_373 | 9293 | CTCN_3164 | 19480 |
| GTCN_374 | 9294 | GTCN_1860 | 19481 |
| CTCN_595 | 9295 | ATCN_2234 | 19482 |
| ATCN_469 | 9296 | TTCN_3585 | 19483 |
| ATCN_470 | 9297 | TTCN_3586 | 19484 |
| TTCN_770 | 9298 | TTCN_3587 | 19485 |
| GTCN_375 | 9299 | CTCN_3165 | 19486 |
| TTCN_771 | 9300 | GTCN_1861 | 19487 |
| TTCN_772 | 9301 | CTCN_3166 | 19488 |
| TTCN_773 | 9302 | TTCN_3588 | 19489 |
| GTCN_376 | 9303 | CTCN_3167 | 19490 |
| GTCN_377 | 9304 | CTCN_3168 | 19491 |
| TTCN_774 | 9305 | TTCN_3589 | 19492 |
| TTCN_775 | 9306 | CTCN_3169 | 19493 |
| TTCN_776 | 9307 | TTCN_3590 | 19494 |
| CTCN_596 | 9308 | ATCN_2235 | 19495 |
| TTCN_777 | 9309 | GTCN_1862 | 19496 |
| ATCN_471 | 9310 | CTCN_3170 | 19497 |
| TTCN_778 | 9311 | GTCN_1863 | 19498 |
| TTCN_779 | 9312 | CTCN_3171 | 19499 |
| TTCN_780 | 9313 | CTCN_3172 | 19500 |
| GTCN_378 | 9314 | ATCN_2236 | 19501 |
| GTCN_379 | 9315 | TTCN_3591 | 19502 |
| ATCN_472 | 9316 | GTCN_1864 | 19503 |
| TTCN_781 | 9317 | CTCN_3173 | 19504 |
| TTCN_782 | 9318 | ATCN_2237 | 19505 |
| GTCN_380 | 9319 | CTCN_3174 | 19506 |
| CTCN_597 | 9320 | TTCN_3592 | 19507 |
| CTCN_598 | 9321 | CTCN_3175 | 19508 |
| ATCN_473 | 9322 | CTCN_3176 | 19509 |
| CTCN_599 | 9323 | TTCN_3593 | 19510 |
| TTCN_783 | 9324 | TTCN_3594 | 19511 |
| GTCN_381 | 9325 | CTCN_3177 | 19512 |
| CTCN_600 | 9326 | TTCN_3595 | 19513 |
| CTCN_601 | 9327 | CTCN_3178 | 19514 |
| CTCN_602 | 9328 | TTCN_3596 | 19515 |
| GTCN_382 | 9329 | ATCN_2238 | 19516 |
| GTCN_383 | 9330 | CTCN_3179 | 19517 |
| TTCN_784 | 9331 | TTCN_3597 | 19518 |
| TTCN_785 | 9332 | TTCN_3598 | 19519 |
| TTCN_786 | 9333 | TTCN_3599 | 19520 |
| TTCN_787 | 9334 | CTCN_3180 | 19521 |
| TTCN_788 | 9335 | ATCN_2239 | 19522 |
| CTCN_603 | 9336 | CTCN_3181 | 19523 |

| | | | |
|---|---|---|---|
| ATCN_474 | 9337 | GTCN_1865 | 19524 |
| TTCN_789 | 9338 | CTCN_3182 | 19525 |
| GTCN_384 | 9339 | ATCN_2240 | 19526 |
| CTCN_604 | 9340 | CTCN_3183 | 19527 |
| TTCN_790 | 9341 | GTCN_1866 | 19528 |
| ATCN_475 | 9342 | TTCN_3600 | 19529 |
| CTCN_605 | 9343 | ATCN_2241 | 19530 |
| CTCN_606 | 9344 | TTCN_3601 | 19531 |
| CTCN_607 | 9345 | CTCN_3184 | 19532 |
| CTCN_608 | 9346 | ATCN_2242 | 19533 |
| TTCN_791 | 9347 | CTCN_3185 | 19534 |
| CTCN_609 | 9348 | CTCN_3186 | 19535 |
| CTCN_610 | 9349 | CTCN_3187 | 19536 |
| TTCN_792 | 9350 | ATCN_2243 | 19537 |
| CTCN_611 | 9351 | CTCN_3188 | 19538 |
| TTCN_793 | 9352 | ATCN_2244 | 19539 |
| TTCN_794 | 9353 | ATCN_2245 | 19540 |
| CTCN_612 | 9354 | TTCN_3602 | 19541 |
| ATCN_476 | 9355 | CTCN_3189 | 19542 |
| TTCN_795 | 9356 | TTCN_3603 | 19543 |
| GTCN_385 | 9357 | CTCN_3190 | 19544 |
| CTCN_613 | 9358 | GTCN_1867 | 19545 |
| TTCN_796 | 9359 | CTCN_3191 | 19546 |
| CTCN_614 | 9360 | ATCN_2246 | 19547 |
| TTCN_797 | 9361 | TTCN_3604 | 19548 |
| TTCN_798 | 9362 | ATCN_2247 | 19549 |
| GTCN_386 | 9363 | TTCN_3605 | 19550 |
| CTCN_615 | 9364 | CTCN_3192 | 19551 |
| TTCN_799 | 9365 | CTCN_3193 | 19552 |
| GTCN_387 | 9366 | TTCN_3606 | 19553 |
| ATCN_477 | 9367 | TTCN_3607 | 19554 |
| ATCN_478 | 9368 | ATCN_2248 | 19555 |
| TTCN_800 | 9369 | ATCN_2249 | 19556 |
| ATCN_479 | 9370 | TTCN_3608 | 19557 |
| GTCN_388 | 9371 | TTCN_3609 | 19558 |
| ATCN_480 | 9372 | TTCN_3610 | 19559 |
| CTCN_616 | 9373 | CTCN_3194 | 19560 |
| GTCN_389 | 9374 | TTCN_3611 | 19561 |
| CTCN_617 | 9375 | TTCN_3612 | 19562 |
| ATCN_481 | 9376 | TTCN_3613 | 19563 |
| ATCN_482 | 9377 | ATCN_2250 | 19564 |
| CTCN_618 | 9378 | CTCN_3195 | 19565 |
| GTCN_390 | 9379 | ATCN_2251 | 19566 |
| CTCN_619 | 9380 | ATCN_2252 | 19567 |
| GTCN_391 | 9381 | GTCN_1868 | 19568 |
| TTCN_801 | 9382 | CTCN_3196 | 19569 |
| TTCN_802 | 9383 | GTCN_1869 | 19570 |
| CTCN_620 | 9384 | GTCN_1870 | 19571 |
| CTCN_621 | 9385 | ATCN_2253 | 19572 |
| GTCN_392 | 9386 | CTCN_3197 | 19573 |
| TTCN_803 | 9387 | TTCN_3614 | 19574 |
| TTCN_804 | 9388 | ATCN_2254 | 19575 |
| ATCN_483 | 9389 | TTCN_3615 | 19576 |
| TTCN_805 | 9390 | CTCN_3198 | 19577 |
| TTCN_806 | 9391 | GTCN_1871 | 19578 |

FIG. 36 (continued)

| | | | |
|---|---|---|---|
| TTCN_807 | 9392 | GTCN_1872 | 19579 |
| ATCN_484 | 9393 | CTCN_3199 | 19580 |
| TTCN_808 | 9394 | GTCN_1873 | 19581 |
| ATCN_485 | 9395 | ATCN_2255 | 19582 |
| CTCN_622 | 9396 | ATCN_2256 | 19583 |
| ATCN_486 | 9397 | GTCN_1874 | 19584 |
| TTCN_809 | 9398 | CTCN_3200 | 19585 |
| GTCN_393 | 9399 | CTCN_3201 | 19586 |
| TTCN_810 | 9400 | TTCN_3616 | 19587 |
| CTCN_623 | 9401 | CTCN_3202 | 19588 |
| TTCN_811 | 9402 | ATCN_2257 | 19589 |
| GTCN_394 | 9403 | ATCN_2258 | 19590 |
| GTCN_395 | 9404 | GTCN_1875 | 19591 |
| GTCN_396 | 9405 | ATCN_2259 | 19592 |
| TTCN_812 | 9406 | ATCN_2260 | 19593 |
| TTCN_813 | 9407 | CTCN_3203 | 19594 |
| TTCN_814 | 9408 | GTCN_1876 | 19595 |
| CTCN_624 | 9409 | ATCN_2261 | 19596 |
| ATCN_487 | 9410 | ATCN_2262 | 19597 |
| GTCN_397 | 9411 | TTCN_3617 | 19598 |
| GTCN_398 | 9412 | GTCN_1877 | 19599 |
| TTCN_815 | 9413 | CTCN_3204 | 19600 |
| ATCN_488 | 9414 | CTCN_3205 | 19601 |
| TTCN_816 | 9415 | GTCN_1878 | 19602 |
| TTCN_817 | 9416 | CTCN_3206 | 19603 |
| TTCN_818 | 9417 | ATCN_2263 | 19604 |
| TTCN_819 | 9418 | GTCN_1879 | 19605 |
| GTCN_399 | 9419 | GTCN_1880 | 19606 |
| TTCN_820 | 9420 | GTCN_1881 | 19607 |
| GTCN_400 | 9421 | TTCN_3618 | 19608 |
| ATCN_489 | 9422 | ATCN_2264 | 19609 |
| GTCN_401 | 9423 | ATCN_2265 | 19610 |
| CTCN_625 | 9424 | TTCN_3619 | 19611 |
| ATCN_490 | 9425 | CTCN_3207 | 19612 |
| TTCN_821 | 9426 | GTCN_1882 | 19613 |
| CTCN_626 | 9427 | ATCN_2266 | 19614 |
| ATCN_491 | 9428 | TTCN_3620 | 19615 |
| ATCN_492 | 9429 | ATCN_2267 | 19616 |
| CTCN_627 | 9430 | ATCN_2268 | 19617 |
| CTCN_628 | 9431 | GTCN_1883 | 19618 |
| GTCN_402 | 9432 | GTCN_1884 | 19619 |
| GTCN_403 | 9433 | CTCN_3208 | 19620 |
| GTCN_404 | 9434 | GTCN_1885 | 19621 |
| TTCN_822 | 9435 | GTCN_1886 | 19622 |
| TTCN_823 | 9436 | TTCN_3621 | 19623 |
| TTCN_824 | 9437 | CTCN_3209 | 19624 |
| TTCN_825 | 9438 | CTCN_3210 | 19625 |
| GTCN_405 | 9439 | ATCN_2269 | 19626 |
| ATCN_493 | 9440 | GTCN_1887 | 19627 |
| CTCN_629 | 9441 | TTCN_3622 | 19628 |
| ATCN_494 | 9442 | TTCN_3623 | 19629 |
| CTCN_630 | 9443 | TTCN_3624 | 19630 |
| ATCN_495 | 9444 | GTCN_1888 | 19631 |
| TTCN_826 | 9445 | TTCN_3625 | 19632 |
| GTCN_406 | 9446 | TTCN_3626 | 19633 |

| | | | |
|---|---|---|---|
| GTCN_407 | 9447 | TTCN_3627 | 19634 |
| ATCN_496 | 9448 | TTCN_3628 | 19635 |
| TTCN_827 | 9449 | TTCN_3629 | 19636 |
| ATCN_497 | 9450 | TTCN_3630 | 19637 |
| TTCN_828 | 9451 | TTCN_3631 | 19638 |
| TTCN_829 | 9452 | CTCN_3211 | 19639 |
| GTCN_408 | 9453 | CTCN_3212 | 19640 |
| TTCN_830 | 9454 | GTCN_1889 | 19641 |
| GTCN_409 | 9455 | ATCN_2270 | 19642 |
| TTCN_831 | 9456 | GTCN_1890 | 19643 |
| TTCN_832 | 9457 | CTCN_3213 | 19644 |
| TTCN_833 | 9458 | CTCN_3214 | 19645 |
| TTCN_834 | 9459 | ATCN_2271 | 19646 |
| GTCN_410 | 9460 | GTCN_1891 | 19647 |
| CTCN_631 | 9461 | CTCN_3215 | 19648 |
| TTCN_835 | 9462 | ATCN_2272 | 19649 |
| TTCN_836 | 9463 | CTCN_3216 | 19650 |
| ATCN_498 | 9464 | TTCN_3632 | 19651 |
| CTCN_632 | 9465 | CTCN_3217 | 19652 |
| GTCN_411 | 9466 | TTCN_3633 | 19653 |
| CTCN_633 | 9467 | GTCN_1892 | 19654 |
| TTCN_837 | 9468 | CTCN_3218 | 19655 |
| CTCN_634 | 9469 | TTCN_3634 | 19656 |
| TTCN_838 | 9470 | GTCN_1893 | 19657 |
| ATCN_499 | 9471 | TTCN_3635 | 19658 |
| CTCN_635 | 9472 | ATCN_2273 | 19659 |
| TTCN_839 | 9473 | TTCN_3636 | 19660 |
| CTCN_636 | 9474 | CTCN_3219 | 19661 |
| GTCN_412 | 9475 | TTCN_3637 | 19662 |
| CTCN_637 | 9476 | CTCN_3220 | 19663 |
| TTCN_840 | 9477 | CTCN_3221 | 19664 |
| CTCN_638 | 9478 | CTCN_3222 | 19665 |
| TTCN_841 | 9479 | GTCN_1894 | 19666 |
| ATCN_500 | 9480 | CTCN_3223 | 19667 |
| TTCN_842 | 9481 | CTCN_3224 | 19668 |
| ATCN_501 | 9482 | CTCN_3225 | 19669 |
| TTCN_843 | 9483 | TTCN_3638 | 19670 |
| CTCN_639 | 9484 | CTCN_3226 | 19671 |
| CTCN_640 | 9485 | GTCN_1895 | 19672 |
| TTCN_844 | 9486 | CTCN_3227 | 19673 |
| CTCN_641 | 9487 | TTCN_3639 | 19674 |
| TTCN_845 | 9488 | CTCN_3228 | 19675 |
| TTCN_846 | 9489 | TTCN_3640 | 19676 |
| TTCN_847 | 9490 | TTCN_3641 | 19677 |
| TTCN_848 | 9491 | CTCN_3229 | 19678 |
| CTCN_642 | 9492 | CTCN_3230 | 19679 |
| TTCN_849 | 9493 | CTCN_3231 | 19680 |
| ATCN_502 | 9494 | TTCN_3642 | 19681 |
| CTCN_643 | 9495 | CTCN_3232 | 19682 |
| TTCN_850 | 9496 | GTCN_1896 | 19683 |
| ATCN_503 | 9497 | ATCN_2274 | 19684 |
| CTCN_644 | 9498 | TTCN_3643 | 19685 |
| TTCN_851 | 9499 | CTCN_3233 | 19686 |
| ATCN_504 | 9500 | GTCN_1897 | 19687 |
| CTCN_645 | 9501 | GTCN_1898 | 19688 |

FIG. 36 (continued)

| | | | |
|---|---|---|---|
| TTCN_852 | 9502 | CTCN_3234 | 19689 |
| ATCN_505 | 9503 | GTCN_1899 | 19690 |
| TTCN_853 | 9504 | CTCN_3235 | 19691 |
| CTCN_646 | 9505 | ATCN_2275 | 19692 |
| ATCN_506 | 9506 | ATCN_2276 | 19693 |
| GTCN_413 | 9507 | TTCN_3644 | 19694 |
| ATCN_507 | 9508 | TTCN_3645 | 19695 |
| TTCN_854 | 9509 | CTCN_3236 | 19696 |
| TTCN_855 | 9510 | TTCN_3646 | 19697 |
| ATCN_508 | 9511 | GTCN_1900 | 19698 |
| TTCN_856 | 9512 | ATCN_2277 | 19699 |
| GTCN_414 | 9513 | CTCN_3237 | 19700 |
| TTCN_857 | 9514 | CTCN_3238 | 19701 |
| GTCN_415 | 9515 | TTCN_3647 | 19702 |
| TTCN_858 | 9516 | TTCN_3648 | 19703 |
| TTCN_859 | 9517 | CTCN_3239 | 19704 |
| CTCN_647 | 9518 | ATCN_2278 | 19705 |
| CTCN_648 | 9519 | GTCN_1901 | 19706 |
| TTCN_860 | 9520 | TTCN_3649 | 19707 |
| TTCN_861 | 9521 | GTCN_1902 | 19708 |
| TTCN_862 | 9522 | TTCN_3650 | 19709 |
| GTCN_416 | 9523 | ATCN_2279 | 19710 |
| CTCN_649 | 9524 | TTCN_3651 | 19711 |
| CTCN_650 | 9525 | CTCN_3240 | 19712 |
| GTCN_417 | 9526 | CTCN_3241 | 19713 |
| CTCN_651 | 9527 | TTCN_3652 | 19714 |
| TTCN_863 | 9528 | TTCN_3653 | 19715 |
| GTCN_418 | 9529 | GTCN_1903 | 19716 |
| GTCN_419 | 9530 | GTCN_1904 | 19717 |
| GTCN_420 | 9531 | TTCN_3654 | 19718 |
| ATCN_509 | 9532 | CTCN_3242 | 19719 |
| ATCN_510 | 9533 | CTCN_3243 | 19720 |
| ATCN_511 | 9534 | TTCN_3655 | 19721 |
| TTCN_864 | 9535 | TTCN_3656 | 19722 |
| TTCN_865 | 9536 | TTCN_3657 | 19723 |
| TTCN_866 | 9537 | ATCN_2280 | 19724 |
| TTCN_867 | 9538 | CTCN_3244 | 19725 |
| ATCN_512 | 9539 | CTCN_3245 | 19726 |
| TTCN_868 | 9540 | GTCN_1905 | 19727 |
| TTCN_869 | 9541 | CTCN_3246 | 19728 |
| TTCN_870 | 9542 | GTCN_1906 | 19729 |
| CTCN_652 | 9543 | CTCN_3247 | 19730 |
| CTCN_653 | 9544 | CTCN_3248 | 19731 |
| TTCN_871 | 9545 | CTCN_3249 | 19732 |
| ATCN_513 | 9546 | TTCN_3658 | 19733 |
| TTCN_872 | 9547 | CTCN_3250 | 19734 |
| CTCN_654 | 9548 | TTCN_3659 | 19735 |
| ATCN_514 | 9549 | CTCN_3251 | 19736 |
| CTCN_655 | 9550 | CTCN_3252 | 19737 |
| TTCN_873 | 9551 | TTCN_3660 | 19738 |
| CTCN_656 | 9552 | TTCN_3661 | 19739 |
| ATCN_515 | 9553 | CTCN_3253 | 19740 |
| TTCN_874 | 9554 | GTCN_1907 | 19741 |
| CTCN_657 | 9555 | TTCN_3662 | 19742 |
| ATCN_516 | 9556 | CTCN_3254 | 19743 |

| | | | |
|---|---|---|---|
| TTCN_875 | 9557 | CTCN_3255 | 19744 |
| GTCN_421 | 9558 | GTCN_1908 | 19745 |
| CTCN_658 | 9559 | TTCN_3663 | 19746 |
| CTCN_659 | 9560 | GTCN_1909 | 19747 |
| ATCN_517 | 9561 | TTCN_3664 | 19748 |
| TTCN_876 | 9562 | ATCN_2281 | 19749 |
| CTCN_660 | 9563 | ATCN_2282 | 19750 |
| ATCN_518 | 9564 | TTCN_3665 | 19751 |
| TTCN_877 | 9565 | CTCN_3256 | 19752 |
| TTCN_878 | 9566 | GTCN_1910 | 19753 |
| ATCN_519 | 9567 | TTCN_3666 | 19754 |
| TTCN_879 | 9568 | CTCN_3257 | 19755 |
| ATCN_520 | 9569 | ATCN_2283 | 19756 |
| ATCN_521 | 9570 | CTCN_3258 | 19757 |
| CTCN_661 | 9571 | CTCN_3259 | 19758 |
| CTCN_662 | 9572 | CTCN_3260 | 19759 |
| ATCN_522 | 9573 | ATCN_2284 | 19760 |
| GTCN_422 | 9574 | CTCN_3261 | 19761 |
| GTCN_423 | 9575 | CTCN_3262 | 19762 |
| CTCN_663 | 9576 | CTCN_3263 | 19763 |
| GTCN_424 | 9577 | TTCN_3667 | 19764 |
| ATCN_523 | 9578 | ATCN_2285 | 19765 |
| GTCN_425 | 9579 | TTCN_3668 | 19766 |
| TTCN_880 | 9580 | CTCN_3264 | 19767 |
| CTCN_664 | 9581 | CTCN_3265 | 19768 |
| TTCN_881 | 9582 | CTCN_3266 | 19769 |
| GTCN_426 | 9583 | CTCN_3267 | 19770 |
| CTCN_665 | 9584 | CTCN_3268 | 19771 |
| TTCN_882 | 9585 | ATCN_2286 | 19772 |
| GTCN_427 | 9586 | CTCN_3269 | 19773 |
| CTCN_666 | 9587 | GTCN_1911 | 19774 |
| GTCN_428 | 9588 | TTCN_3669 | 19775 |
| TTCN_883 | 9589 | GTCN_1912 | 19776 |
| TTCN_884 | 9590 | CTCN_3270 | 19777 |
| ATCN_524 | 9591 | TTCN_3670 | 19778 |
| TTCN_885 | 9592 | CTCN_3271 | 19779 |
| CTCN_667 | 9593 | GTCN_1913 | 19780 |
| TTCN_886 | 9594 | CTCN_3272 | 19781 |
| TTCN_887 | 9595 | ATCN_2287 | 19782 |
| CTCN_668 | 9596 | ATCN_2288 | 19783 |
| TTCN_888 | 9597 | TTCN_3671 | 19784 |
| TTCN_889 | 9598 | CTCN_3273 | 19785 |
| CTCN_669 | 9599 | ATCN_2289 | 19786 |
| TTCN_890 | 9600 | CTCN_3274 | 19787 |
| TTCN_891 | 9601 | TTCN_3672 | 19788 |
| ATCN_525 | 9602 | ATCN_2290 | 19789 |
| GTCN_429 | 9603 | ATCN_2291 | 19790 |
| ATCN_526 | 9604 | ATCN_2292 | 19791 |
| TTCN_892 | 9605 | CTCN_3275 | 19792 |
| ATCN_527 | 9606 | CTCN_3276 | 19793 |
| TTCN_893 | 9607 | CTCN_3277 | 19794 |
| CTCN_670 | 9608 | CTCN_3278 | 19795 |
| ATCN_528 | 9609 | TTCN_3673 | 19796 |
| TTCN_894 | 9610 | TTCN_3674 | 19797 |
| TTCN_895 | 9611 | CTCN_3279 | 19798 |

FIG. 36 (continued)

| | | | |
|---|---|---|---|
| CTCN_671 | 9612 | CTCN_3280 | 19799 |
| ATCN_529 | 9613 | CTCN_3281 | 19800 |
| TTCN_896 | 9614 | ATCN_2293 | 19801 |
| TTCN_897 | 9615 | ATCN_2294 | 19802 |
| GTCN_430 | 9616 | CTCN_3282 | 19803 |
| TTCN_898 | 9617 | CTCN_3283 | 19804 |
| CTCN_672 | 9618 | TTCN_3675 | 19805 |
| CTCN_673 | 9619 | TTCN_3676 | 19806 |
| TTCN_899 | 9620 | TTCN_3677 | 19807 |
| CTCN_674 | 9621 | ATCN_2295 | 19808 |
| TTCN_900 | 9622 | CTCN_3284 | 19809 |
| CTCN_675 | 9623 | TTCN_3678 | 19810 |
| ATCN_530 | 9624 | CTCN_3285 | 19811 |
| TTCN_901 | 9625 | ATCN_2296 | 19812 |
| CTCN_676 | 9626 | ATCN_2297 | 19813 |
| ATCN_531 | 9627 | TTCN_3679 | 19814 |
| TTCN_902 | 9628 | ATCN_2298 | 19815 |
| TTCN_903 | 9629 | CTCN_3286 | 19816 |
| TTCN_904 | 9630 | CTCN_3287 | 19817 |
| TTCN_905 | 9631 | GTCN_1914 | 19818 |
| CTCN_677 | 9632 | ATCN_2299 | 19819 |
| CTCN_678 | 9633 | TTCN_3680 | 19820 |
| TTCN_906 | 9634 | TTCN_3681 | 19821 |
| TTCN_907 | 9635 | TTCN_3682 | 19822 |
| GTCN_431 | 9636 | ATCN_2300 | 19823 |
| TTCN_908 | 9637 | ATCN_2301 | 19824 |
| TTCN_909 | 9638 | TTCN_3683 | 19825 |
| CTCN_679 | 9639 | TTCN_3684 | 19826 |
| GTCN_432 | 9640 | CTCN_3288 | 19827 |
| CTCN_680 | 9641 | GTCN_1915 | 19828 |
| CTCN_681 | 9642 | CTCN_3289 | 19829 |
| ATCN_532 | 9643 | CTCN_3290 | 19830 |
| CTCN_682 | 9644 | GTCN_1916 | 19831 |
| ATCN_533 | 9645 | CTCN_3291 | 19832 |
| ATCN_534 | 9646 | TTCN_3685 | 19833 |
| ATCN_535 | 9647 | TTCN_3686 | 19834 |
| GTCN_433 | 9648 | CTCN_3292 | 19835 |
| CTCN_683 | 9649 | GTCN_1917 | 19836 |
| TTCN_910 | 9650 | ATCN_2302 | 19837 |
| ATCN_536 | 9651 | GTCN_1918 | 19838 |
| CTCN_684 | 9652 | CTCN_3293 | 19839 |
| ATCN_537 | 9653 | TTCN_3687 | 19840 |
| CTCN_685 | 9654 | GTCN_1919 | 19841 |
| GTCN_434 | 9655 | CTCN_3294 | 19842 |
| TTCN_911 | 9656 | CTCN_3295 | 19843 |
| ATCN_538 | 9657 | ATCN_2303 | 19844 |
| ATCN_539 | 9658 | GTCN_1920 | 19845 |
| CTCN_686 | 9659 | CTCN_3296 | 19846 |
| ATCN_540 | 9660 | CTCN_3297 | 19847 |
| TTCN_912 | 9661 | CTCN_3298 | 19848 |
| ATCN_541 | 9662 | TTCN_3688 | 19849 |
| TTCN_913 | 9663 | CTCN_3299 | 19850 |
| TTCN_914 | 9664 | ATCN_2304 | 19851 |
| TTCN_915 | 9665 | ATCN_2305 | 19852 |
| GTCN_435 | 9666 | CTCN_3300 | 19853 |

| | | | |
|---|---|---|---|
| GTCN_436 | 9667 | CTCN_3301 | 19854 |
| GTCN_437 | 9668 | CTCN_3302 | 19855 |
| ATCN_542 | 9669 | TTCN_3689 | 19856 |
| CTCN_687 | 9670 | TTCN_3690 | 19857 |
| CTCN_688 | 9671 | TTCN_3691 | 19858 |
| TTCN_916 | 9672 | CTCN_3303 | 19859 |
| TTCN_917 | 9673 | GTCN_1921 | 19860 |
| CTCN_689 | 9674 | CTCN_3304 | 19861 |
| TTCN_918 | 9675 | CTCN_3305 | 19862 |
| ATCN_543 | 9676 | GTCN_1922 | 19863 |
| CTCN_690 | 9677 | CTCN_3306 | 19864 |
| CTCN_691 | 9678 | ATCN_2306 | 19865 |
| GTCN_438 | 9679 | TTCN_3692 | 19866 |
| GTCN_439 | 9680 | TTCN_3693 | 19867 |
| CTCN_692 | 9681 | GTCN_1923 | 19868 |
| GTCN_440 | 9682 | TTCN_3694 | 19869 |
| ATCN_544 | 9683 | TTCN_3695 | 19870 |
| TTCN_919 | 9684 | TTCN_3696 | 19871 |
| ATCN_545 | 9685 | ATCN_2307 | 19872 |
| CTCN_693 | 9686 | GTCN_1924 | 19873 |
| CTCN_694 | 9687 | GTCN_1925 | 19874 |
| CTCN_695 | 9688 | CTCN_3307 | 19875 |
| ATCN_546 | 9689 | TTCN_3697 | 19876 |
| TTCN_920 | 9690 | TTCN_3698 | 19877 |
| TTCN_921 | 9691 | GTCN_1926 | 19878 |
| TTCN_922 | 9692 | GTCN_1927 | 19879 |
| TTCN_923 | 9693 | ATCN_2308 | 19880 |
| ATCN_547 | 9694 | TTCN_3699 | 19881 |
| ATCN_548 | 9695 | ATCN_2309 | 19882 |
| TTCN_924 | 9696 | TTCN_3700 | 19883 |
| ATCN_549 | 9697 | ATCN_2310 | 19884 |
| GTCN_441 | 9698 | CTCN_3308 | 19885 |
| GTCN_442 | 9699 | CTCN_3309 | 19886 |
| CTCN_696 | 9700 | TTCN_3701 | 19887 |
| TTCN_925 | 9701 | TTCN_3702 | 19888 |
| CTCN_697 | 9702 | ATCN_2311 | 19889 |
| TTCN_926 | 9703 | TTCN_3703 | 19890 |
| CTCN_698 | 9704 | TTCN_3704 | 19891 |
| CTCN_699 | 9705 | ATCN_2312 | 19892 |
| ATCN_550 | 9706 | CTCN_3310 | 19893 |
| ATCN_551 | 9707 | TTCN_3705 | 19894 |
| GTCN_443 | 9708 | TTCN_3706 | 19895 |
| TTCN_927 | 9709 | TTCN_3707 | 19896 |
| CTCN_700 | 9710 | GTCN_1928 | 19897 |
| TTCN_928 | 9711 | CTCN_3311 | 19898 |
| TTCN_929 | 9712 | GTCN_1929 | 19899 |
| TTCN_930 | 9713 | CTCN_3312 | 19900 |
| CTCN_701 | 9714 | CTCN_3313 | 19901 |
| GTCN_444 | 9715 | TTCN_3708 | 19902 |
| CTCN_702 | 9716 | ATCN_2313 | 19903 |
| ATCN_552 | 9717 | CTCN_3314 | 19904 |
| ATCN_553 | 9718 | CTCN_3315 | 19905 |
| GTCN_445 | 9719 | ATCN_2314 | 19906 |
| TTCN_931 | 9720 | CTCN_3316 | 19907 |
| CTCN_703 | 9721 | GTCN_1930 | 19908 |

FIG. 36 (continued)

| | | | |
|---|---|---|---|
| CTCN_704 | 9722 | TTCN_3709 | 19909 |
| CTCN_705 | 9723 | TTCN_3710 | 19910 |
| CTCN_706 | 9724 | CTCN_3317 | 19911 |
| TTCN_932 | 9725 | ATCN_2315 | 19912 |
| CTCN_707 | 9726 | CTCN_3318 | 19913 |
| TTCN_933 | 9727 | TTCN_3711 | 19914 |
| CTCN_708 | 9728 | TTCN_3712 | 19915 |
| TTCN_934 | 9729 | GTCN_1931 | 19916 |
| TTCN_935 | 9730 | GTCN_1932 | 19917 |
| GTCN_446 | 9731 | CTCN_3319 | 19918 |
| ATCN_554 | 9732 | CTCN_3320 | 19919 |
| GTCN_447 | 9733 | CTCN_3321 | 19920 |
| TTCN_936 | 9734 | CTCN_3322 | 19921 |
| CTCN_709 | 9735 | TTCN_3713 | 19922 |
| GTCN_448 | 9736 | TTCN_3714 | 19923 |
| TTCN_937 | 9737 | CTCN_3323 | 19924 |
| TTCN_938 | 9738 | GTCN_1933 | 19925 |
| GTCN_449 | 9739 | CTCN_3324 | 19926 |
| GTCN_450 | 9740 | CTCN_3325 | 19927 |
| CTCN_710 | 9741 | CTCN_3326 | 19928 |
| CTCN_711 | 9742 | CTCN_3327 | 19929 |
| CTCN_712 | 9743 | CTCN_3328 | 19930 |
| GTCN_451 | 9744 | TTCN_3715 | 19931 |
| CTCN_713 | 9745 | TTCN_3716 | 19932 |
| GTCN_452 | 9746 | TTCN_3717 | 19933 |
| CTCN_714 | 9747 | CTCN_3329 | 19934 |
| TTCN_939 | 9748 | GTCN_1934 | 19935 |
| GTCN_453 | 9749 | ATCN_2316 | 19936 |
| TTCN_940 | 9750 | TTCN_3718 | 19937 |
| GTCN_454 | 9751 | ATCN_2317 | 19938 |
| TTCN_941 | 9752 | ATCN_2318 | 19939 |
| CTCN_715 | 9753 | ATCN_2319 | 19940 |
| TTCN_942 | 9754 | CTCN_3330 | 19941 |
| CTCN_716 | 9755 | GTCN_1935 | 19942 |
| GTCN_455 | 9756 | CTCN_3331 | 19943 |
| CTCN_717 | 9757 | TTCN_3719 | 19944 |
| TTCN_943 | 9758 | TTCN_3720 | 19945 |
| CTCN_718 | 9759 | GTCN_1936 | 19946 |
| TTCN_944 | 9760 | CTCN_3332 | 19947 |
| ATCN_555 | 9761 | GTCN_1937 | 19948 |
| TTCN_945 | 9762 | GTCN_1938 | 19949 |
| ATCN_556 | 9763 | CTCN_3333 | 19950 |
| TTCN_946 | 9764 | CTCN_3334 | 19951 |
| ATCN_557 | 9765 | TTCN_3721 | 19952 |
| TTCN_947 | 9766 | ATCN_2320 | 19953 |
| ATCN_558 | 9767 | CTCN_3335 | 19954 |
| TTCN_948 | 9768 | CTCN_3336 | 19955 |
| TTCN_949 | 9769 | TTCN_3722 | 19956 |
| CTCN_719 | 9770 | TTCN_3723 | 19957 |
| TTCN_950 | 9771 | CTCN_3337 | 19958 |
| TTCN_951 | 9772 | TTCN_3724 | 19959 |
| ATCN_559 | 9773 | CTCN_3338 | 19960 |
| CTCN_720 | 9774 | GTCN_1939 | 19961 |
| TTCN_952 | 9775 | ATCN_2321 | 19962 |
| ATCN_560 | 9776 | TTCN_3725 | 19963 |

| | | | |
|---|---|---|---|
| TTCN_953 | 9777 | TTCN_3726 | 19964 |
| TTCN_954 | 9778 | CTCN_3339 | 19965 |
| TTCN_955 | 9779 | ATCN_2322 | 19966 |
| TTCN_956 | 9780 | GTCN_1940 | 19967 |
| ATCN_561 | 9781 | CTCN_3340 | 19968 |
| TTCN_957 | 9782 | ATCN_2323 | 19969 |
| ATCN_562 | 9783 | ATCN_2324 | 19970 |
| GTCN_456 | 9784 | TTCN_3727 | 19971 |
| TTCN_958 | 9785 | CTCN_3341 | 19972 |
| ATCN_563 | 9786 | ATCN_2325 | 19973 |
| TTCN_959 | 9787 | TTCN_3728 | 19974 |
| ATCN_564 | 9788 | CTCN_3342 | 19975 |
| ATCN_565 | 9789 | TTCN_3729 | 19976 |
| ATCN_566 | 9790 | CTCN_3343 | 19977 |
| GTCN_457 | 9791 | GTCN_1941 | 19978 |
| CTCN_721 | 9792 | GTCN_1942 | 19979 |
| TTCN_960 | 9793 | TTCN_3730 | 19980 |
| CTCN_722 | 9794 | GTCN_1943 | 19981 |
| CTCN_723 | 9795 | TTCN_3731 | 19982 |
| TTCN_961 | 9796 | TTCN_3732 | 19983 |
| GTCN_458 | 9797 | TTCN_3733 | 19984 |
| ATCN_567 | 9798 | TTCN_3734 | 19985 |
| TTCN_962 | 9799 | ATCN_2326 | 19986 |
| CTCN_724 | 9800 | ATCN_2327 | 19987 |
| CTCN_725 | 9801 | TTCN_3735 | 19988 |
| ATCN_568 | 9802 | GTCN_1944 | 19989 |
| GTCN_459 | 9803 | CTCN_3344 | 19990 |
| GTCN_460 | 9804 | CTCN_3345 | 19991 |
| GTCN_461 | 9805 | CTCN_3346 | 19992 |
| TTCN_963 | 9806 | CTCN_3347 | 19993 |
| CTCN_726 | 9807 | TTCN_3736 | 19994 |
| TTCN_964 | 9808 | GTCN_1945 | 19995 |
| TTCN_965 | 9809 | GTCN_1946 | 19996 |
| TTCN_966 | 9810 | CTCN_3348 | 19997 |
| TTCN_967 | 9811 | ATCN_2328 | 19998 |
| CTCN_727 | 9812 | TTCN_3737 | 19999 |
| TTCN_968 | 9813 | TTCN_3738 | 20000 |
| CTCN_728 | 9814 | GTCN_1947 | 20001 |
| GTCN_462 | 9815 | ATCN_2329 | 20002 |
| TTCN_969 | 9816 | TTCN_3739 | 20003 |
| TTCN_970 | 9817 | TTCN_3740 | 20004 |
| CTCN_729 | 9818 | ATCN_2330 | 20005 |
| CTCN_730 | 9819 | CTCN_3349 | 20006 |
| TTCN_971 | 9820 | CTCN_3350 | 20007 |
| ATCN_569 | 9821 | TTCN_3741 | 20008 |
| TTCN_972 | 9822 | ATCN_2331 | 20009 |
| CTCN_731 | 9823 | CTCN_3351 | 20010 |
| TTCN_973 | 9824 | GTCN_1948 | 20011 |
| TTCN_974 | 9825 | GTCN_1949 | 20012 |
| TTCN_975 | 9826 | CTCN_3352 | 20013 |
| TTCN_976 | 9827 | CTCN_3353 | 20014 |
| ATCN_570 | 9828 | TTCN_3742 | 20015 |
| CTCN_732 | 9829 | CTCN_3354 | 20016 |
| TTCN_977 | 9830 | GTCN_1950 | 20017 |
| TTCN_978 | 9831 | GTCN_1951 | 20018 |

FIG. 36 (continued)

| | | | |
|---|---|---|---|
| ATCN_571 | 9832 | CTCN_3355 | 20019 |
| ATCN_572 | 9833 | ATCN_2332 | 20020 |
| ATCN_573 | 9834 | CTCN_3356 | 20021 |
| CTCN_733 | 9835 | CTCN_3357 | 20022 |
| ATCN_574 | 9836 | CTCN_3358 | 20023 |
| TTCN_979 | 9837 | CTCN_3359 | 20024 |
| CTCN_734 | 9838 | GTCN_1952 | 20025 |
| GTCN_463 | 9839 | GTCN_1953 | 20026 |
| TTCN_980 | 9840 | CTCN_3360 | 20027 |
| TTCN_981 | 9841 | CTCN_3361 | 20028 |
| ATCN_575 | 9842 | CTCN_3362 | 20029 |
| TTCN_982 | 9843 | TTCN_3743 | 20030 |
| ATCN_576 | 9844 | TTCN_3744 | 20031 |
| ATCN_577 | 9845 | TTCN_3745 | 20032 |
| CTCN_735 | 9846 | CTCN_3363 | 20033 |
| TTCN_983 | 9847 | TTCN_3746 | 20034 |
| TTCN_984 | 9848 | ATCN_2333 | 20035 |
| TTCN_985 | 9849 | CTCN_3364 | 20036 |
| ATCN_578 | 9850 | TTCN_3747 | 20037 |
| CTCN_736 | 9851 | CTCN_3365 | 20038 |
| ATCN_579 | 9852 | TTCN_3748 | 20039 |
| ATCN_580 | 9853 | CTCN_3366 | 20040 |
| GTCN_464 | 9854 | CTCN_3367 | 20041 |
| TTCN_986 | 9855 | TTCN_3749 | 20042 |
| TTCN_987 | 9856 | TTCN_3750 | 20043 |
| ATCN_581 | 9857 | TTCN_3751 | 20044 |
| CTCN_737 | 9858 | TTCN_3752 | 20045 |
| TTCN_988 | 9859 | TTCN_3753 | 20046 |
| ATCN_582 | 9860 | CTCN_3368 | 20047 |
| GTCN_465 | 9861 | CTCN_3369 | 20048 |
| GTCN_466 | 9862 | CTCN_3370 | 20049 |
| GTCN_467 | 9863 | TTCN_3754 | 20050 |
| GTCN_468 | 9864 | CTCN_3371 | 20051 |
| ATCN_583 | 9865 | CTCN_3372 | 20052 |
| CTCN_738 | 9866 | GTCN_1954 | 20053 |
| CTCN_739 | 9867 | TTCN_3755 | 20054 |
| ATCN_584 | 9868 | CTCN_3373 | 20055 |
| TTCN_989 | 9869 | CTCN_3374 | 20056 |
| TTCN_990 | 9870 | CTCN_3375 | 20057 |
| TTCN_991 | 9871 | CTCN_3376 | 20058 |
| TTCN_992 | 9872 | GTCN_1955 | 20059 |
| TTCN_993 | 9873 | CTCN_3377 | 20060 |
| CTCN_740 | 9874 | CTCN_3378 | 20061 |
| TTCN_994 | 9875 | CTCN_3379 | 20062 |
| TTCN_995 | 9876 | CTCN_3380 | 20063 |
| TTCN_996 | 9877 | CTCN_3381 | 20064 |
| CTCN_741 | 9878 | CTCN_3382 | 20065 |
| CTCN_742 | 9879 | TTCN_3756 | 20066 |
| TTCN_997 | 9880 | TTCN_3757 | 20067 |
| TTCN_998 | 9881 | GTCN_1956 | 20068 |
| TTCN_999 | 9882 | CTCN_3383 | 20069 |
| CTCN_743 | 9883 | ATCN_2334 | 20070 |
| ATCN_585 | 9884 | CTCN_3384 | 20071 |
| GTCN_469 | 9885 | GTCN_1957 | 20072 |
| CTCN_744 | 9886 | CTCN_3385 | 20073 |

| | | | |
|---|---|---|---|
| GTCN_470 | 9887 | CTCN_3386 | 20074 |
| GTCN_471 | 9888 | CTCN_3387 | 20075 |
| GTCN_472 | 9889 | GTCN_1958 | 20076 |
| CTCN_745 | 9890 | GTCN_1959 | 20077 |
| CTCN_746 | 9891 | GTCN_1960 | 20078 |
| TTCN_1000 | 9892 | GTCN_1961 | 20079 |
| ATCN_586 | 9893 | ATCN_2335 | 20080 |
| TTCN_1001 | 9894 | TTCN_3758 | 20081 |
| CTCN_747 | 9895 | ATCN_2336 | 20082 |
| TTCN_1002 | 9896 | ATCN_2337 | 20083 |
| CTCN_748 | 9897 | CTCN_3388 | 20084 |
| TTCN_1003 | 9898 | CTCN_3389 | 20085 |
| TTCN_1004 | 9899 | ATCN_2338 | 20086 |
| TTCN_1005 | 9900 | CTCN_3390 | 20087 |
| ATCN_587 | 9901 | CTCN_3391 | 20088 |
| GTCN_473 | 9902 | CTCN_3392 | 20089 |
| CTCN_749 | 9903 | CTCN_3393 | 20090 |
| CTCN_750 | 9904 | CTCN_3394 | 20091 |
| GTCN_474 | 9905 | CTCN_3395 | 20092 |
| CTCN_751 | 9906 | GTCN_1962 | 20093 |
| TTCN_1006 | 9907 | CTCN_3396 | 20094 |
| CTCN_752 | 9908 | GTCN_1963 | 20095 |
| TTCN_1007 | 9909 | CTCN_3397 | 20096 |
| CTCN_753 | 9910 | TTCN_3759 | 20097 |
| CTCN_754 | 9911 | GTCN_1964 | 20098 |
| TTCN_1008 | 9912 | CTCN_3398 | 20099 |
| TTCN_1009 | 9913 | CTCN_3399 | 20100 |
| CTCN_755 | 9914 | ATCN_2339 | 20101 |
| TTCN_1010 | 9915 | CTCN_3400 | 20102 |
| ATCN_588 | 9916 | ATCN_2340 | 20103 |
| TTCN_1011 | 9917 | ATCN_2341 | 20104 |
| TTCN_1012 | 9918 | CTCN_3401 | 20105 |
| ATCN_589 | 9919 | TTCN_3760 | 20106 |
| GTCN_475 | 9920 | CTCN_3402 | 20107 |
| TTCN_1013 | 9921 | CTCN_3403 | 20108 |
| TTCN_1014 | 9922 | ATCN_2342 | 20109 |
| CTCN_756 | 9923 | GTCN_1965 | 20110 |
| TTCN_1015 | 9924 | CTCN_3404 | 20111 |
| GTCN_476 | 9925 | TTCN_3761 | 20112 |
| GTCN_477 | 9926 | GTCN_1966 | 20113 |
| TTCN_1016 | 9927 | ATCN_2343 | 20114 |
| ATCN_590 | 9928 | ATCN_2344 | 20115 |
| TTCN_1017 | 9929 | GTCN_1967 | 20116 |
| TTCN_1018 | 9930 | CTCN_3405 | 20117 |
| ATCN_591 | 9931 | TTCN_3762 | 20118 |
| GTCN_478 | 9932 | CTCN_3406 | 20119 |
| CTCN_757 | 9933 | CTCN_3407 | 20120 |
| ATCN_592 | 9934 | TTCN_3763 | 20121 |
| CTCN_758 | 9935 | CTCN_3408 | 20122 |
| CTCN_759 | 9936 | CTCN_3409 | 20123 |
| ATCN_593 | 9937 | ATCN_2345 | 20124 |
| ATCN_594 | 9938 | ATCN_2346 | 20125 |
| TTCN_1019 | 9939 | ATCN_2347 | 20126 |
| ATCN_595 | 9940 | GTCN_1968 | 20127 |
| TTCN_1020 | 9941 | GTCN_1969 | 20128 |

FIG. 36 (continued)

| | | | |
|---|---|---|---|
| CTCN_760 | 9942 | TTCN_3764 | 20129 |
| ATCN_596 | 9943 | CTCN_3410 | 20130 |
| CTCN_761 | 9944 | GTCN_1970 | 20131 |
| CTCN_762 | 9945 | GTCN_1971 | 20132 |
| CTCN_763 | 9946 | TTCN_3765 | 20133 |
| TTCN_1021 | 9947 | TTCN_3766 | 20134 |
| TTCN_1022 | 9948 | TTCN_3767 | 20135 |
| GTCN_479 | 9949 | CTCN_3411 | 20136 |
| CTCN_764 | 9950 | TTCN_3768 | 20137 |
| TTCN_1023 | 9951 | ATCN_2348 | 20138 |
| GTCN_480 | 9952 | ATCN_2349 | 20139 |
| CTCN_765 | 9953 | ATCN_2350 | 20140 |
| GTCN_481 | 9954 | GTCN_1972 | 20141 |
| CTCN_766 | 9955 | CTCN_3412 | 20142 |
| CTCN_767 | 9956 | CTCN_3413 | 20143 |
| GTCN_482 | 9957 | CTCN_3414 | 20144 |
| GTCN_483 | 9958 | TTCN_3769 | 20145 |
| TTCN_1024 | 9959 | CTCN_3415 | 20146 |
| TTCN_1025 | 9960 | CTCN_3416 | 20147 |
| ATCN_597 | 9961 | TTCN_3770 | 20148 |
| TTCN_1026 | 9962 | CTCN_3417 | 20149 |
| TTCN_1027 | 9963 | CTCN_3418 | 20150 |
| ATCN_598 | 9964 | CTCN_3419 | 20151 |
| TTCN_1028 | 9965 | CTCN_3420 | 20152 |
| TTCN_1029 | 9966 | TTCN_3771 | 20153 |
| CTCN_768 | 9967 | CTCN_3421 | 20154 |
| ATCN_599 | 9968 | CTCN_3422 | 20155 |
| GTCN_484 | 9969 | CTCN_3423 | 20156 |
| TTCN_1030 | 9970 | TTCN_3772 | 20157 |
| ATCN_600 | 9971 | CTCN_3424 | 20158 |
| ATCN_601 | 9972 | ATCN_2351 | 20159 |
| TTCN_1031 | 9973 | ATCN_2352 | 20160 |
| GTCN_485 | 9974 | TTCN_3773 | 20161 |
| CTCN_769 | 9975 | ATCN_2353 | 20162 |
| CTCN_770 | 9976 | ATCN_2354 | 20163 |
| GTCN_486 | 9977 | TTCN_3774 | 20164 |
| ATCN_602 | 9978 | CTCN_3425 | 20165 |
| TTCN_1032 | 9979 | CTCN_3426 | 20166 |
| ATCN_603 | 9980 | TTCN_3775 | 20167 |
| TTCN_1033 | 9981 | GTCN_1973 | 20168 |
| TTCN_1034 | 9982 | GTCN_1974 | 20169 |
| ATCN_604 | 9983 | TTCN_3776 | 20170 |
| CTCN_771 | 9984 | CTCN_3427 | 20171 |
| GTCN_487 | 9985 | CTCN_3428 | 20172 |
| CTCN_772 | 9986 | TTCN_3777 | 20173 |
| GTCN_488 | 9987 | CTCN_3429 | 20174 |
| CTCN_773 | 9988 | CTCN_3430 | 20175 |
| GTCN_489 | 9989 | CTCN_3431 | 20176 |
| TTCN_1035 | 9990 | GTCN_1975 | 20177 |
| CTCN_774 | 9991 | CTCN_3432 | 20178 |
| GTCN_490 | 9992 | ATCN_2355 | 20179 |
| GTCN_491 | 9993 | ATCN_2356 | 20180 |
| TTCN_1036 | 9994 | ATCN_2357 | 20181 |
| TTCN_1037 | 9995 | ATCN_2358 | 20182 |
| TTCN_1038 | 9996 | ATCN_2359 | 20183 |

| | | | |
|---|---|---|---|
| CTCN_775 | 9997 | TTCN_3778 | 20184 |
| TTCN_1039 | 9998 | TTCN_3779 | 20185 |
| TTCN_1040 | 9999 | CTCN_3433 | 20186 |
| CTCN_776 | 10000 | CTCN_3434 | 20187 |
| TTCN_1041 | 10001 | GTCN_1976 | 20188 |
| CTCN_777 | 10002 | TTCN_3780 | 20189 |
| CTCN_778 | 10003 | CTCN_3435 | 20190 |
| CTCN_779 | 10004 | TTCN_3781 | 20191 |
| GTCN_492 | 10005 | TTCN_3782 | 20192 |
| CTCN_780 | 10006 | TTCN_3783 | 20193 |
| GTCN_493 | 10007 | TTCN_3784 | 20194 |
| CTCN_781 | 10008 | TTCN_3785 | 20195 |
| TTCN_1042 | 10009 | CTCN_3436 | 20196 |
| CTCN_782 | 10010 | GTCN_1977 | 20197 |
| GTCN_494 | 10011 | TTCN_3786 | 20198 |
| CTCN_783 | 10012 | ATCN_2360 | 20199 |
| GTCN_495 | 10013 | CTCN_3437 | 20200 |
| GTCN_496 | 10014 | ATCN_2361 | 20201 |
| TTCN_1043 | 10015 | CTCN_3438 | 20202 |
| ATCN_605 | 10016 | ATCN_2362 | 20203 |
| TTCN_1044 | 10017 | GTCN_1978 | 20204 |
| TTCN_1045 | 10018 | ATCN_2363 | 20205 |
| CTCN_784 | 10019 | TTCN_3787 | 20206 |
| CTCN_785 | 10020 | ATCN_2364 | 20207 |
| GTCN_497 | 10021 | TTCN_3788 | 20208 |
| ATCN_606 | 10022 | CTCN_3439 | 20209 |
| ATCN_607 | 10023 | CTCN_3440 | 20210 |
| TTCN_1046 | 10024 | GTCN_1979 | 20211 |
| ATCN_608 | 10025 | CTCN_3441 | 20212 |
| TTCN_1047 | 10026 | GTCN_1980 | 20213 |
| TTCN_1048 | 10027 | CTCN_3442 | 20214 |
| CTCN_786 | 10028 | GTCN_1981 | 20215 |
| GTCN_498 | 10029 | TTCN_3789 | 20216 |
| TTCN_1049 | 10030 | ATCN_2365 | 20217 |
| ATCN_609 | 10031 | ATCN_2366 | 20218 |
| TTCN_1050 | 10032 | CTCN_3443 | 20219 |
| TTCN_1051 | 10033 | TTCN_3790 | 20220 |
| TTCN_1052 | 10034 | GTCN_1982 | 20221 |
| CTCN_787 | 10035 | ATCN_2367 | 20222 |
| ATCN_610 | 10036 | GTCN_1983 | 20223 |
| GTCN_499 | 10037 | TTCN_3791 | 20224 |
| CTCN_788 | 10038 | CTCN_3444 | 20225 |
| GTCN_500 | 10039 | TTCN_3792 | 20226 |
| CTCN_789 | 10040 | GTCN_1984 | 20227 |
| CTCN_790 | 10041 | CTCN_3445 | 20228 |
| ATCN_611 | 10042 | TTCN_3793 | 20229 |
| GTCN_501 | 10043 | TTCN_3794 | 20230 |
| CTCN_791 | 10044 | CTCN_3446 | 20231 |
| TTCN_1053 | 10045 | TTCN_3795 | 20232 |
| CTCN_792 | 10046 | CTCN_3447 | 20233 |
| CTCN_793 | 10047 | TTCN_3796 | 20234 |
| TTCN_1054 | 10048 | GTCN_1985 | 20235 |
| GTCN_502 | 10049 | CTCN_3448 | 20236 |
| TTCN_1055 | 10050 | CTCN_3449 | 20237 |
| TTCN_1056 | 10051 | CTCN_3450 | 20238 |

FIG. 36 (continued)

| | | | |
|---|---|---|---|
| TTCN_1057 | 10052 | CTCN_3451 | 20239 |
| CTCN_794 | 10053 | CTCN_3452 | 20240 |
| ATCN_612 | 10054 | GTCN_1986 | 20241 |
| TTCN_1058 | 10055 | CTCN_3453 | 20242 |
| GTCN_503 | 10056 | GTCN_1987 | 20243 |
| TTCN_1059 | 10057 | GTCN_1988 | 20244 |
| ATCN_613 | 10058 | GTCN_1989 | 20245 |
| GTCN_504 | 10059 | GTCN_1990 | 20246 |
| GTCN_505 | 10060 | GTCN_1991 | 20247 |
| ATCN_614 | 10061 | CTCN_3454 | 20248 |
| GTCN_506 | 10062 | CTCN_3455 | 20249 |
| TTCN_1060 | 10063 | CTCN_3456 | 20250 |
| TTCN_1061 | 10064 | TTCN_3797 | 20251 |
| CTCN_795 | 10065 | CTCN_3457 | 20252 |
| CTCN_796 | 10066 | CTCN_3458 | 20253 |
| TTCN_1062 | 10067 | CTCN_3459 | 20254 |
| ATCN_615 | 10068 | CTCN_3460 | 20255 |
| TTCN_1063 | 10069 | GTCN_1992 | 20256 |
| GTCN_507 | 10070 | TTCN_3798 | 20257 |
| GTCN_508 | 10071 | TTCN_3799 | 20258 |
| TTCN_1064 | 10072 | GTCN_1993 | 20259 |
| GTCN_509 | 10073 | CTCN_3461 | 20260 |
| CTCN_797 | 10074 | TTCN_3800 | 20261 |
| TTCN_1065 | 10075 | GTCN_1994 | 20262 |
| TTCN_1066 | 10076 | CTCN_3462 | 20263 |
| CTCN_798 | 10077 | ATCN_2368 | 20264 |
| GTCN_510 | 10078 | ATCN_2369 | 20265 |
| TTCN_1067 | 10079 | CTCN_3463 | 20266 |
| GTCN_511 | 10080 | GTCN_1995 | 20267 |
| ATCN_616 | 10081 | CTCN_3464 | 20268 |
| ATCN_617 | 10082 | CTCN_3465 | 20269 |
| ATCN_618 | 10083 | CTCN_3466 | 20270 |
| ATCN_619 | 10084 | TTCN_3801 | 20271 |
| TTCN_1068 | 10085 | GTCN_1996 | 20272 |
| ATCN_620 | 10086 | GTCN_1997 | 20273 |
| CTCN_799 | 10087 | TTCN_3802 | 20274 |
| TTCN_1069 | 10088 | ATCN_2370 | 20275 |
| GTCN_512 | 10089 | ATCN_2371 | 20276 |
| ATCN_621 | 10090 | CTCN_3467 | 20277 |
| GTCN_513 | 10091 | TTCN_3803 | 20278 |
| GTCN_514 | 10092 | CTCN_3468 | 20279 |
| CTCN_800 | 10093 | TTCN_3804 | 20280 |
| ATCN_622 | 10094 | CTCN_3469 | 20281 |
| TTCN_1070 | 10095 | ATCN_2372 | 20282 |
| GTCN_515 | 10096 | CTCN_3470 | 20283 |
| TTCN_1071 | 10097 | GTCN_1998 | 20284 |
| GTCN_516 | 10098 | CTCN_3471 | 20285 |
| ATCN_623 | 10099 | CTCN_3472 | 20286 |
| TTCN_1072 | 10100 | ATCN_2373 | 20287 |
| TTCN_1073 | 10101 | GTCN_1999 | 20288 |
| CTCN_801 | 10102 | CTCN_3473 | 20289 |
| GTCN_517 | 10103 | CTCN_3474 | 20290 |
| CTCN_802 | 10104 | CTCN_3475 | 20291 |
| GTCN_518 | 10105 | CTCN_3476 | 20292 |
| CTCN_803 | 10106 | CTCN_3477 | 20293 |
| CTCN_804 | 10107 | CTCN_3478 | 20294 |
| GTCN_519 | 10108 | CTCN_3479 | 20295 |
| TTCN_1074 | 10109 | CTCN_3480 | 20296 |
| CTCN_805 | 10110 | CTCN_3481 | 20297 |
| CTCN_806 | 10111 | TTCN_3805 | 20298 |
| GTCN_520 | 10112 | GTCN_2000 | 20299 |
| CTCN_807 | 10113 | TTCN_3806 | 20300 |
| ATCN_624 | 10114 | GTCN_2001 | 20301 |
| GTCN_521 | 10115 | CTCN_3482 | 20302 |
| TTCN_1075 | 10116 | CTCN_3483 | 20303 |
| TTCN_1076 | 10117 | CTCN_3484 | 20304 |
| TTCN_1077 | 10118 | CTCN_3485 | 20305 |
| GTCN_522 | 10119 | CTCN_3486 | 20306 |
| GTCN_523 | 10120 | GTCN_2002 | 20307 |
| TTCN_1078 | 10121 | CTCN_3487 | 20308 |
| TTCN_1079 | 10122 | CTCN_3488 | 20309 |
| ATCN_625 | 10123 | TTCN_3807 | 20310 |
| ATCN_626 | 10124 | GTCN_2003 | 20311 |
| ATCN_627 | 10125 | ATCN_2374 | 20312 |
| ATCN_628 | 10126 | CTCN_3489 | 20313 |
| TTCN_1080 | 10127 | TTCN_3808 | 20314 |
| ATCN_629 | 10128 | CTCN_3490 | 20315 |
| TTCN_1081 | 10129 | GTCN_2004 | 20316 |
| CTCN_808 | 10130 | CTCN_3491 | 20317 |
| TTCN_1082 | 10131 | ATCN_2375 | 20318 |
| TTCN_1083 | 10132 | GTCN_2005 | 20319 |
| GTCN_524 | 10133 | CTCN_3492 | 20320 |
| GTCN_525 | 10134 | CTCN_3493 | 20321 |
| TTCN_1084 | 10135 | TTCN_3809 | 20322 |
| CTCN_809 | 10136 | ATCN_2376 | 20323 |
| ATCN_630 | 10137 | TTCN_3810 | 20324 |
| TTCN_1085 | 10138 | CTCN_3494 | 20325 |
| TTCN_1086 | 10139 | TTCN_3811 | 20326 |
| TTCN_1087 | 10140 | GTCN_2006 | 20327 |
| CTCN_810 | 10141 | GTCN_2007 | 20328 |
| CTCN_811 | 10142 | ATCN_2377 | 20329 |
| ATCN_631 | 10143 | TTCN_3812 | 20330 |
| ATCN_632 | 10144 | ATCN_2378 | 20331 |
| TTCN_1088 | 10145 | ATCN_2379 | 20332 |
| CTCN_812 | 10146 | CTCN_3495 | 20333 |
| GTCN_526 | 10147 | TTCN_3813 | 20334 |
| ATCN_633 | 10148 | TTCN_3814 | 20335 |
| CTCN_813 | 10149 | TTCN_3815 | 20336 |
| ATCN_634 | 10150 | ATCN_2380 | 20337 |
| TTCN_1089 | 10151 | TTCN_3816 | 20338 |
| GTCN_527 | 10152 | CTCN_3496 | 20339 |
| TTCN_1090 | 10153 | ATCN_2381 | 20340 |
| CTCN_814 | 10154 | ATCN_2382 | 20341 |
| TTCN_1091 | 10155 | TTCN_3817 | 20342 |
| CTCN_815 | 10156 | TTCN_3818 | 20343 |
| CTCN_816 | 10157 | TTCN_3819 | 20344 |
| CTCN_817 | 10158 | ATCN_2383 | 20345 |
| GTCN_528 | 10159 | CTCN_3497 | 20346 |
| CTCN_818 | 10160 | TTCN_3820 | 20347 |
| ATCN_635 | 10161 | TTCN_3821 | 20348 |

FIG. 36 (continued)

| | | | |
|---|---|---|---|
| TTCN_1092 | 10162 | ATCN_2384 | 20349 |
| GTCN_529 | 10163 | ATCN_2385 | 20350 |
| ATCN_636 | 10164 | ATCN_2386 | 20351 |
| TTCN_1093 | 10165 | TTCN_3822 | 20352 |
| GTCN_530 | 10166 | ATCN_2387 | 20353 |
| CTCN_819 | 10167 | ATCN_2388 | 20354 |
| CTCN_820 | 10168 | CTCN_3498 | 20355 |
| CTCN_821 | 10169 | CTCN_3499 | 20356 |
| CTCN_822 | 10170 | TTCN_3823 | 20357 |
| GTCN_531 | 10171 | CTCN_3500 | 20358 |
| GTCN_532 | 10172 | ATCN_2389 | 20359 |
| TTCN_1094 | 10173 | TTCN_3824 | 20360 |
| ATCN_637 | 10174 | ATCN_2390 | 20361 |
| ATCN_638 | 10175 | CTCN_3501 | 20362 |
| CTCN_823 | 10176 | TTCN_3825 | 20363 |
| TTCN_1095 | 10177 | TTCN_3826 | 20364 |
| GTCN_533 | 10178 | ATCN_2391 | 20365 |
| TTCN_1096 | 10179 | TTCN_3827 | 20366 |
| ATCN_639 | 10180 | ATCN_2392 | 20367 |
| TTCN_1097 | 10181 | GTCN_2008 | 20368 |
| CTCN_824 | 10182 | CTCN_3502 | 20369 |
| GTCN_534 | 10183 | ATCN_2393 | 20370 |
| TTCN_1098 | 10184 | CTCN_3503 | 20371 |
| CTCN_825 | 10185 | CTCN_3504 | 20372 |
| CTCN_826 | 10186 | TTCN_3828 | 20373 |
| ATCN_640 | 10187 | GTCN_2009 | 20374 |
| TTCN_1099 | 10188 | GTCN_2010 | 20375 |
| CTCN_827 | 10189 | CTCN_3505 | 20376 |
| TTCN_1100 | 10190 | CTCN_3506 | 20377 |
| ATCN_641 | 10191 | CTCN_3507 | 20378 |
| CTCN_828 | 10192 | CTCN_3508 | 20379 |
| GTCN_535 | 10193 | ATCN_2394 | 20380 |
| CTCN_829 | 10194 | TTCN_3829 | 20381 |
| TTCN_1101 | 10195 | GTCN_2011 | 20382 |
| CTCN_830 | 10196 | TTCN_3830 | 20383 |
| CTCN_831 | 10197 | TTCN_3831 | 20384 |
| CTCN_832 | 10198 | GTCN_2012 | 20385 |
| ATCN_642 | 10199 | TTCN_3832 | 20386 |
| CTCN_833 | 10200 | CTCN_3509 | 20387 |
| TTCN_1102 | 10201 | GTCN_2013 | 20388 |
| GTCN_536 | 10202 | GTCN_2014 | 20389 |
| CTCN_834 | 10203 | CTCN_3510 | 20390 |
| GTCN_537 | 10204 | GTCN_2015 | 20391 |
| GTCN_538 | 10205 | TTCN_3833 | 20392 |
| GTCN_539 | 10206 | ATCN_2395 | 20393 |
| GTCN_540 | 10207 | TTCN_3834 | 20394 |
| CTCN_835 | 10208 | TTCN_3835 | 20395 |
| TTCN_1103 | 10209 | ATCN_2396 | 20396 |
| GTCN_541 | 10210 | CTCN_3511 | 20397 |
| TTCN_1104 | 10211 | CTCN_3512 | 20398 |
| ATCN_643 | 10212 | ATCN_2397 | 20399 |
| TTCN_1105 | 10213 | TTCN_3836 | 20400 |
| CTCN_836 | 10214 | CTCN_3513 | 20401 |
| CTCN_837 | 10215 | GTCN_2016 | 20402 |
| GTCN_542 | 10216 | CTCN_3514 | 20403 |

| | | | |
|---|---|---|---|
| CTCN_838 | 10217 | ATCN_2398 | 20404 |
| TTCN_1106 | 10218 | GTCN_2017 | 20405 |
| CTCN_839 | 10219 | CTCN_3515 | 20406 |
| TTCN_1107 | 10220 | CTCN_3516 | 20407 |
| CTCN_840 | 10221 | GTCN_2018 | 20408 |
| CTCN_841 | 10222 | TTCN_3837 | 20409 |
| TTCN_1108 | 10223 | CTCN_3517 | 20410 |
| GTCN_543 | 10224 | CTCN_3518 | 20411 |
| CTCN_842 | 10225 | CTCN_3519 | 20412 |
| TTCN_1109 | 10226 | CTCN_3520 | 20413 |
| TTCN_1110 | 10227 | CTCN_3521 | 20414 |
| GTCN_544 | 10228 | GTCN_2019 | 20415 |
| TTCN_1111 | 10229 | GTCN_2020 | 20416 |
| CTCN_843 | 10230 | CTCN_3522 | 20417 |
| TTCN_1112 | 10231 | ATCN_2399 | 20418 |
| GTCN_545 | 10232 | TTCN_3838 | 20419 |
| GTCN_546 | 10233 | TTCN_3839 | 20420 |
| GTCN_547 | 10234 | TTCN_3840 | 20421 |
| ATCN_644 | 10235 | TTCN_3841 | 20422 |
| GTCN_548 | 10236 | CTCN_3523 | 20423 |
| GTCN_549 | 10237 | TTCN_3842 | 20424 |
| ATCN_645 | 10238 | TTCN_3843 | 20425 |
| GTCN_550 | 10239 | CTCN_3524 | 20426 |
| TTCN_1113 | 10240 | CTCN_3525 | 20427 |
| TTCN_1114 | 10241 | CTCN_3526 | 20428 |
| TTCN_1115 | 10242 | ATCN_2400 | 20429 |
| GTCN_551 | 10243 | CTCN_3527 | 20430 |
| GTCN_552 | 10244 | TTCN_3844 | 20431 |
| TTCN_1116 | 10245 | CTCN_3528 | 20432 |
| ATCN_646 | 10246 | TTCN_3845 | 20433 |
| GTCN_553 | 10247 | TTCN_3846 | 20434 |
| CTCN_844 | 10248 | TTCN_3847 | 20435 |
| CTCN_845 | 10249 | TTCN_3848 | 20436 |
| GTCN_554 | 10250 | TTCN_3849 | 20437 |
| TTCN_1117 | 10251 | ATCN_2401 | 20438 |
| CTCN_846 | 10252 | TTCN_3850 | 20439 |
| TTCN_1118 | 10253 | TTCN_3851 | 20440 |
| CTCN_847 | 10254 | CTCN_3529 | 20441 |
| TTCN_1119 | 10255 | GTCN_2021 | 20442 |
| ATCN_647 | 10256 | CTCN_3530 | 20443 |
| TTCN_1120 | 10257 | CTCN_3531 | 20444 |
| GTCN_555 | 10258 | GTCN_2022 | 20445 |
| CTCN_848 | 10259 | TTCN_3852 | 20446 |
| GTCN_556 | 10260 | GTCN_2023 | 20447 |
| GTCN_557 | 10261 | CTCN_3532 | 20448 |
| CTCN_849 | 10262 | TTCN_3853 | 20449 |
| GTCN_558 | 10263 | CTCN_3533 | 20450 |
| GTCN_559 | 10264 | GTCN_2024 | 20451 |
| TTCN_1121 | 10265 | CTCN_3534 | 20452 |
| GTCN_560 | 10266 | GTCN_2025 | 20453 |
| TTCN_1122 | 10267 | TTCN_3854 | 20454 |
| ATCN_648 | 10268 | GTCN_2026 | 20455 |
| TTCN_1123 | 10269 | GTCN_2027 | 20456 |
| TTCN_1124 | 10270 | GTCN_2028 | 20457 |
| GTCN_561 | 10271 | CTCN_3535 | 20458 |

FIG. 36 (continued)

| | | | |
|---|---|---|---|
| TTCN_1125 | 10272 | TTCN_3855 | 20459 |
| CTCN_850 | 10273 | CTCN_3536 | 20460 |
| CTCN_851 | 10274 | CTCN_3537 | 20461 |
| ATCN_649 | 10275 | CTCN_3538 | 20462 |
| CTCN_852 | 10276 | GTCN_2029 | 20463 |
| CTCN_853 | 10277 | GTCN_2030 | 20464 |
| GTCN_562 | 10278 | CTCN_3539 | 20465 |
| ATCN_650 | 10279 | GTCN_2031 | 20466 |
| TTCN_1126 | 10280 | CTCN_3540 | 20467 |
| GTCN_563 | 10281 | CTCN_3541 | 20468 |
| CTCN_854 | 10282 | CTCN_3542 | 20469 |
| CTCN_855 | 10283 | CTCN_3543 | 20470 |
| TTCN_1127 | 10284 | CTCN_3544 | 20471 |
| TTCN_1128 | 10285 | CTCN_3545 | 20472 |
| GTCN_564 | 10286 | CTCN_3546 | 20473 |
| TTCN_1129 | 10287 | CTCN_3547 | 20474 |
| GTCN_565 | 10288 | CTCN_3548 | 20475 |
| TTCN_1130 | 10289 | CTCN_3549 | 20476 |
| CTCN_856 | 10290 | CTCN_3550 | 20477 |
| ATCN_651 | 10291 | GTCN_2032 | 20478 |
| TTCN_1131 | 10292 | CTCN_3551 | 20479 |
| CTCN_857 | 10293 | CTCN_3552 | 20480 |
| TTCN_1132 | 10294 | CTCN_3553 | 20481 |
| ATCN_652 | 10295 | CTCN_3554 | 20482 |
| ATCN_653 | 10296 | CTCN_3555 | 20483 |
| CTCN_858 | 10297 | CTCN_3556 | 20484 |
| TTCN_1133 | 10298 | CTCN_3557 | 20485 |
| CTCN_859 | 10299 | GTCN_2033 | 20486 |
| CTCN_860 | 10300 | CTCN_3558 | 20487 |
| CTCN_861 | 10301 | CTCN_3559 | 20488 |
| TTCN_1134 | 10302 | GTCN_2034 | 20489 |
| TTCN_1135 | 10303 | CTCN_3560 | 20490 |
| TTCN_1136 | 10304 | CTCN_3561 | 20491 |
| TTCN_1137 | 10305 | CTCN_3562 | 20492 |
| CTCN_862 | 10306 | CTCN_3563 | 20493 |
| CTCN_863 | 10307 | CTCN_3564 | 20494 |
| TTCN_1138 | 10308 | CTCN_3565 | 20495 |
| TTCN_1139 | 10309 | GTCN_2035 | 20496 |
| TTCN_1140 | 10310 | CTCN_3566 | 20497 |
| TTCN_1141 | 10311 | CTCN_3567 | 20498 |
| ATCN_654 | 10312 | CTCN_3568 | 20499 |
| CTCN_864 | 10313 | CTCN_3569 | 20500 |
| GTCN_566 | 10314 | GTCN_2036 | 20501 |
| TTCN_1142 | 10315 | CTCN_3570 | 20502 |
| ATCN_655 | 10316 | CTCN_3571 | 20503 |
| CTCN_865 | 10317 | CTCN_3572 | 20504 |
| CTCN_866 | 10318 | CTCN_3573 | 20505 |
| TTCN_1143 | 10319 | GTCN_2037 | 20506 |
| GTCN_567 | 10320 | CTCN_3574 | 20507 |
| GTCN_568 | 10321 | CTCN_3575 | 20508 |
| ATCN_656 | 10322 | CTCN_3576 | 20509 |
| CTCN_867 | 10323 | CTCN_3577 | 20510 |
| TTCN_1144 | 10324 | GTCN_2038 | 20511 |
| ATCN_657 | 10325 | GTCN_2039 | 20512 |
| CTCN_868 | 10326 | ATCN_2402 | 20513 |

| | | | |
|---|---|---|---|
| CTCN_869 | 10327 | ATCN_2403 | 20514 |
| CTCN_870 | 10328 | ATCN_2404 | 20515 |
| CTCN_871 | 10329 | GTCN_2040 | 20516 |
| CTCN_872 | 10330 | CTCN_3578 | 20517 |
| CTCN_873 | 10331 | ATCN_2405 | 20518 |
| TTCN_1145 | 10332 | GTCN_2041 | 20519 |
| ATCN_658 | 10333 | GTCN_2042 | 20520 |
| GTCN_569 | 10334 | ATCN_2406 | 20521 |
| TTCN_1146 | 10335 | TTCN_3856 | 20522 |
| ATCN_659 | 10336 | CTCN_3579 | 20523 |
| GTCN_570 | 10337 | CTCN_3580 | 20524 |
| TTCN_1147 | 10338 | CTCN_3581 | 20525 |
| GTCN_571 | 10339 | TTCN_3857 | 20526 |
| TTCN_1148 | 10340 | TTCN_3858 | 20527 |
| ATCN_660 | 10341 | GTCN_2043 | 20528 |
| TTCN_1149 | 10342 | ATCN_2407 | 20529 |
| CTCN_874 | 10343 | CTCN_3582 | 20530 |
| TTCN_1150 | 10344 | ATCN_2408 | 20531 |
| ATCN_661 | 10345 | ATCN_2409 | 20532 |
| TTCN_1151 | 10346 | ATCN_2410 | 20533 |
| CTCN_875 | 10347 | TTCN_3859 | 20534 |
| GTCN_572 | 10348 | TTCN_3860 | 20535 |
| ATCN_662 | 10349 | TTCN_3861 | 20536 |
| ATCN_663 | 10350 | CTCN_3583 | 20537 |
| CTCN_876 | 10351 | GTCN_2044 | 20538 |
| ATCN_664 | 10352 | CTCN_3584 | 20539 |
| TTCN_1152 | 10353 | CTCN_3585 | 20540 |
| ATCN_665 | 10354 | GTCN_2045 | 20541 |
| TTCN_1153 | 10355 | CTCN_3586 | 20542 |
| CTCN_877 | 10356 | GTCN_2046 | 20543 |
| GTCN_573 | 10357 | CTCN_3587 | 20544 |
| TTCN_1154 | 10358 | GTCN_2047 | 20545 |
| GTCN_574 | 10359 | CTCN_3588 | 20546 |
| ATCN_666 | 10360 | CTCN_3589 | 20547 |
| TTCN_1155 | 10361 | CTCN_3590 | 20548 |
| TTCN_1156 | 10362 | ATCN_2411 | 20549 |
| TTCN_1157 | 10363 | TTCN_3862 | 20550 |
| GTCN_575 | 10364 | CTCN_3591 | 20551 |
| GTCN_576 | 10365 | ATCN_2412 | 20552 |
| CTCN_878 | 10366 | ATCN_2413 | 20553 |
| TTCN_1158 | 10367 | CTCN_3592 | 20554 |
| CTCN_879 | 10368 | GTCN_2048 | 20555 |
| ATCN_667 | 10369 | CTCN_3593 | 20556 |
| GTCN_577 | 10370 | CTCN_3594 | 20557 |
| CTCN_880 | 10371 | ATCN_2414 | 20558 |
| TTCN_1159 | 10372 | CTCN_3595 | 20559 |
| ATCN_668 | 10373 | GTCN_2049 | 20560 |
| TTCN_1160 | 10374 | CTCN_3596 | 20561 |
| CTCN_881 | 10375 | TTCN_3863 | 20562 |
| GTCN_578 | 10376 | TTCN_3864 | 20563 |
| GTCN_579 | 10377 | CTCN_3597 | 20564 |
| TTCN_1161 | 10378 | CTCN_3598 | 20565 |
| TTCN_1162 | 10379 | CTCN_3599 | 20566 |
| GTCN_580 | 10380 | CTCN_3600 | 20567 |
| CTCN_882 | 10381 | TTCN_3865 | 20568 |

FIG. 36 (continued)

| | | | |
|---|---|---|---|
| TTCN_1163 | 10382 | CTCN_3601 | 20569 |
| CTCN_883 | 10383 | GTCN_2050 | 20570 |
| TTCN_1164 | 10384 | CTCN_3602 | 20571 |
| TTCN_1165 | 10385 | CTCN_3603 | 20572 |
| TTCN_1166 | 10386 | TTCN_3866 | 20573 |
| ATCN_669 | 10387 | CTCN_3604 | 20574 |
| TTCN_1167 | 10388 | TTCN_3867 | 20575 |
| CTCN_884 | 10389 | CTCN_3605 | 20576 |
| CTCN_885 | 10390 | CTCN_3606 | 20577 |
| GTCN_581 | 10391 | GTCN_2051 | 20578 |
| TTCN_1168 | 10392 | TTCN_3868 | 20579 |
| ATCN_670 | 10393 | GTCN_2052 | 20580 |
| TTCN_1169 | 10394 | TTCN_3869 | 20581 |
| CTCN_886 | 10395 | CTCN_3607 | 20582 |
| CTCN_887 | 10396 | GTCN_2053 | 20583 |
| GTCN_582 | 10397 | TTCN_3870 | 20584 |
| TTCN_1170 | 10398 | GTCN_2054 | 20585 |
| CTCN_888 | 10399 | GTCN_2055 | 20586 |
| TTCN_1171 | 10400 | CTCN_3608 | 20587 |
| ATCN_671 | 10401 | CTCN_3609 | 20588 |
| TTCN_1172 | 10402 | GTCN_2056 | 20589 |
| TTCN_1173 | 10403 | CTCN_3610 | 20590 |
| CTCN_889 | 10404 | GTCN_2057 | 20591 |
| GTCN_583 | 10405 | ATCN_2415 | 20592 |
| TTCN_1174 | 10406 | TTCN_3871 | 20593 |
| TTCN_1175 | 10407 | TTCN_3872 | 20594 |
| TTCN_1176 | 10408 | GTCN_2058 | 20595 |
| TTCN_1177 | 10409 | TTCN_3873 | 20596 |
| GTCN_584 | 10410 | CTCN_3611 | 20597 |
| TTCN_1178 | 10411 | GTCN_2059 | 20598 |
| ATCN_672 | 10412 | CTCN_3612 | 20599 |
| GTCN_585 | 10413 | CTCN_3613 | 20600 |
| CTCN_890 | 10414 | GTCN_2060 | 20601 |
| ATCN_673 | 10415 | GTCN_2061 | 20602 |
| CTCN_891 | 10416 | TTCN_3874 | 20603 |
| GTCN_586 | 10417 | TTCN_3875 | 20604 |
| CTCN_892 | 10418 | GTCN_2062 | 20605 |
| TTCN_1179 | 10419 | CTCN_3614 | 20606 |
| ATCN_674 | 10420 | CTCN_3615 | 20607 |
| ATCN_675 | 10421 | ATCN_2416 | 20608 |
| CTCN_893 | 10422 | TTCN_3876 | 20609 |
| TTCN_1180 | 10423 | CTCN_3616 | 20610 |
| CTCN_894 | 10424 | GTCN_2063 | 20611 |
| TTCN_1181 | 10425 | CTCN_3617 | 20612 |
| ATCN_676 | 10426 | CTCN_3618 | 20613 |
| ATCN_677 | 10427 | TTCN_3877 | 20614 |
| CTCN_895 | 10428 | TTCN_3878 | 20615 |
| ATCN_678 | 10429 | TTCN_3879 | 20616 |
| GTCN_587 | 10430 | GTCN_2064 | 20617 |
| CTCN_896 | 10431 | GTCN_2065 | 20618 |
| ATCN_679 | 10432 | CTCN_3619 | 20619 |
| CTCN_897 | 10433 | CTCN_3620 | 20620 |
| GTCN_588 | 10434 | CTCN_3621 | 20621 |
| GTCN_589 | 10435 | GTCN_2066 | 20622 |
| TTCN_1182 | 10436 | CTCN_3622 | 20623 |

| | | | |
|---|---|---|---|
| CTCN_898 | 10437 | CTCN_3623 | 20624 |
| GTCN_590 | 10438 | TTCN_3880 | 20625 |
| GTCN_591 | 10439 | TTCN_3881 | 20626 |
| ATCN_680 | 10440 | CTCN_3624 | 20627 |
| CTCN_899 | 10441 | ATCN_2417 | 20628 |
| CTCN_900 | 10442 | CTCN_3625 | 20629 |
| CTCN_901 | 10443 | GTCN_2067 | 20630 |
| GTCN_592 | 10444 | TTCN_3882 | 20631 |
| ATCN_681 | 10445 | CTCN_3626 | 20632 |
| CTCN_902 | 10446 | GTCN_2068 | 20633 |
| TTCN_1183 | 10447 | CTCN_3627 | 20634 |
| ATCN_682 | 10448 | CTCN_3628 | 20635 |
| ATCN_683 | 10449 | CTCN_3629 | 20636 |
| TTCN_1184 | 10450 | ATCN_2418 | 20637 |
| TTCN_1185 | 10451 | CTCN_3630 | 20638 |
| CTCN_903 | 10452 | GTCN_2069 | 20639 |
| ATCN_684 | 10453 | CTCN_3631 | 20640 |
| ATCN_685 | 10454 | GTCN_2070 | 20641 |
| ATCN_686 | 10455 | TTCN_3883 | 20642 |
| TTCN_1186 | 10456 | CTCN_3632 | 20643 |
| CTCN_904 | 10457 | ATCN_2419 | 20644 |
| ATCN_687 | 10458 | ATCN_2420 | 20645 |
| CTCN_905 | 10459 | GTCN_2071 | 20646 |
| TTCN_1187 | 10460 | ATCN_2421 | 20647 |
| GTCN_593 | 10461 | ATCN_2422 | 20648 |
| TTCN_1188 | 10462 | TTCN_3884 | 20649 |
| CTCN_906 | 10463 | GTCN_2072 | 20650 |
| GTCN_594 | 10464 | CTCN_3633 | 20651 |
| TTCN_1189 | 10465 | ATCN_2423 | 20652 |
| CTCN_907 | 10466 | TTCN_3885 | 20653 |
| TTCN_1190 | 10467 | GTCN_2073 | 20654 |
| CTCN_908 | 10468 | GTCN_2074 | 20655 |
| CTCN_909 | 10469 | ATCN_2424 | 20656 |
| CTCN_910 | 10470 | GTCN_2075 | 20657 |
| CTCN_911 | 10471 | TTCN_3886 | 20658 |
| GTCN_595 | 10472 | TTCN_3887 | 20659 |
| GTCN_596 | 10473 | ATCN_2425 | 20660 |
| CTCN_912 | 10474 | TTCN_3888 | 20661 |
| ATCN_688 | 10475 | TTCN_3889 | 20662 |
| ATCN_689 | 10476 | GTCN_2076 | 20663 |
| GTCN_597 | 10477 | CTCN_3634 | 20664 |
| TTCN_1191 | 10478 | CTCN_3635 | 20665 |
| ATCN_690 | 10479 | CTCN_3636 | 20666 |
| ATCN_691 | 10480 | CTCN_3637 | 20667 |
| TTCN_1192 | 10481 | CTCN_3638 | 20668 |
| GTCN_598 | 10482 | CTCN_3639 | 20669 |
| TTCN_1193 | 10483 | CTCN_3640 | 20670 |
| CTCN_913 | 10484 | CTCN_3641 | 20671 |
| CTCN_914 | 10485 | TTCN_3890 | 20672 |
| ATCN_692 | 10486 | TTCN_3891 | 20673 |
| CTCN_915 | 10487 | ATCN_2426 | 20674 |
| CTCN_916 | 10488 | CTCN_3642 | 20675 |
| GTCN_599 | 10489 | TTCN_3892 | 20676 |
| TTCN_1194 | 10490 | GTCN_2077 | 20677 |
| ATCN_693 | 10491 | CTCN_3643 | 20678 |

FIG. 36 (continued)

| | | | |
|---|---|---|---|
| TTCN_1195 | 10492 | GTCN_2078 | 20679 |
| CTCN_917 | 10493 | TTCN_3893 | 20680 |
| CTCN_918 | 10494 | CTCN_3644 | 20681 |
| TTCN_1196 | 10495 | GTCN_2079 | 20682 |
| GTCN_600 | 10496 | TTCN_3894 | 20683 |
| CTCN_919 | 10497 | TTCN_3895 | 20684 |
| TTCN_1197 | 10498 | TTCN_3896 | 20685 |
| GTCN_601 | 10499 | TTCN_3897 | 20686 |
| CTCN_920 | 10500 | CTCN_3645 | 20687 |
| ATCN_694 | 10501 | CTCN_3646 | 20688 |
| CTCN_921 | 10502 | ATCN_2427 | 20689 |
| CTCN_922 | 10503 | ATCN_2428 | 20690 |
| ATCN_695 | 10504 | CTCN_3647 | 20691 |
| ATCN_696 | 10505 | GTCN_2080 | 20692 |
| CTCN_923 | 10506 | GTCN_2081 | 20693 |
| CTCN_924 | 10507 | ATCN_2429 | 20694 |
| CTCN_925 | 10508 | CTCN_3648 | 20695 |
| CTCN_926 | 10509 | GTCN_2082 | 20696 |
| TTCN_1198 | 10510 | GTCN_2083 | 20697 |
| TTCN_1199 | 10511 | CTCN_3649 | 20698 |
| ATCN_697 | 10512 | GTCN_2084 | 20699 |
| CTCN_927 | 10513 | CTCN_3650 | 20700 |
| CTCN_928 | 10514 | GTCN_2085 | 20701 |
| ATCN_698 | 10515 | CTCN_3651 | 20702 |
| CTCN_929 | 10516 | GTCN_2086 | 20703 |
| CTCN_930 | 10517 | TTCN_3898 | 20704 |
| TTCN_1200 | 10518 | CTCN_3652 | 20705 |
| ATCN_699 | 10519 | TTCN_3899 | 20706 |
| ATCN_700 | 10520 | CTCN_3653 | 20707 |
| CTCN_931 | 10521 | CTCN_3654 | 20708 |
| GTCN_602 | 10522 | GTCN_2087 | 20709 |
| GTCN_603 | 10523 | CTCN_3655 | 20710 |
| CTCN_932 | 10524 | ATCN_2430 | 20711 |
| GTCN_604 | 10525 | CTCN_3656 | 20712 |
| TTCN_1201 | 10526 | CTCN_3657 | 20713 |
| CTCN_933 | 10527 | TTCN_3900 | 20714 |
| ATCN_701 | 10528 | GTCN_2088 | 20715 |
| ATCN_702 | 10529 | CTCN_3658 | 20716 |
| ATCN_703 | 10530 | TTCN_3901 | 20717 |
| TTCN_1202 | 10531 | GTCN_2089 | 20718 |
| TTCN_1203 | 10532 | ATCN_2431 | 20719 |
| CTCN_934 | 10533 | CTCN_3659 | 20720 |
| TTCN_1204 | 10534 | GTCN_2090 | 20721 |
| CTCN_935 | 10535 | CTCN_3660 | 20722 |
| CTCN_936 | 10536 | CTCN_3661 | 20723 |
| CTCN_937 | 10537 | GTCN_2091 | 20724 |
| GTCN_605 | 10538 | GTCN_2092 | 20725 |
| CTCN_938 | 10539 | TTCN_3902 | 20726 |
| TTCN_1205 | 10540 | TTCN_3903 | 20727 |
| ATCN_704 | 10541 | GTCN_2093 | 20728 |
| CTCN_939 | 10542 | GTCN_2094 | 20729 |
| TTCN_1206 | 10543 | GTCN_2095 | 20730 |
| GTCN_606 | 10544 | CTCN_3662 | 20731 |
| TTCN_1207 | 10545 | CTCN_3663 | 20732 |
| TTCN_1208 | 10546 | CTCN_3664 | 20733 |

| | | | |
|---|---|---|---|
| ATCN_705 | 10547 | TTCN_3904 | 20734 |
| TTCN_1209 | 10548 | CTCN_3665 | 20735 |
| TTCN_1210 | 10549 | GTCN_2096 | 20736 |
| TTCN_1211 | 10550 | CTCN_3666 | 20737 |
| ATCN_706 | 10551 | CTCN_3667 | 20738 |
| CTCN_940 | 10552 | CTCN_3668 | 20739 |
| CTCN_941 | 10553 | CTCN_3669 | 20740 |
| CTCN_942 | 10554 | GTCN_2097 | 20741 |
| ATCN_707 | 10555 | GTCN_2098 | 20742 |
| ATCN_708 | 10556 | CTCN_3670 | 20743 |
| TTCN_1212 | 10557 | GTCN_2099 | 20744 |
| ATCN_709 | 10558 | TTCN_3905 | 20745 |
| CTCN_943 | 10559 | TTCN_3906 | 20746 |
| ATCN_710 | 10560 | TTCN_3907 | 20747 |
| TTCN_1213 | 10561 | GTCN_2100 | 20748 |
| ATCN_711 | 10562 | CTCN_3671 | 20749 |
| GTCN_607 | 10563 | TTCN_3908 | 20750 |
| CTCN_944 | 10564 | CTCN_3672 | 20751 |
| ATCN_712 | 10565 | GTCN_2101 | 20752 |
| CTCN_945 | 10566 | CTCN_3673 | 20753 |
| GTCN_608 | 10567 | TTCN_3909 | 20754 |
| GTCN_609 | 10568 | GTCN_2102 | 20755 |
| ATCN_713 | 10569 | GTCN_2103 | 20756 |
| TTCN_1214 | 10570 | CTCN_3674 | 20757 |
| CTCN_946 | 10571 | TTCN_3910 | 20758 |
| GTCN_610 | 10572 | CTCN_3675 | 20759 |
| ATCN_714 | 10573 | CTCN_3676 | 20760 |
| GTCN_611 | 10574 | TTCN_3911 | 20761 |
| ATCN_715 | 10575 | ATCN_2432 | 20762 |
| GTCN_612 | 10576 | CTCN_3677 | 20763 |
| TTCN_1215 | 10577 | TTCN_3912 | 20764 |
| GTCN_613 | 10578 | TTCN_3913 | 20765 |
| CTCN_947 | 10579 | CTCN_3678 | 20766 |
| GTCN_614 | 10580 | CTCN_3679 | 20767 |
| CTCN_948 | 10581 | CTCN_3680 | 20768 |
| GTCN_615 | 10582 | ATCN_2433 | 20769 |
| ATCN_716 | 10583 | ATCN_2434 | 20770 |
| ATCN_717 | 10584 | CTCN_3681 | 20771 |
| CTCN_949 | 10585 | CTCN_3682 | 20772 |
| GTCN_616 | 10586 | CTCN_3683 | 20773 |
| CTCN_950 | 10587 | CTCN_3684 | 20774 |
| CTCN_951 | 10588 | GTCN_2104 | 20775 |
| TTCN_1216 | 10589 | CTCN_3685 | 20776 |
| ATCN_718 | 10590 | CTCN_3686 | 20777 |
| CTCN_952 | 10591 | CTCN_3687 | 20778 |
| ATCN_719 | 10592 | CTCN_3688 | 20779 |
| GTCN_617 | 10593 | CTCN_3689 | 20780 |
| CTCN_953 | 10594 | CTCN_3690 | 20781 |
| ATCN_720 | 10595 | ATCN_2435 | 20782 |
| ATCN_721 | 10596 | ATCN_2436 | 20783 |
| TTCN_1217 | 10597 | GTCN_2105 | 20784 |
| GTCN_618 | 10598 | ATCN_2437 | 20785 |
| TTCN_1218 | 10599 | ATCN_2438 | 20786 |
| GTCN_619 | 10600 | CTCN_3691 | 20787 |
| ATCN_722 | 10601 | ATCN_2439 | 20788 |

FIG. 36 (continued)

| | | | |
|---|---|---|---|
| GTCN_620 | 10602 | GTCN_2106 | 20789 |
| TTCN_1219 | 10603 | CTCN_3692 | 20790 |
| TTCN_1220 | 10604 | CTCN_3693 | 20791 |
| GTCN_621 | 10605 | GTCN_2107 | 20792 |
| ATCN_723 | 10606 | CTCN_3694 | 20793 |
| TTCN_1221 | 10607 | GTCN_2108 | 20794 |
| CTCN_954 | 10608 | CTCN_3695 | 20795 |
| ATCN_724 | 10609 | CTCN_3696 | 20796 |
| TTCN_1222 | 10610 | TTCN_3914 | 20797 |
| GTCN_622 | 10611 | CTCN_3697 | 20798 |
| ATCN_725 | 10612 | CTCN_3698 | 20799 |
| TTCN_1223 | 10613 | CTCN_3699 | 20800 |
| CTCN_955 | 10614 | ATCN_2440 | 20801 |
| GTCN_623 | 10615 | TTCN_3915 | 20802 |
| TTCN_1224 | 10616 | CTCN_3700 | 20803 |
| TTCN_1225 | 10617 | CTCN_3701 | 20804 |
| TTCN_1226 | 10618 | GTCN_2109 | 20805 |
| ATCN_726 | 10619 | CTCN_3702 | 20806 |
| ATCN_727 | 10620 | ATCN_2441 | 20807 |
| CTCN_956 | 10621 | GTCN_2110 | 20808 |
| CTCN_957 | 10622 | ATCN_2442 | 20809 |
| CTCN_958 | 10623 | GTCN_2111 | 20810 |
| ATCN_728 | 10624 | ATCN_2443 | 20811 |
| CTCN_959 | 10625 | GTCN_2112 | 20812 |
| TTCN_1227 | 10626 | GTCN_2113 | 20813 |
| ATCN_729 | 10627 | GTCN_2114 | 20814 |
| TTCN_1228 | 10628 | GTCN_2115 | 20815 |
| TTCN_1229 | 10629 | CTCN_3703 | 20816 |
| TTCN_1230 | 10630 | GTCN_2116 | 20817 |
| TTCN_1231 | 10631 | TTCN_3916 | 20818 |
| GTCN_624 | 10632 | ATCN_2444 | 20819 |
| ATCN_730 | 10633 | GTCN_2117 | 20820 |
| TTCN_1232 | 10634 | CTCN_3704 | 20821 |
| GTCN_625 | 10635 | CTCN_3705 | 20822 |
| ATCN_731 | 10636 | TTCN_3917 | 20823 |
| ATCN_732 | 10637 | TTCN_3918 | 20824 |
| TTCN_1233 | 10638 | ATCN_2445 | 20825 |
| TTCN_1234 | 10639 | ATCN_2446 | 20826 |
| ATCN_733 | 10640 | CTCN_3706 | 20827 |
| ATCN_734 | 10641 | TTCN_3919 | 20828 |
| ATCN_735 | 10642 | GTCN_2118 | 20829 |
| ATCN_736 | 10643 | ATCN_2447 | 20830 |
| CTCN_960 | 10644 | CTCN_3707 | 20831 |
| CTCN_961 | 10645 | GTCN_2119 | 20832 |
| TTCN_1235 | 10646 | CTCN_3708 | 20833 |
| GTCN_626 | 10647 | TTCN_3920 | 20834 |
| TTCN_1236 | 10648 | CTCN_3709 | 20835 |
| TTCN_1237 | 10649 | GTCN_2120 | 20836 |
| GTCN_627 | 10650 | TTCN_3921 | 20837 |
| GTCN_628 | 10651 | CTCN_3710 | 20838 |
| GTCN_629 | 10652 | ATCN_2448 | 20839 |
| ATCN_737 | 10653 | TTCN_3922 | 20840 |
| TTCN_1238 | 10654 | TTCN_3923 | 20841 |
| ATCN_738 | 10655 | CTCN_3711 | 20842 |
| CTCN_962 | 10656 | TTCN_3924 | 20843 |

| | | | |
|---|---|---|---|
| CTCN_963 | 10657 | CTCN_3712 | 20844 |
| CTCN_964 | 10658 | TTCN_3925 | 20845 |
| TTCN_1239 | 10659 | GTCN_2121 | 20846 |
| ATCN_739 | 10660 | ATCN_2449 | 20847 |
| GTCN_630 | 10661 | GTCN_2122 | 20848 |
| CTCN_965 | 10662 | GTCN_2123 | 20849 |
| GTCN_631 | 10663 | GTCN_2124 | 20850 |
| CTCN_966 | 10664 | ATCN_2450 | 20851 |
| CTCN_967 | 10665 | GTCN_2125 | 20852 |
| CTCN_968 | 10666 | ATCN_2451 | 20853 |
| TTCN_1240 | 10667 | CTCN_3713 | 20854 |
| CTCN_969 | 10668 | CTCN_3714 | 20855 |
| TTCN_1241 | 10669 | CTCN_3715 | 20856 |
| CTCN_970 | 10670 | TTCN_3926 | 20857 |
| ATCN_740 | 10671 | GTCN_2126 | 20858 |
| GTCN_632 | 10672 | ATCN_2452 | 20859 |
| GTCN_633 | 10673 | ATCN_2453 | 20860 |
| CTCN_971 | 10674 | GTCN_2127 | 20861 |
| GTCN_634 | 10675 | GTCN_2128 | 20862 |
| CTCN_972 | 10676 | CTCN_3716 | 20863 |
| TTCN_1242 | 10677 | CTCN_3717 | 20864 |
| CTCN_973 | 10678 | CTCN_3718 | 20865 |
| TTCN_1243 | 10679 | TTCN_3927 | 20866 |
| ATCN_741 | 10680 | CTCN_3719 | 20867 |
| TTCN_1244 | 10681 | CTCN_3720 | 20868 |
| TTCN_1245 | 10682 | CTCN_3721 | 20869 |
| GTCN_635 | 10683 | TTCN_3928 | 20870 |
| GTCN_636 | 10684 | TTCN_3929 | 20871 |
| GTCN_637 | 10685 | CTCN_3722 | 20872 |
| GTCN_638 | 10686 | GTCN_2129 | 20873 |
| TTCN_1246 | 10687 | ATCN_2454 | 20874 |
| GTCN_639 | 10688 | ATCN_2455 | 20875 |
| TTCN_1247 | 10689 | ATCN_2456 | 20876 |
| TTCN_1248 | 10690 | CTCN_3723 | 20877 |
| ATCN_742 | 10691 | GTCN_2130 | 20878 |
| CTCN_974 | 10692 | CTCN_3724 | 20879 |
| TTCN_1249 | 10693 | TTCN_3930 | 20880 |
| CTCN_975 | 10694 | GTCN_2131 | 20881 |
| GTCN_640 | 10695 | TTCN_3931 | 20882 |
| GTCN_641 | 10696 | CTCN_3725 | 20883 |
| CTCN_976 | 10697 | CTCN_3726 | 20884 |
| TTCN_1250 | 10698 | CTCN_3727 | 20885 |
| CTCN_977 | 10699 | CTCN_3728 | 20886 |
| TTCN_1251 | 10700 | TTCN_3932 | 20887 |
| ATCN_743 | 10701 | TTCN_3933 | 20888 |
| GTCN_642 | 10702 | GTCN_2132 | 20889 |
| CTCN_978 | 10703 | CTCN_3729 | 20890 |
| CTCN_979 | 10704 | ATCN_2457 | 20891 |
| GTCN_643 | 10705 | TTCN_3934 | 20892 |
| CTCN_980 | 10706 | GTCN_2133 | 20893 |
| TTCN_1252 | 10707 | CTCN_3730 | 20894 |
| ATCN_744 | 10708 | GTCN_2134 | 20895 |
| GTCN_644 | 10709 | CTCN_3731 | 20896 |
| GTCN_645 | 10710 | ATCN_2458 | 20897 |
| TTCN_1253 | 10711 | TTCN_3935 | 20898 |

FIG. 36 (continued)

| | | | |
|---|---|---|---|
| TTCN_1254 | 10712 | GTCN_2135 | 20899 |
| TTCN_1255 | 10713 | TTCN_3936 | 20900 |
| ATCN_745 | 10714 | ATCN_2459 | 20901 |
| ATCN_746 | 10715 | ATCN_2460 | 20902 |
| GTCN_646 | 10716 | TTCN_3937 | 20903 |
| ATCN_747 | 10717 | CTCN_3732 | 20904 |
| ATCN_748 | 10718 | TTCN_3938 | 20905 |
| ATCN_749 | 10719 | ATCN_2461 | 20906 |
| ATCN_750 | 10720 | ATCN_2462 | 20907 |
| ATCN_751 | 10721 | TTCN_3939 | 20908 |
| ATCN_752 | 10722 | CTCN_3733 | 20909 |
| ATCN_753 | 10723 | TTCN_3940 | 20910 |
| ATCN_754 | 10724 | TTCN_3941 | 20911 |
| ATCN_755 | 10725 | TTCN_3942 | 20912 |
| ATCN_756 | 10726 | TTCN_3943 | 20913 |
| CTCN_981 | 10727 | ATCN_2463 | 20914 |
| TTCN_1256 | 10728 | ATCN_2464 | 20915 |
| ATCN_757 | 10729 | ATCN_2465 | 20916 |
| TTCN_1257 | 10730 | ATCN_2466 | 20917 |
| CTCN_982 | 10731 | ATCN_2467 | 20918 |
| GTCN_647 | 10732 | TTCN_3944 | 20919 |
| ATCN_758 | 10733 | CTCN_3734 | 20920 |
| ATCN_759 | 10734 | TTCN_3945 | 20921 |
| TTCN_1258 | 10735 | CTCN_3735 | 20922 |
| TTCN_1259 | 10736 | CTCN_3736 | 20923 |
| TTCN_1260 | 10737 | TTCN_3946 | 20924 |
| CTCN_983 | 10738 | GTCN_2136 | 20925 |
| TTCN_1261 | 10739 | TTCN_3947 | 20926 |
| TTCN_1262 | 10740 | CTCN_3737 | 20927 |
| TTCN_1263 | 10741 | GTCN_2137 | 20928 |
| TTCN_1264 | 10742 | CTCN_3738 | 20929 |
| TTCN_1265 | 10743 | TTCN_3948 | 20930 |
| ATCN_760 | 10744 | CTCN_3739 | 20931 |
| GTCN_648 | 10745 | ATCN_2468 | 20932 |
| GTCN_649 | 10746 | GTCN_2138 | 20933 |
| CTCN_984 | 10747 | CTCN_3740 | 20934 |
| CTCN_985 | 10748 | TTCN_3949 | 20935 |
| CTCN_986 | 10749 | CTCN_3741 | 20936 |
| ATCN_761 | 10750 | CTCN_3742 | 20937 |
| CTCN_987 | 10751 | CTCN_3743 | 20938 |
| TTCN_1266 | 10752 | GTCN_2139 | 20939 |
| CTCN_988 | 10753 | CTCN_3744 | 20940 |
| CTCN_989 | 10754 | CTCN_3745 | 20941 |
| CTCN_990 | 10755 | CTCN_3746 | 20942 |
| TTCN_1267 | 10756 | TTCN_3950 | 20943 |
| CTCN_991 | 10757 | GTCN_2140 | 20944 |
| GTCN_650 | 10758 | GTCN_2141 | 20945 |
| TTCN_1268 | 10759 | CTCN_3747 | 20946 |
| CTCN_992 | 10760 | TTCN_3951 | 20947 |
| CTCN_993 | 10761 | CTCN_3748 | 20948 |
| CTCN_994 | 10762 | CTCN_3749 | 20949 |
| CTCN_995 | 10763 | TTCN_3952 | 20950 |
| CTCN_996 | 10764 | CTCN_3750 | 20951 |
| GTCN_651 | 10765 | GTCN_2142 | 20952 |
| CTCN_997 | 10766 | TTCN_3953 | 20953 |

| | | | |
|---|---|---|---|
| ATCN_762 | 10767 | CTCN_3751 | 20954 |
| TTCN_1269 | 10768 | ATCN_2469 | 20955 |
| CTCN_998 | 10769 | TTCN_3954 | 20956 |
| GTCN_652 | 10770 | CTCN_3752 | 20957 |
| CTCN_999 | 10771 | TTCN_3955 | 20958 |
| TTCN_1270 | 10772 | ATCN_2470 | 20959 |
| ATCN_763 | 10773 | TTCN_3956 | 20960 |
| TTCN_1271 | 10774 | TTCN_3957 | 20961 |
| ATCN_764 | 10775 | TTCN_3958 | 20962 |
| ATCN_765 | 10776 | ATCN_2471 | 20963 |
| CTCN_1000 | 10777 | TTCN_3959 | 20964 |
| TTCN_1272 | 10778 | TTCN_3960 | 20965 |
| ATCN_766 | 10779 | ATCN_2472 | 20966 |
| GTCN_653 | 10780 | TTCN_3961 | 20967 |
| ATCN_767 | 10781 | TTCN_3962 | 20968 |
| ATCN_768 | 10782 | GTCN_2143 | 20969 |
| CTCN_1001 | 10783 | TTCN_3963 | 20970 |
| GTCN_654 | 10784 | GTCN_2144 | 20971 |
| ATCN_769 | 10785 | TTCN_3964 | 20972 |
| ATCN_770 | 10786 | ATCN_2473 | 20973 |
| ATCN_771 | 10787 | GTCN_2145 | 20974 |
| CTCN_1002 | 10788 | ATCN_2474 | 20975 |
| CTCN_1003 | 10789 | CTCN_3753 | 20976 |
| CTCN_1004 | 10790 | TTCN_3965 | 20977 |
| TTCN_1273 | 10791 | TTCN_3966 | 20978 |
| CTCN_1005 | 10792 | CTCN_3754 | 20979 |
| ATCN_772 | 10793 | CTCN_3755 | 20980 |
| TTCN_1274 | 10794 | CTCN_3756 | 20981 |
| TTCN_1275 | 10795 | TTCN_3967 | 20982 |
| CTCN_1006 | 10796 | CTCN_3757 | 20983 |
| TTCN_1276 | 10797 | TTCN_3968 | 20984 |
| TTCN_1277 | 10798 | CTCN_3758 | 20985 |
| TTCN_1278 | 10799 | CTCN_3759 | 20986 |
| ATCN_773 | 10800 | CTCN_3760 | 20987 |
| ATCN_774 | 10801 | GTCN_2146 | 20988 |
| ATCN_775 | 10802 | TTCN_3969 | 20989 |
| GTCN_655 | 10803 | CTCN_3761 | 20990 |
| CTCN_1007 | 10804 | TTCN_3970 | 20991 |
| CTCN_1008 | 10805 | ATCN_2475 | 20992 |
| TTCN_1279 | 10806 | GTCN_2147 | 20993 |
| TTCN_1280 | 10807 | CTCN_3762 | 20994 |
| TTCN_1281 | 10808 | TTCN_3971 | 20995 |
| CTCN_1009 | 10809 | CTCN_3763 | 20996 |
| CTCN_1010 | 10810 | TTCN_3972 | 20997 |
| TTCN_1282 | 10811 | TTCN_3973 | 20998 |
| TTCN_1283 | 10812 | TTCN_3974 | 20999 |
| TTCN_1284 | 10813 | TTCN_3975 | 21000 |
| GTCN_656 | 10814 | ATCN_2476 | 21001 |
| ATCN_776 | 10815 | CTCN_3764 | 21002 |
| TTCN_1285 | 10816 | TTCN_3976 | 21003 |
| TTCN_1286 | 10817 | GTCN_2148 | 21004 |
| CTCN_1011 | 10818 | CTCN_3765 | 21005 |
| ATCN_777 | 10819 | GTCN_2149 | 21006 |
| TTCN_1287 | 10820 | CTCN_3766 | 21007 |
| CTCN_1012 | 10821 | TTCN_3977 | 21008 |

FIG. 36 (continued)

| | | | |
|---|---|---|---|
| GTCN_657 | 10822 | GTCN_2150 | 21009 |
| CTCN_1013 | 10823 | TTCN_3978 | 21010 |
| CTCN_1014 | 10824 | TTCN_3979 | 21011 |
| TTCN_1288 | 10825 | CTCN_3767 | 21012 |
| ATCN_778 | 10826 | CTCN_3768 | 21013 |
| GTCN_658 | 10827 | GTCN_2151 | 21014 |
| TTCN_1289 | 10828 | CTCN_3769 | 21015 |
| ATCN_779 | 10829 | CTCN_3770 | 21016 |
| TTCN_1290 | 10830 | ATCN_2477 | 21017 |
| CTCN_1015 | 10831 | TTCN_3980 | 21018 |
| TTCN_1291 | 10832 | CTCN_3771 | 21019 |
| GTCN_659 | 10833 | GTCN_2152 | 21020 |
| TTCN_1292 | 10834 | ATCN_2478 | 21021 |
| GTCN_660 | 10835 | CTCN_3772 | 21022 |
| CTCN_1016 | 10836 | CTCN_3773 | 21023 |
| ATCN_780 | 10837 | CTCN_3774 | 21024 |
| TTCN_1293 | 10838 | CTCN_3775 | 21025 |
| TTCN_1294 | 10839 | TTCN_3981 | 21026 |
| ATCN_781 | 10840 | CTCN_3776 | 21027 |
| GTCN_661 | 10841 | TTCN_3982 | 21028 |
| TTCN_1295 | 10842 | TTCN_3983 | 21029 |
| ATCN_782 | 10843 | CTCN_3777 | 21030 |
| ATCN_783 | 10844 | CTCN_3778 | 21031 |
| TTCN_1296 | 10845 | TTCN_3984 | 21032 |
| ATCN_784 | 10846 | ATCN_2479 | 21033 |
| ATCN_785 | 10847 | TTCN_3985 | 21034 |
| CTCN_1017 | 10848 | CTCN_3779 | 21035 |
| ATCN_786 | 10849 | GTCN_2153 | 21036 |
| CTCN_1018 | 10850 | CTCN_3780 | 21037 |
| TTCN_1297 | 10851 | CTCN_3781 | 21038 |
| TTCN_1298 | 10852 | TTCN_3986 | 21039 |
| ATCN_787 | 10853 | ATCN_2480 | 21040 |
| GTCN_662 | 10854 | CTCN_3782 | 21041 |
| TTCN_1299 | 10855 | CTCN_3783 | 21042 |
| CTCN_1019 | 10856 | TTCN_3987 | 21043 |
| GTCN_663 | 10857 | GTCN_2154 | 21044 |
| ATCN_788 | 10858 | CTCN_3784 | 21045 |
| CTCN_1020 | 10859 | GTCN_2155 | 21046 |
| TTCN_1300 | 10860 | TTCN_3988 | 21047 |
| TTCN_1301 | 10861 | CTCN_3785 | 21048 |
| CTCN_1021 | 10862 | TTCN_3989 | 21049 |
| GTCN_664 | 10863 | CTCN_3786 | 21050 |
| GTCN_665 | 10864 | CTCN_3787 | 21051 |
| TTCN_1302 | 10865 | GTCN_2156 | 21052 |
| TTCN_1303 | 10866 | CTCN_3788 | 21053 |
| ATCN_789 | 10867 | GTCN_2157 | 21054 |
| TTCN_1304 | 10868 | TTCN_3990 | 21055 |
| TTCN_1305 | 10869 | CTCN_3789 | 21056 |
| GTCN_666 | 10870 | TTCN_3991 | 21057 |
| TTCN_1306 | 10871 | TTCN_3992 | 21058 |
| CTCN_1022 | 10872 | TTCN_3993 | 21059 |
| TTCN_1307 | 10873 | ATCN_2481 | 21060 |
| TTCN_1308 | 10874 | ATCN_2482 | 21061 |
| TTCN_1309 | 10875 | ATCN_2483 | 21062 |
| GTCN_667 | 10876 | CTCN_3790 | 21063 |

| | | | |
|---|---|---|---|
| ATCN_790 | 10877 | CTCN_3791 | 21064 |
| TTCN_1310 | 10878 | ATCN_2484 | 21065 |
| TTCN_1311 | 10879 | ATCN_2485 | 21066 |
| ATCN_791 | 10880 | TTCN_3994 | 21067 |
| ATCN_792 | 10881 | TTCN_3995 | 21068 |
| CTCN_1023 | 10882 | TTCN_3996 | 21069 |
| CTCN_1024 | 10883 | ATCN_2486 | 21070 |
| TTCN_1312 | 10884 | ATCN_2487 | 21071 |
| TTCN_1313 | 10885 | CTCN_3792 | 21072 |
| TTCN_1314 | 10886 | CTCN_3793 | 21073 |
| ATCN_793 | 10887 | GTCN_2158 | 21074 |
| CTCN_1025 | 10888 | TTCN_3997 | 21075 |
| GTCN_668 | 10889 | TTCN_3998 | 21076 |
| CTCN_1026 | 10890 | TTCN_3999 | 21077 |
| GTCN_669 | 10891 | TTCN_4000 | 21078 |
| CTCN_1027 | 10892 | CTCN_3794 | 21079 |
| CTCN_1028 | 10893 | TTCN_4001 | 21080 |
| GTCN_670 | 10894 | ATCN_2488 | 21081 |
| TTCN_1315 | 10895 | ATCN_2489 | 21082 |
| GTCN_671 | 10896 | TTCN_4002 | 21083 |
| TTCN_1316 | 10897 | GTCN_2159 | 21084 |
| GTCN_672 | 10898 | GTCN_2160 | 21085 |
| CTCN_1029 | 10899 | CTCN_3795 | 21086 |
| CTCN_1030 | 10900 | CTCN_3796 | 21087 |
| CTCN_1031 | 10901 | GTCN_2161 | 21088 |
| ATCN_794 | 10902 | ATCN_2490 | 21089 |
| TTCN_1317 | 10903 | TTCN_4003 | 21090 |
| CTCN_1032 | 10904 | TTCN_4004 | 21091 |
| CTCN_1033 | 10905 | CTCN_3797 | 21092 |
| ATCN_795 | 10906 | GTCN_2162 | 21093 |
| ATCN_796 | 10907 | CTCN_3798 | 21094 |
| TTCN_1318 | 10908 | TTCN_4005 | 21095 |
| ATCN_797 | 10909 | TTCN_4006 | 21096 |
| ATCN_798 | 10910 | ATCN_2491 | 21097 |
| CTCN_1034 | 10911 | CTCN_3799 | 21098 |
| TTCN_1319 | 10912 | TTCN_4007 | 21099 |
| TTCN_1320 | 10913 | GTCN_2163 | 21100 |
| ATCN_799 | 10914 | TTCN_4008 | 21101 |
| CTCN_1035 | 10915 | TTCN_4009 | 21102 |
| TTCN_1321 | 10916 | CTCN_3800 | 21103 |
| TTCN_1322 | 10917 | ATCN_2492 | 21104 |
| ATCN_800 | 10918 | TTCN_4010 | 21105 |
| ATCN_801 | 10919 | CTCN_3801 | 21106 |
| GTCN_673 | 10920 | GTCN_2164 | 21107 |
| CTCN_1036 | 10921 | ATCN_2493 | 21108 |
| TTCN_1323 | 10922 | GTCN_2165 | 21109 |
| TTCN_1324 | 10923 | TTCN_4011 | 21110 |
| ATCN_802 | 10924 | ATCN_2494 | 21111 |
| CTCN_1037 | 10925 | TTCN_4012 | 21112 |
| TTCN_1325 | 10926 | TTCN_4013 | 21113 |
| GTCN_674 | 10927 | GTCN_2166 | 21114 |
| GTCN_675 | 10928 | ATCN_2495 | 21115 |
| ATCN_803 | 10929 | ATCN_2496 | 21116 |
| TTCN_1326 | 10930 | GTCN_2167 | 21117 |
| TTCN_1327 | 10931 | CTCN_3802 | 21118 |

FIG. 36 (continued)

| | | | |
|---|---|---|---|
| ATCN_804 | 10932 | ATCN_2497 | 21119 |
| ATCN_805 | 10933 | ATCN_2498 | 21120 |
| TTCN_1328 | 10934 | ATCN_2499 | 21121 |
| CTCN_1038 | 10935 | CTCN_3803 | 21122 |
| ATCN_806 | 10936 | ATCN_2500 | 21123 |
| TTCN_1329 | 10937 | ATCN_2501 | 21124 |
| TTCN_1330 | 10938 | ATCN_2502 | 21125 |
| CTCN_1039 | 10939 | GTCN_2168 | 21126 |
| CTCN_1040 | 10940 | CTCN_3804 | 21127 |
| TTCN_1331 | 10941 | TTCN_4014 | 21128 |
| TTCN_1332 | 10942 | CTCN_3805 | 21129 |
| CTCN_1041 | 10943 | CTCN_3806 | 21130 |
| ATCN_807 | 10944 | CTCN_3807 | 21131 |
| ATCN_808 | 10945 | ATCN_2503 | 21132 |
| GTCN_676 | 10946 | TTCN_4015 | 21133 |
| TTCN_1333 | 10947 | CTCN_3808 | 21134 |
| TTCN_1334 | 10948 | ATCN_2504 | 21135 |
| ATCN_809 | 10949 | ATCN_2505 | 21136 |
| CTCN_1042 | 10950 | TTCN_4016 | 21137 |
| GTCN_677 | 10951 | ATCN_2506 | 21138 |
| CTCN_1043 | 10952 | ATCN_2507 | 21139 |
| CTCN_1044 | 10953 | GTCN_2169 | 21140 |
| ATCN_810 | 10954 | CTCN_3809 | 21141 |
| CTCN_1045 | 10955 | ATCN_2508 | 21142 |
| ATCN_811 | 10956 | ATCN_2509 | 21143 |
| GTCN_678 | 10957 | TTCN_4017 | 21144 |
| CTCN_1046 | 10958 | CTCN_3810 | 21145 |
| TTCN_1335 | 10959 | GTCN_2170 | 21146 |
| CTCN_1047 | 10960 | CTCN_3811 | 21147 |
| ATCN_812 | 10961 | TTCN_4018 | 21148 |
| ATCN_813 | 10962 | TTCN_4019 | 21149 |
| ATCN_814 | 10963 | ATCN_2510 | 21150 |
| CTCN_1048 | 10964 | TTCN_4020 | 21151 |
| CTCN_1049 | 10965 | ATCN_2511 | 21152 |
| CTCN_1050 | 10966 | CTCN_3812 | 21153 |
| CTCN_1051 | 10967 | TTCN_4021 | 21154 |
| ATCN_815 | 10968 | CTCN_3813 | 21155 |
| ATCN_816 | 10969 | TTCN_4022 | 21156 |
| GTCN_679 | 10970 | GTCN_2171 | 21157 |
| CTCN_1052 | 10971 | TTCN_4023 | 21158 |
| TTCN_1336 | 10972 | GTCN_2172 | 21159 |
| TTCN_1337 | 10973 | GTCN_2173 | 21160 |
| CTCN_1053 | 10974 | TTCN_4024 | 21161 |
| ATCN_817 | 10975 | CTCN_3814 | 21162 |
| CTCN_1054 | 10976 | TTCN_4025 | 21163 |
| CTCN_1055 | 10977 | CTCN_3815 | 21164 |
| TTCN_1338 | 10978 | TTCN_4026 | 21165 |
| CTCN_1056 | 10979 | GTCN_2174 | 21166 |
| CTCN_1057 | 10980 | CTCN_3816 | 21167 |
| CTCN_1058 | 10981 | ATCN_2512 | 21168 |
| ATCN_818 | 10982 | ATCN_2513 | 21169 |
| ATCN_819 | 10983 | ATCN_2514 | 21170 |
| TTCN_1339 | 10984 | TTCN_4027 | 21171 |
| TTCN_1340 | 10985 | ATCN_2515 | 21172 |
| CTCN_1059 | 10986 | CTCN_3817 | 21173 |

| | | | |
|---|---|---|---|
| CTCN_1060 | 10987 | ATCN_2516 | 21174 |
| TTCN_1341 | 10988 | ATCN_2517 | 21175 |
| TTCN_1342 | 10989 | TTCN_4028 | 21176 |
| TTCN_1343 | 10990 | CTCN_3818 | 21177 |
| TTCN_1344 | 10991 | CTCN_3819 | 21178 |
| TTCN_1345 | 10992 | CTCN_3820 | 21179 |
| GTCN_680 | 10993 | CTCN_3821 | 21180 |
| TTCN_1346 | 10994 | CTCN_3822 | 21181 |
| TTCN_1347 | 10995 | ATCN_2518 | 21182 |
| CTCN_1061 | 10996 | CTCN_3823 | 21183 |
| TTCN_1348 | 10997 | ATCN_2519 | 21184 |
| TTCN_1349 | 10998 | TTCN_4029 | 21185 |
| TTCN_1350 | 10999 | ATCN_2520 | 21186 |
| TTCN_1351 | 11000 | ATCN_2521 | 21187 |
| GTCN_681 | 11001 | CTCN_3824 | 21188 |
| CTCN_1062 | 11002 | GTCN_2175 | 21189 |
| TTCN_1352 | 11003 | CTCN_3825 | 21190 |
| TTCN_1353 | 11004 | TTCN_4030 | 21191 |
| ATCN_820 | 11005 | GTCN_2176 | 21192 |
| TTCN_1354 | 11006 | TTCN_4031 | 21193 |
| TTCN_1355 | 11007 | ATCN_2522 | 21194 |
| CTCN_1063 | 11008 | CTCN_3826 | 21195 |
| CTCN_1064 | 11009 | ATCN_2523 | 21196 |
| ATCN_821 | 11010 | CTCN_3827 | 21197 |
| GTCN_682 | 11011 | CTCN_3828 | 21198 |
| GTCN_683 | 11012 | CTCN_3829 | 21199 |
| GTCN_684 | 11013 | TTCN_4032 | 21200 |
| ATCN_822 | 11014 | TTCN_4033 | 21201 |
| CTCN_1065 | 11015 | TTCN_4034 | 21202 |
| ATCN_823 | 11016 | CTCN_3830 | 21203 |
| ATCN_824 | 11017 | ATCN_2524 | 21204 |
| GTCN_685 | 11018 | CTCN_3831 | 21205 |
| TTCN_1356 | 11019 | CTCN_3832 | 21206 |
| TTCN_1357 | 11020 | ATCN_2525 | 21207 |
| TTCN_1358 | 11021 | ATCN_2526 | 21208 |
| ATCN_825 | 11022 | CTCN_3833 | 21209 |
| CTCN_1066 | 11023 | CTCN_3834 | 21210 |
| ATCN_826 | 11024 | GTCN_2177 | 21211 |
| TTCN_1359 | 11025 | CTCN_3835 | 21212 |
| GTCN_686 | 11026 | ATCN_2527 | 21213 |
| CTCN_1067 | 11027 | ATCN_2528 | 21214 |
| CTCN_1068 | 11028 | CTCN_3836 | 21215 |
| CTCN_1069 | 11029 | ATCN_2529 | 21216 |
| CTCN_1070 | 11030 | CTCN_3837 | 21217 |
| ATCN_827 | 11031 | ATCN_2530 | 21218 |
| GTCN_687 | 11032 | ATCN_2531 | 21219 |
| CTCN_1071 | 11033 | GTCN_2178 | 21220 |
| CTCN_1072 | 11034 | CTCN_3838 | 21221 |
| CTCN_1073 | 11035 | GTCN_2179 | 21222 |
| TTCN_1360 | 11036 | TTCN_4035 | 21223 |
| GTCN_688 | 11037 | GTCN_2180 | 21224 |
| CTCN_1074 | 11038 | CTCN_3839 | 21225 |
| GTCN_689 | 11039 | TTCN_4036 | 21226 |
| CTCN_1075 | 11040 | GTCN_2181 | 21227 |
| CTCN_1076 | 11041 | ATCN_2532 | 21228 |

FIG. 36 (continued)

| | | | |
|---|---|---|---|
| GTCN_690 | 11042 | ATCN_2533 | 21229 |
| CTCN_1077 | 11043 | CTCN_3840 | 21230 |
| GTCN_691 | 11044 | GTCN_2182 | 21231 |
| GTCN_692 | 11045 | GTCN_2183 | 21232 |
| GTCN_693 | 11046 | CTCN_3841 | 21233 |
| CTCN_1078 | 11047 | CTCN_3842 | 21234 |
| CTCN_1079 | 11048 | GTCN_2184 | 21235 |
| TTCN_1361 | 11049 | TTCN_4037 | 21236 |
| TTCN_1362 | 11050 | CTCN_3843 | 21237 |
| GTCN_694 | 11051 | CTCN_3844 | 21238 |
| CTCN_1080 | 11052 | GTCN_2185 | 21239 |
| TTCN_1363 | 11053 | TTCN_4038 | 21240 |
| TTCN_1364 | 11054 | TTCN_4039 | 21241 |
| ATCN_828 | 11055 | TTCN_4040 | 21242 |
| CTCN_1081 | 11056 | CTCN_3845 | 21243 |
| CTCN_1082 | 11057 | CTCN_3846 | 21244 |
| TTCN_1365 | 11058 | TTCN_4041 | 21245 |
| GTCN_695 | 11059 | CTCN_3847 | 21246 |
| GTCN_696 | 11060 | CTCN_3848 | 21247 |
| CTCN_1083 | 11061 | TTCN_4042 | 21248 |
| CTCN_1084 | 11062 | TTCN_4043 | 21249 |
| CTCN_1085 | 11063 | CTCN_3849 | 21250 |
| TTCN_1366 | 11064 | TTCN_4044 | 21251 |
| TTCN_1367 | 11065 | CTCN_3850 | 21252 |
| TTCN_1368 | 11066 | GTCN_2186 | 21253 |
| TTCN_1369 | 11067 | GTCN_2187 | 21254 |
| TTCN_1370 | 11068 | TTCN_4045 | 21255 |
| TTCN_1371 | 11069 | TTCN_4046 | 21256 |
| TTCN_1372 | 11070 | TTCN_4047 | 21257 |
| CTCN_1086 | 11071 | CTCN_3851 | 21258 |
| GTCN_697 | 11072 | TTCN_4048 | 21259 |
| ATCN_829 | 11073 | CTCN_3852 | 21260 |
| CTCN_1087 | 11074 | TTCN_4049 | 21261 |
| TTCN_1373 | 11075 | TTCN_4050 | 21262 |
| ATCN_830 | 11076 | CTCN_3853 | 21263 |
| TTCN_1374 | 11077 | CTCN_3854 | 21264 |
| CTCN_1088 | 11078 | ATCN_2534 | 21265 |
| ATCN_831 | 11079 | ATCN_2535 | 21266 |
| TTCN_1375 | 11080 | GTCN_2188 | 21267 |
| TTCN_1376 | 11081 | ATCN_2536 | 21268 |
| TTCN_1377 | 11082 | GTCN_2189 | 21269 |
| TTCN_1378 | 11083 | ATCN_2537 | 21270 |
| GTCN_698 | 11084 | TTCN_4051 | 21271 |
| TTCN_1379 | 11085 | GTCN_2190 | 21272 |
| ATCN_832 | 11086 | CTCN_3855 | 21273 |
| TTCN_1380 | 11087 | CTCN_3856 | 21274 |
| TTCN_1381 | 11088 | GTCN_2191 | 21275 |
| ATCN_833 | 11089 | CTCN_3857 | 21276 |
| CTCN_1089 | 11090 | TTCN_4052 | 21277 |
| ATCN_834 | 11091 | TTCN_4053 | 21278 |
| GTCN_699 | 11092 | ATCN_2538 | 21279 |
| CTCN_1090 | 11093 | ATCN_2539 | 21280 |
| GTCN_700 | 11094 | TTCN_4054 | 21281 |
| TTCN_1382 | 11095 | GTCN_2192 | 21282 |
| TTCN_1383 | 11096 | CTCN_3858 | 21283 |

| | | | |
|---|---|---|---|
| TTCN_1384 | 11097 | CTCN_3859 | 21284 |
| ATCN_835 | 11098 | CTCN_3860 | 21285 |
| GTCN_701 | 11099 | GTCN_2193 | 21286 |
| TTCN_1385 | 11100 | CTCN_3861 | 21287 |
| TTCN_1386 | 11101 | CTCN_3862 | 21288 |
| ATCN_836 | 11102 | TTCN_4055 | 21289 |
| GTCN_702 | 11103 | CTCN_3863 | 21290 |
| TTCN_1387 | 11104 | TTCN_4056 | 21291 |
| GTCN_703 | 11105 | CTCN_3864 | 21292 |
| CTCN_1091 | 11106 | GTCN_2194 | 21293 |
| TTCN_1388 | 11107 | CTCN_3865 | 21294 |
| TTCN_1389 | 11108 | CTCN_3866 | 21295 |
| CTCN_1092 | 11109 | GTCN_2195 | 21296 |
| CTCN_1093 | 11110 | TTCN_4057 | 21297 |
| CTCN_1094 | 11111 | ATCN_2540 | 21298 |
| CTCN_1095 | 11112 | CTCN_3867 | 21299 |
| GTCN_704 | 11113 | CTCN_3868 | 21300 |
| TTCN_1390 | 11114 | TTCN_4058 | 21301 |
| TTCN_1391 | 11115 | GTCN_2196 | 21302 |
| GTCN_705 | 11116 | TTCN_4059 | 21303 |
| TTCN_1392 | 11117 | CTCN_3869 | 21304 |
| TTCN_1393 | 11118 | CTCN_3870 | 21305 |
| CTCN_1096 | 11119 | TTCN_4060 | 21306 |
| CTCN_1097 | 11120 | CTCN_3871 | 21307 |
| GTCN_706 | 11121 | TTCN_4061 | 21308 |
| GTCN_707 | 11122 | TTCN_4062 | 21309 |
| CTCN_1098 | 11123 | ATCN_2541 | 21310 |
| CTCN_1099 | 11124 | CTCN_3872 | 21311 |
| GTCN_708 | 11125 | TTCN_4063 | 21312 |
| TTCN_1394 | 11126 | ATCN_2542 | 21313 |
| TTCN_1395 | 11127 | TTCN_4064 | 21314 |
| TTCN_1396 | 11128 | ATCN_2543 | 21315 |
| ATCN_837 | 11129 | TTCN_4065 | 21316 |
| TTCN_1397 | 11130 | ATCN_2544 | 21317 |
| TTCN_1398 | 11131 | CTCN_3873 | 21318 |
| TTCN_1399 | 11132 | GTCN_2197 | 21319 |
| TTCN_1400 | 11133 | ATCN_2545 | 21320 |
| TTCN_1401 | 11134 | CTCN_3874 | 21321 |
| TTCN_1402 | 11135 | TTCN_4066 | 21322 |
| ATCN_838 | 11136 | TTCN_4067 | 21323 |
| TTCN_1403 | 11137 | GTCN_2198 | 21324 |
| TTCN_1404 | 11138 | TTCN_4068 | 21325 |
| TTCN_1405 | 11139 | ATCN_2546 | 21326 |
| TTCN_1406 | 11140 | TTCN_4069 | 21327 |
| CTCN_1100 | 11141 | CTCN_3875 | 21328 |
| CTCN_1101 | 11142 | GTCN_2199 | 21329 |
| ATCN_839 | 11143 | CTCN_3876 | 21330 |
| ATCN_840 | 11144 | TTCN_4070 | 21331 |
| TTCN_1407 | 11145 | CTCN_3877 | 21332 |
| CTCN_1102 | 11146 | ATCN_2547 | 21333 |
| GTCN_709 | 11147 | TTCN_4071 | 21334 |
| TTCN_1408 | 11148 | ATCN_2548 | 21335 |
| CTCN_1103 | 11149 | TTCN_4072 | 21336 |
| TTCN_1409 | 11150 | CTCN_3878 | 21337 |
| GTCN_710 | 11151 | TTCN_4073 | 21338 |

FIG. 36 (continued)

| | | | |
|---|---|---|---|
| ATCN_841 | 11152 | ATCN_2549 | 21339 |
| CTCN_1104 | 11153 | TTCN_4074 | 21340 |
| GTCN_711 | 11154 | CTCN_3879 | 21341 |
| GTCN_712 | 11155 | GTCN_2200 | 21342 |
| GTCN_713 | 11156 | CTCN_3880 | 21343 |
| TTCN_1410 | 11157 | CTCN_3881 | 21344 |
| TTCN_1411 | 11158 | CTCN_3882 | 21345 |
| CTCN_1105 | 11159 | GTCN_2201 | 21346 |
| ATCN_842 | 11160 | ATCN_2550 | 21347 |
| TTCN_1412 | 11161 | GTCN_2202 | 21348 |
| CTCN_1106 | 11162 | ATCN_2551 | 21349 |
| CTCN_1107 | 11163 | TTCN_4075 | 21350 |
| ATCN_843 | 11164 | CTCN_3883 | 21351 |
| ATCN_844 | 11165 | GTCN_2203 | 21352 |
| CTCN_1108 | 11166 | GTCN_2204 | 21353 |
| GTCN_714 | 11167 | GTCN_2205 | 21354 |
| CTCN_1109 | 11168 | TTCN_4076 | 21355 |
| ATCN_845 | 11169 | GTCN_2206 | 21356 |
| TTCN_1413 | 11170 | TTCN_4077 | 21357 |
| ATCN_846 | 11171 | ATCN_2552 | 21358 |
| ATCN_847 | 11172 | TTCN_4078 | 21359 |
| GTCN_715 | 11173 | ATCN_2553 | 21360 |
| TTCN_1414 | 11174 | ATCN_2554 | 21361 |
| GTCN_716 | 11175 | TTCN_4079 | 21362 |
| CTCN_1110 | 11176 | CTCN_3884 | 21363 |
| CTCN_1111 | 11177 | CTCN_3885 | 21364 |
| GTCN_717 | 11178 | TTCN_4080 | 21365 |
| GTCN_718 | 11179 | ATCN_2555 | 21366 |
| GTCN_719 | 11180 | GTCN_2207 | 21367 |
| TTCN_1415 | 11181 | TTCN_4081 | 21368 |
| GTCN_720 | 11182 | GTCN_2208 | 21369 |
| CTCN_1112 | 11183 | ATCN_2556 | 21370 |
| TTCN_1416 | 11184 | GTCN_2209 | 21371 |
| TTCN_1417 | 11185 | TTCN_4082 | 21372 |
| CTCN_1113 | 11186 | TTCN_4083 | 21373 |
| GTCN_721 | 11187 | TTCN_4084 | 21374 |
| GTCN_722 | 11188 | CTCN_3886 | 21375 |
| GTCN_723 | 11189 | TTCN_4085 | 21376 |
| GTCN_724 | 11190 | CTCN_3887 | 21377 |
| CTCN_1114 | 11191 | CTCN_3888 | 21378 |
| GTCN_725 | 11192 | CTCN_3889 | 21379 |
| CTCN_1115 | 11193 | CTCN_3890 | 21380 |
| TTCN_1418 | 11194 | ATCN_2557 | 21381 |
| ATCN_848 | 11195 | ATCN_2558 | 21382 |
| TTCN_1419 | 11196 | TTCN_4086 | 21383 |
| TTCN_1420 | 11197 | TTCN_4087 | 21384 |
| GTCN_726 | 11198 | TTCN_4088 | 21385 |
| CTCN_1116 | 11199 | CTCN_3891 | 21386 |
| GTCN_727 | 11200 | CTCN_3892 | 21387 |
| CTCN_1117 | 11201 | TTCN_4089 | 21388 |
| ATCN_849 | 11202 | ATCN_2559 | 21389 |
| TTCN_1421 | 11203 | GTCN_2210 | 21390 |
| ATCN_850 | 11204 | TTCN_4090 | 21391 |
| ATCN_851 | 11205 | GTCN_2211 | 21392 |
| GTCN_728 | 11206 | CTCN_3893 | 21393 |

| | | | |
|---|---|---|---|
| TTCN_1422 | 11207 | CTCN_3894 | 21394 |
| CTCN_1118 | 11208 | ATCN_2560 | 21395 |
| CTCN_1119 | 11209 | CTCN_3895 | 21396 |
| TTCN_1423 | 11210 | CTCN_3896 | 21397 |
| TTCN_1424 | 11211 | CTCN_3897 | 21398 |
| ATCN_852 | 11212 | GTCN_2212 | 21399 |
| GTCN_729 | 11213 | CTCN_3898 | 21400 |
| CTCN_1120 | 11214 | CTCN_3899 | 21401 |
| GTCN_730 | 11215 | CTCN_3900 | 21402 |
| GTCN_731 | 11216 | CTCN_3901 | 21403 |
| TTCN_1425 | 11217 | CTCN_3902 | 21404 |
| TTCN_1426 | 11218 | CTCN_3903 | 21405 |
| ATCN_853 | 11219 | GTCN_2213 | 21406 |
| GTCN_732 | 11220 | CTCN_3904 | 21407 |
| TTCN_1427 | 11221 | TTCN_4091 | 21408 |
| GTCN_733 | 11222 | ATCN_2561 | 21409 |
| ATCN_854 | 11223 | TTCN_4092 | 21410 |
| ATCN_855 | 11224 | ATCN_2562 | 21411 |
| CTCN_1121 | 11225 | TTCN_4093 | 21412 |
| CTCN_1122 | 11226 | ATCN_2563 | 21413 |
| TTCN_1428 | 11227 | ATCN_2564 | 21414 |
| CTCN_1123 | 11228 | ATCN_2565 | 21415 |
| CTCN_1124 | 11229 | CTCN_3905 | 21416 |
| CTCN_1125 | 11230 | TTCN_4094 | 21417 |
| CTCN_1126 | 11231 | CTCN_3906 | 21418 |
| TTCN_1429 | 11232 | TTCN_4095 | 21419 |
| GTCN_734 | 11233 | TTCN_4096 | 21420 |
| GTCN_735 | 11234 | CTCN_3907 | 21421 |
| GTCN_736 | 11235 | CTCN_3908 | 21422 |
| TTCN_1430 | 11236 | ATCN_2566 | 21423 |
| CTCN_1127 | 11237 | TTCN_4097 | 21424 |
| CTCN_1128 | 11238 | ATCN_2567 | 21425 |
| CTCN_1129 | 11239 | TTCN_4098 | 21426 |
| TTCN_1431 | 11240 | CTCN_3909 | 21427 |
| CTCN_1130 | 11241 | CTCN_3910 | 21428 |
| TTCN_1432 | 11242 | TTCN_4099 | 21429 |
| CTCN_1131 | 11243 | TTCN_4100 | 21430 |
| CTCN_1132 | 11244 | TTCN_4101 | 21431 |
| CTCN_1133 | 11245 | GTCN_2214 | 21432 |
| TTCN_1433 | 11246 | TTCN_4102 | 21433 |
| CTCN_1134 | 11247 | TTCN_4103 | 21434 |
| CTCN_1135 | 11248 | TTCN_4104 | 21435 |
| GTCN_737 | 11249 | CTCN_3911 | 21436 |
| GTCN_738 | 11250 | TTCN_4105 | 21437 |
| CTCN_1136 | 11251 | CTCN_3912 | 21438 |
| GTCN_739 | 11252 | CTCN_3913 | 21439 |
| CTCN_1137 | 11253 | CTCN_3914 | 21440 |
| ATCN_856 | 11254 | TTCN_4106 | 21441 |
| ATCN_857 | 11255 | GTCN_2215 | 21442 |
| ATCN_858 | 11256 | CTCN_3915 | 21443 |
| CTCN_1138 | 11257 | CTCN_3916 | 21444 |
| TTCN_1434 | 11258 | CTCN_3917 | 21445 |
| GTCN_740 | 11259 | CTCN_3918 | 21446 |
| CTCN_1139 | 11260 | ATCN_2568 | 21447 |
| GTCN_741 | 11261 | CTCN_3919 | 21448 |

FIG. 36 (continued)

| | | | |
|---|---|---|---|
| TTCN_1435 | 11262 | TTCN_4107 | 21449 |
| CTCN_1140 | 11263 | TTCN_4108 | 21450 |
| TTCN_1436 | 11264 | TTCN_4109 | 21451 |
| ATCN_859 | 11265 | TTCN_4110 | 21452 |
| CTCN_1141 | 11266 | ATCN_2569 | 21453 |
| CTCN_1142 | 11267 | TTCN_4111 | 21454 |
| GTCN_742 | 11268 | GTCN_2216 | 21455 |
| CTCN_1143 | 11269 | TTCN_4112 | 21456 |
| ATCN_860 | 11270 | GTCN_2217 | 21457 |
| CTCN_1144 | 11271 | GTCN_2218 | 21458 |
| GTCN_743 | 11272 | TTCN_4113 | 21459 |
| CTCN_1145 | 11273 | GTCN_2219 | 21460 |
| CTCN_1146 | 11274 | TTCN_4114 | 21461 |
| ATCN_861 | 11275 | ATCN_2570 | 21462 |
| ATCN_862 | 11276 | GTCN_2220 | 21463 |
| CTCN_1147 | 11277 | CTCN_3920 | 21464 |
| CTCN_1148 | 11278 | CTCN_3921 | 21465 |
| GTCN_744 | 11279 | ATCN_2571 | 21466 |
| CTCN_1149 | 11280 | ATCN_2572 | 21467 |
| TTCN_1437 | 11281 | GTCN_2221 | 21468 |
| ATCN_863 | 11282 | CTCN_3922 | 21469 |
| ATCN_864 | 11283 | CTCN_3923 | 21470 |
| GTCN_745 | 11284 | CTCN_3924 | 21471 |
| ATCN_865 | 11285 | CTCN_3925 | 21472 |
| CTCN_1150 | 11286 | CTCN_3926 | 21473 |
| ATCN_866 | 11287 | GTCN_2222 | 21474 |
| GTCN_746 | 11288 | CTCN_3927 | 21475 |
| CTCN_1151 | 11289 | CTCN_3928 | 21476 |
| TTCN_1438 | 11290 | GTCN_2223 | 21477 |
| TTCN_1439 | 11291 | GTCN_2224 | 21478 |
| TTCN_1440 | 11292 | CTCN_3929 | 21479 |
| TTCN_1441 | 11293 | GTCN_2225 | 21480 |
| ATCN_867 | 11294 | TTCN_4115 | 21481 |
| CTCN_1152 | 11295 | CTCN_3930 | 21482 |
| ATCN_868 | 11296 | TTCN_4116 | 21483 |
| TTCN_1442 | 11297 | TTCN_4117 | 21484 |
| CTCN_1153 | 11298 | TTCN_4118 | 21485 |
| TTCN_1443 | 11299 | CTCN_3931 | 21486 |
| GTCN_747 | 11300 | TTCN_4119 | 21487 |
| CTCN_1154 | 11301 | ATCN_2573 | 21488 |
| TTCN_1444 | 11302 | CTCN_3932 | 21489 |
| CTCN_1155 | 11303 | TTCN_4120 | 21490 |
| GTCN_748 | 11304 | GTCN_2226 | 21491 |
| GTCN_749 | 11305 | TTCN_4121 | 21492 |
| CTCN_1156 | 11306 | ATCN_2574 | 21493 |
| ATCN_869 | 11307 | TTCN_4122 | 21494 |
| ATCN_870 | 11308 | TTCN_4123 | 21495 |
| TTCN_1445 | 11309 | TTCN_4124 | 21496 |
| CTCN_1157 | 11310 | CTCN_3933 | 21497 |
| ATCN_871 | 11311 | ATCN_2575 | 21498 |
| CTCN_1158 | 11312 | CTCN_3934 | 21499 |
| ATCN_872 | 11313 | CTCN_3935 | 21500 |
| GTCN_750 | 11314 | CTCN_3936 | 21501 |
| CTCN_1159 | 11315 | TTCN_4125 | 21502 |
| ATCN_873 | 11316 | TTCN_4126 | 21503 |

| | | | |
|---|---|---|---|
| TTCN_1446 | 11317 | CTCN_3937 | 21504 |
| ATCN_874 | 11318 | GTCN_2227 | 21505 |
| TTCN_1447 | 11319 | CTCN_3938 | 21506 |
| TTCN_1448 | 11320 | GTCN_2228 | 21507 |
| GTCN_751 | 11321 | CTCN_3939 | 21508 |
| TTCN_1449 | 11322 | CTCN_3940 | 21509 |
| TTCN_1450 | 11323 | ATCN_2576 | 21510 |
| TTCN_1451 | 11324 | CTCN_3941 | 21511 |
| CTCN_1160 | 11325 | CTCN_3942 | 21512 |
| GTCN_752 | 11326 | GTCN_2229 | 21513 |
| TTCN_1452 | 11327 | TTCN_4127 | 21514 |
| CTCN_1161 | 11328 | ATCN_2577 | 21515 |
| TTCN_1453 | 11329 | GTCN_2230 | 21516 |
| GTCN_753 | 11330 | GTCN_2231 | 21517 |
| CTCN_1162 | 11331 | CTCN_3943 | 21518 |
| CTCN_1163 | 11332 | GTCN_2232 | 21519 |
| ATCN_875 | 11333 | CTCN_3944 | 21520 |
| GTCN_754 | 11334 | ATCN_2578 | 21521 |
| GTCN_755 | 11335 | ATCN_2579 | 21522 |
| CTCN_1164 | 11336 | CTCN_3945 | 21523 |
| GTCN_756 | 11337 | CTCN_3946 | 21524 |
| CTCN_1165 | 11338 | ATCN_2580 | 21525 |
| GTCN_757 | 11339 | TTCN_4128 | 21526 |
| CTCN_1166 | 11340 | CTCN_3947 | 21527 |
| ATCN_876 | 11341 | TTCN_4129 | 21528 |
| CTCN_1167 | 11342 | GTCN_2233 | 21529 |
| CTCN_1168 | 11343 | CTCN_3948 | 21530 |
| TTCN_1454 | 11344 | CTCN_3949 | 21531 |
| CTCN_1169 | 11345 | GTCN_2234 | 21532 |
| TTCN_1455 | 11346 | TTCN_4130 | 21533 |
| TTCN_1456 | 11347 | TTCN_4131 | 21534 |
| ATCN_877 | 11348 | GTCN_2235 | 21535 |
| CTCN_1170 | 11349 | CTCN_3950 | 21536 |
| CTCN_1171 | 11350 | TTCN_4132 | 21537 |
| ATCN_878 | 11351 | ATCN_2581 | 21538 |
| CTCN_1172 | 11352 | TTCN_4133 | 21539 |
| CTCN_1173 | 11353 | CTCN_3951 | 21540 |
| ATCN_879 | 11354 | CTCN_3952 | 21541 |
| ATCN_880 | 11355 | ATCN_2582 | 21542 |
| CTCN_1174 | 11356 | ATCN_2583 | 21543 |
| CTCN_1175 | 11357 | CTCN_3953 | 21544 |
| TTCN_1457 | 11358 | GTCN_2236 | 21545 |
| CTCN_1176 | 11359 | TTCN_4134 | 21546 |
| CTCN_1177 | 11360 | TTCN_4135 | 21547 |
| CTCN_1178 | 11361 | GTCN_2237 | 21548 |
| TTCN_1458 | 11362 | TTCN_4136 | 21549 |
| ATCN_881 | 11363 | TTCN_4137 | 21550 |
| TTCN_1459 | 11364 | TTCN_4138 | 21551 |
| GTCN_758 | 11365 | ATCN_2584 | 21552 |
| TTCN_1460 | 11366 | ATCN_2585 | 21553 |
| TTCN_1461 | 11367 | CTCN_3954 | 21554 |
| ATCN_882 | 11368 | CTCN_3955 | 21555 |
| CTCN_1179 | 11369 | GTCN_2238 | 21556 |
| CTCN_1180 | 11370 | GTCN_2239 | 21557 |
| GTCN_759 | 11371 | TTCN_4139 | 21558 |

FIG. 36 (continued)

| | | | |
|---|---|---|---|
| TTCN_1462 | 11372 | GTCN_2240 | 21559 |
| GTCN_760 | 11373 | ATCN_2586 | 21560 |
| TTCN_1463 | 11374 | CTCN_3956 | 21561 |
| GTCN_761 | 11375 | ATCN_2587 | 21562 |
| CTCN_1181 | 11376 | ATCN_2588 | 21563 |
| TTCN_1464 | 11377 | TTCN_4140 | 21564 |
| CTCN_1182 | 11378 | GTCN_2241 | 21565 |
| TTCN_1465 | 11379 | GTCN_2242 | 21566 |
| ATCN_883 | 11380 | TTCN_4141 | 21567 |
| CTCN_1183 | 11381 | TTCN_4142 | 21568 |
| ATCN_884 | 11382 | TTCN_4143 | 21569 |
| ATCN_885 | 11383 | TTCN_4144 | 21570 |
| ATCN_886 | 11384 | GTCN_2243 | 21571 |
| GTCN_762 | 11385 | CTCN_3957 | 21572 |
| TTCN_1466 | 11386 | GTCN_2244 | 21573 |
| TTCN_1467 | 11387 | ATCN_2589 | 21574 |
| TTCN_1468 | 11388 | TTCN_4145 | 21575 |
| CTCN_1184 | 11389 | TTCN_4146 | 21576 |
| ATCN_887 | 11390 | TTCN_4147 | 21577 |
| ATCN_888 | 11391 | TTCN_4148 | 21578 |
| CTCN_1185 | 11392 | CTCN_3958 | 21579 |
| CTCN_1186 | 11393 | GTCN_2245 | 21580 |
| GTCN_763 | 11394 | ATCN_2590 | 21581 |
| TTCN_1469 | 11395 | TTCN_4149 | 21582 |
| GTCN_764 | 11396 | CTCN_3959 | 21583 |
| TTCN_1470 | 11397 | ATCN_2591 | 21584 |
| CTCN_1187 | 11398 | GTCN_2246 | 21585 |
| TTCN_1471 | 11399 | GTCN_2247 | 21586 |
| TTCN_1472 | 11400 | ATCN_2592 | 21587 |
| TTCN_1473 | 11401 | TTCN_4150 | 21588 |
| TTCN_1474 | 11402 | ATCN_2593 | 21589 |
| CTCN_1188 | 11403 | CTCN_3960 | 21590 |
| CTCN_1189 | 11404 | ATCN_2594 | 21591 |
| CTCN_1190 | 11405 | CTCN_3961 | 21592 |
| TTCN_1475 | 11406 | CTCN_3962 | 21593 |
| TTCN_1476 | 11407 | ATCN_2595 | 21594 |
| GTCN_765 | 11408 | ATCN_2596 | 21595 |
| TTCN_1477 | 11409 | CTCN_3963 | 21596 |
| TTCN_1478 | 11410 | GTCN_2248 | 21597 |
| TTCN_1479 | 11411 | CTCN_3964 | 21598 |
| ATCN_889 | 11412 | CTCN_3965 | 21599 |
| ATCN_890 | 11413 | GTCN_2249 | 21600 |
| GTCN_766 | 11414 | GTCN_2250 | 21601 |
| GTCN_767 | 11415 | CTCN_3966 | 21602 |
| CTCN_1191 | 11416 | TTCN_4151 | 21603 |
| ATCN_891 | 11417 | GTCN_2251 | 21604 |
| ATCN_892 | 11418 | CTCN_3967 | 21605 |
| ATCN_893 | 11419 | ATCN_2597 | 21606 |
| CTCN_1192 | 11420 | CTCN_3968 | 21607 |
| TTCN_1480 | 11421 | CTCN_3969 | 21608 |
| CTCN_1193 | 11422 | CTCN_3970 | 21609 |
| CTCN_1194 | 11423 | TTCN_4152 | 21610 |
| CTCN_1195 | 11424 | TTCN_4153 | 21611 |
| TTCN_1481 | 11425 | CTCN_3971 | 21612 |
| CTCN_1196 | 11426 | CTCN_3972 | 21613 |
| CTCN_1197 | 11427 | CTCN_3973 | 21614 |
| GTCN_768 | 11428 | CTCN_3974 | 21615 |
| TTCN_1482 | 11429 | ATCN_2598 | 21616 |
| CTCN_1198 | 11430 | ATCN_2599 | 21617 |
| ATCN_894 | 11431 | CTCN_3975 | 21618 |
| TTCN_1483 | 11432 | CTCN_3976 | 21619 |
| CTCN_1199 | 11433 | CTCN_3977 | 21620 |
| ATCN_895 | 11434 | CTCN_3978 | 21621 |
| ATCN_896 | 11435 | ATCN_2600 | 21622 |
| TTCN_1484 | 11436 | CTCN_3979 | 21623 |
| TTCN_1485 | 11437 | TTCN_4154 | 21624 |
| GTCN_769 | 11438 | ATCN_2601 | 21625 |
| TTCN_1486 | 11439 | CTCN_3980 | 21626 |
| GTCN_770 | 11440 | ATCN_2602 | 21627 |
| CTCN_1200 | 11441 | CTCN_3981 | 21628 |
| GTCN_771 | 11442 | TTCN_4155 | 21629 |
| TTCN_1487 | 11443 | ATCN_2603 | 21630 |
| ATCN_897 | 11444 | TTCN_4156 | 21631 |
| ATCN_898 | 11445 | GTCN_2252 | 21632 |
| TTCN_1488 | 11446 | ATCN_2604 | 21633 |
| TTCN_1489 | 11447 | TTCN_4157 | 21634 |
| ATCN_899 | 11448 | TTCN_4158 | 21635 |
| GTCN_772 | 11449 | GTCN_2253 | 21636 |
| CTCN_1201 | 11450 | CTCN_3982 | 21637 |
| TTCN_1490 | 11451 | GTCN_2254 | 21638 |
| CTCN_1202 | 11452 | CTCN_3983 | 21639 |
| CTCN_1203 | 11453 | CTCN_3984 | 21640 |
| CTCN_1204 | 11454 | CTCN_3985 | 21641 |
| TTCN_1491 | 11455 | TTCN_4159 | 21642 |
| TTCN_1492 | 11456 | TTCN_4160 | 21643 |
| ATCN_900 | 11457 | TTCN_4161 | 21644 |
| TTCN_1493 | 11458 | ATCN_2605 | 21645 |
| ATCN_901 | 11459 | CTCN_3986 | 21646 |
| CTCN_1205 | 11460 | GTCN_2255 | 21647 |
| CTCN_1206 | 11461 | CTCN_3987 | 21648 |
| GTCN_773 | 11462 | TTCN_4162 | 21649 |
| CTCN_1207 | 11463 | ATCN_2606 | 21650 |
| ATCN_902 | 11464 | CTCN_3988 | 21651 |
| TTCN_1494 | 11465 | CTCN_3989 | 21652 |
| TTCN_1495 | 11466 | ATCN_2607 | 21653 |
| CTCN_1208 | 11467 | TTCN_4163 | 21654 |
| TTCN_1496 | 11468 | CTCN_3990 | 21655 |
| TTCN_1497 | 11469 | ATCN_2608 | 21656 |
| GTCN_774 | 11470 | ATCN_2609 | 21657 |
| TTCN_1498 | 11471 | CTCN_3991 | 21658 |
| GTCN_775 | 11472 | GTCN_2256 | 21659 |
| GTCN_776 | 11473 | TTCN_4164 | 21660 |
| TTCN_1499 | 11474 | ATCN_2610 | 21661 |
| ATCN_903 | 11475 | TTCN_4165 | 21662 |
| GTCN_777 | 11476 | CTCN_3992 | 21663 |
| GTCN_778 | 11477 | CTCN_3993 | 21664 |
| CTCN_1209 | 11478 | ATCN_2611 | 21665 |
| CTCN_1210 | 11479 | GTCN_2257 | 21666 |
| ATCN_904 | 11480 | GTCN_2258 | 21667 |
| GTCN_779 | 11481 | CTCN_3994 | 21668 |

FIG. 36 (continued)

| | | | |
|---|---|---|---|
| TTCN_1500 | 11482 | TTCN_4166 | 21669 |
| GTCN_780 | 11483 | ATCN_2612 | 21670 |
| GTCN_781 | 11484 | CTCN_3995 | 21671 |
| TTCN_1501 | 11485 | TTCN_4167 | 21672 |
| TTCN_1502 | 11486 | CTCN_3996 | 21673 |
| CTCN_1211 | 11487 | CTCN_3997 | 21674 |
| TTCN_1503 | 11488 | TTCN_4168 | 21675 |
| TTCN_1504 | 11489 | ATCN_2613 | 21676 |
| GTCN_782 | 11490 | TTCN_4169 | 21677 |
| CTCN_1212 | 11491 | CTCN_3998 | 21678 |
| GTCN_783 | 11492 | ATCN_2614 | 21679 |
| CTCN_1213 | 11493 | GTCN_2259 | 21680 |
| TTCN_1505 | 11494 | ATCN_2615 | 21681 |
| CTCN_1214 | 11495 | TTCN_4170 | 21682 |
| CTCN_1215 | 11496 | GTCN_2260 | 21683 |
| GTCN_784 | 11497 | CTCN_3999 | 21684 |
| GTCN_785 | 11498 | TTCN_4171 | 21685 |
| CTCN_1216 | 11499 | TTCN_4172 | 21686 |
| GTCN_786 | 11500 | CTCN_4000 | 21687 |
| GTCN_787 | 11501 | ATCN_2616 | 21688 |
| GTCN_788 | 11502 | TTCN_4173 | 21689 |
| TTCN_1506 | 11503 | CTCN_4001 | 21690 |
| GTCN_789 | 11504 | TTCN_4174 | 21691 |
| ATCN_905 | 11505 | CTCN_4002 | 21692 |
| GTCN_790 | 11506 | TTCN_4175 | 21693 |
| CTCN_1217 | 11507 | ATCN_2617 | 21694 |
| CTCN_1218 | 11508 | TTCN_4176 | 21695 |
| TTCN_1507 | 11509 | TTCN_4177 | 21696 |
| TTCN_1508 | 11510 | GTCN_2261 | 21697 |
| GTCN_791 | 11511 | GTCN_2262 | 21698 |
| CTCN_1219 | 11512 | TTCN_4178 | 21699 |
| CTCN_1220 | 11513 | GTCN_2263 | 21700 |
| ATCN_906 | 11514 | TTCN_4179 | 21701 |
| ATCN_907 | 11515 | ATCN_2618 | 21702 |
| TTCN_1509 | 11516 | GTCN_2264 | 21703 |
| CTCN_1221 | 11517 | TTCN_4180 | 21704 |
| GTCN_792 | 11518 | CTCN_4003 | 21705 |
| CTCN_1222 | 11519 | ATCN_2619 | 21706 |
| TTCN_1510 | 11520 | ATCN_2620 | 21707 |
| GTCN_793 | 11521 | GTCN_2265 | 21708 |
| ATCN_908 | 11522 | ATCN_2621 | 21709 |
| TTCN_1511 | 11523 | CTCN_4004 | 21710 |
| TTCN_1512 | 11524 | TTCN_4181 | 21711 |
| ATCN_909 | 11525 | TTCN_4182 | 21712 |
| ATCN_910 | 11526 | TTCN_4183 | 21713 |
| GTCN_794 | 11527 | CTCN_4005 | 21714 |
| TTCN_1513 | 11528 | GTCN_2266 | 21715 |
| TTCN_1514 | 11529 | TTCN_4184 | 21716 |
| TTCN_1515 | 11530 | ATCN_2622 | 21717 |
| TTCN_1516 | 11531 | TTCN_4185 | 21718 |
| TTCN_1517 | 11532 | CTCN_4006 | 21719 |
| TTCN_1518 | 11533 | CTCN_4007 | 21720 |
| CTCN_1223 | 11534 | TTCN_4186 | 21721 |
| ATCN_911 | 11535 | TTCN_4187 | 21722 |
| CTCN_1224 | 11536 | TTCN_4188 | 21723 |

| | | | |
|---|---|---|---|
| CTCN_1225 | 11537 | ATCN_2623 | 21724 |
| ATCN_912 | 11538 | GTCN_2267 | 21725 |
| CTCN_1226 | 11539 | TTCN_4189 | 21726 |
| CTCN_1227 | 11540 | CTCN_4008 | 21727 |
| TTCN_1519 | 11541 | GTCN_2268 | 21728 |
| ATCN_913 | 11542 | CTCN_4009 | 21729 |
| ATCN_914 | 11543 | TTCN_4190 | 21730 |
| CTCN_1228 | 11544 | TTCN_4191 | 21731 |
| GTCN_795 | 11545 | TTCN_4192 | 21732 |
| CTCN_1229 | 11546 | ATCN_2624 | 21733 |
| ATCN_915 | 11547 | TTCN_4193 | 21734 |
| GTCN_796 | 11548 | TTCN_4194 | 21735 |
| ATCN_916 | 11549 | CTCN_4010 | 21736 |
| TTCN_1520 | 11550 | ATCN_2625 | 21737 |
| ATCN_917 | 11551 | TTCN_4195 | 21738 |
| CTCN_1230 | 11552 | TTCN_4196 | 21739 |
| GTCN_797 | 11553 | GTCN_2269 | 21740 |
| CTCN_1231 | 11554 | CTCN_4011 | 21741 |
| CTCN_1232 | 11555 | TTCN_4197 | 21742 |
| CTCN_1233 | 11556 | ATCN_2626 | 21743 |
| CTCN_1234 | 11557 | TTCN_4198 | 21744 |
| TTCN_1521 | 11558 | ATCN_2627 | 21745 |
| ATCN_918 | 11559 | ATCN_2628 | 21746 |
| TTCN_1522 | 11560 | CTCN_4012 | 21747 |
| TTCN_1523 | 11561 | TTCN_4199 | 21748 |
| CTCN_1235 | 11562 | TTCN_4200 | 21749 |
| CTCN_1236 | 11563 | GTCN_2270 | 21750 |
| ATCN_919 | 11564 | GTCN_2271 | 21751 |
| ATCN_920 | 11565 | TTCN_4201 | 21752 |
| CTCN_1237 | 11566 | GTCN_2272 | 21753 |
| GTCN_798 | 11567 | TTCN_4202 | 21754 |
| CTCN_1238 | 11568 | TTCN_4203 | 21755 |
| CTCN_1239 | 11569 | CTCN_4013 | 21756 |
| GTCN_799 | 11570 | TTCN_4204 | 21757 |
| ATCN_921 | 11571 | CTCN_4014 | 21758 |
| CTCN_1240 | 11572 | CTCN_4015 | 21759 |
| TTCN_1524 | 11573 | TTCN_4205 | 21760 |
| TTCN_1525 | 11574 | CTCN_4016 | 21761 |
| TTCN_1526 | 11575 | GTCN_2273 | 21762 |
| CTCN_1241 | 11576 | TTCN_4206 | 21763 |
| TTCN_1527 | 11577 | CTCN_4017 | 21764 |
| CTCN_1242 | 11578 | TTCN_4207 | 21765 |
| GTCN_800 | 11579 | ATCN_2629 | 21766 |
| GTCN_801 | 11580 | TTCN_4208 | 21767 |
| CTCN_1243 | 11581 | ATCN_2630 | 21768 |
| GTCN_802 | 11582 | TTCN_4209 | 21769 |
| CTCN_1244 | 11583 | CTCN_4018 | 21770 |
| ATCN_922 | 11584 | CTCN_4019 | 21771 |
| TTCN_1528 | 11585 | CTCN_4020 | 21772 |
| CTCN_1245 | 11586 | CTCN_4021 | 21773 |
| TTCN_1529 | 11587 | CTCN_4022 | 21774 |
| GTCN_803 | 11588 | TTCN_4210 | 21775 |
| TTCN_1530 | 11589 | TTCN_4211 | 21776 |
| GTCN_804 | 11590 | TTCN_4212 | 21777 |
| TTCN_1531 | 11591 | CTCN_4023 | 21778 |

FIG. 36 (continued)

| | | | |
|---|---|---|---|
| ATCN_923 | 11592 | ATCN_2631 | 21779 |
| ATCN_924 | 11593 | TTCN_4213 | 21780 |
| ATCN_925 | 11594 | TTCN_4214 | 21781 |
| TTCN_1532 | 11595 | GTCN_2274 | 21782 |
| ATCN_926 | 11596 | TTCN_4215 | 21783 |
| ATCN_927 | 11597 | CTCN_4024 | 21784 |
| ATCN_928 | 11598 | TTCN_4216 | 21785 |
| CTCN_1246 | 11599 | CTCN_4025 | 21786 |
| TTCN_1533 | 11600 | CTCN_4026 | 21787 |
| GTCN_805 | 11601 | ATCN_2632 | 21788 |
| GTCN_806 | 11602 | TTCN_4217 | 21789 |
| TTCN_1534 | 11603 | TTCN_4218 | 21790 |
| TTCN_1535 | 11604 | ATCN_2633 | 21791 |
| CTCN_1247 | 11605 | GTCN_2275 | 21792 |
| CTCN_1248 | 11606 | ATCN_2634 | 21793 |
| GTCN_807 | 11607 | CTCN_4027 | 21794 |
| TTCN_1536 | 11608 | TTCN_4219 | 21795 |
| CTCN_1249 | 11609 | CTCN_4028 | 21796 |
| TTCN_1537 | 11610 | ATCN_2635 | 21797 |
| ATCN_929 | 11611 | TTCN_4220 | 21798 |
| ATCN_930 | 11612 | TTCN_4221 | 21799 |
| CTCN_1250 | 11613 | CTCN_4029 | 21800 |
| CTCN_1251 | 11614 | TTCN_4222 | 21801 |
| TTCN_1538 | 11615 | TTCN_4223 | 21802 |
| CTCN_1252 | 11616 | TTCN_4224 | 21803 |
| ATCN_931 | 11617 | GTCN_2276 | 21804 |
| TTCN_1539 | 11618 | ATCN_2636 | 21805 |
| ATCN_932 | 11619 | CTCN_4030 | 21806 |
| GTCN_808 | 11620 | GTCN_2277 | 21807 |
| TTCN_1540 | 11621 | ATCN_2637 | 21808 |
| CTCN_1253 | 11622 | TTCN_4225 | 21809 |
| TTCN_1541 | 11623 | ATCN_2638 | 21810 |
| TTCN_1542 | 11624 | TTCN_4226 | 21811 |
| ATCN_933 | 11625 | GTCN_2278 | 21812 |
| CTCN_1254 | 11626 | TTCN_4227 | 21813 |
| ATCN_934 | 11627 | CTCN_4031 | 21814 |
| TTCN_1543 | 11628 | GTCN_2279 | 21815 |
| CTCN_1255 | 11629 | CTCN_4032 | 21816 |
| CTCN_1256 | 11630 | TTCN_4228 | 21817 |
| ATCN_935 | 11631 | TTCN_4229 | 21818 |
| TTCN_1544 | 11632 | TTCN_4230 | 21819 |
| GTCN_809 | 11633 | TTCN_4231 | 21820 |
| ATCN_936 | 11634 | TTCN_4232 | 21821 |
| ATCN_937 | 11635 | CTCN_4033 | 21822 |
| ATCN_938 | 11636 | ATCN_2639 | 21823 |
| GTCN_810 | 11637 | TTCN_4233 | 21824 |
| CTCN_1257 | 11638 | GTCN_2280 | 21825 |
| TTCN_1545 | 11639 | TTCN_4234 | 21826 |
| TTCN_1546 | 11640 | TTCN_4235 | 21827 |
| CTCN_1258 | 11641 | ATCN_2640 | 21828 |
| CTCN_1259 | 11642 | TTCN_4236 | 21829 |
| CTCN_1260 | 11643 | TTCN_4237 | 21830 |
| TTCN_1547 | 11644 | CTCN_4034 | 21831 |
| CTCN_1261 | 11645 | GTCN_2281 | 21832 |
| CTCN_1262 | 11646 | GTCN_2282 | 21833 |

| | | | |
|---|---|---|---|
| GTCN_811 | 11647 | CTCN_4035 | 21834 |
| TTCN_1548 | 11648 | CTCN_4036 | 21835 |
| CTCN_1263 | 11649 | GTCN_2283 | 21836 |
| ATCN_939 | 11650 | TTCN_4238 | 21837 |
| TTCN_1549 | 11651 | GTCN_2284 | 21838 |
| CTCN_1264 | 11652 | GTCN_2285 | 21839 |
| ATCN_940 | 11653 | TTCN_4239 | 21840 |
| ATCN_941 | 11654 | TTCN_4240 | 21841 |
| TTCN_1550 | 11655 | CTCN_4037 | 21842 |
| TTCN_1551 | 11656 | CTCN_4038 | 21843 |
| GTCN_812 | 11657 | CTCN_4039 | 21844 |
| TTCN_1552 | 11658 | CTCN_4040 | 21845 |
| GTCN_813 | 11659 | TTCN_4241 | 21846 |
| CTCN_1265 | 11660 | TTCN_4242 | 21847 |
| GTCN_814 | 11661 | ATCN_2641 | 21848 |
| TTCN_1553 | 11662 | TTCN_4243 | 21849 |
| ATCN_942 | 11663 | ATCN_2642 | 21850 |
| TTCN_1554 | 11664 | TTCN_4244 | 21851 |
| TTCN_1555 | 11665 | CTCN_4041 | 21852 |
| TTCN_1556 | 11666 | TTCN_4245 | 21853 |
| CTCN_1266 | 11667 | ATCN_2643 | 21854 |
| CTCN_1267 | 11668 | TTCN_4246 | 21855 |
| CTCN_1268 | 11669 | TTCN_4247 | 21856 |
| TTCN_1557 | 11670 | TTCN_4248 | 21857 |
| CTCN_1269 | 11671 | TTCN_4249 | 21858 |
| GTCN_815 | 11672 | TTCN_4250 | 21859 |
| CTCN_1270 | 11673 | ATCN_2644 | 21860 |
| TTCN_1558 | 11674 | CTCN_4042 | 21861 |
| CTCN_1271 | 11675 | GTCN_2286 | 21862 |
| ATCN_943 | 11676 | TTCN_4251 | 21863 |
| ATCN_944 | 11677 | TTCN_4252 | 21864 |
| TTCN_1559 | 11678 | ATCN_2645 | 21865 |
| TTCN_1560 | 11679 | TTCN_4253 | 21866 |
| TTCN_1561 | 11680 | TTCN_4254 | 21867 |
| TTCN_1562 | 11681 | TTCN_4255 | 21868 |
| TTCN_1563 | 11682 | CTCN_4043 | 21869 |
| GTCN_816 | 11683 | TTCN_4256 | 21870 |
| TTCN_1564 | 11684 | CTCN_4044 | 21871 |
| GTCN_817 | 11685 | TTCN_4257 | 21872 |
| GTCN_818 | 11686 | CTCN_4045 | 21873 |
| GTCN_819 | 11687 | ATCN_2646 | 21874 |
| TTCN_1565 | 11688 | ATCN_2647 | 21875 |
| GTCN_820 | 11689 | CTCN_4046 | 21876 |
| TTCN_1566 | 11690 | TTCN_4258 | 21877 |
| CTCN_1272 | 11691 | CTCN_4047 | 21878 |
| GTCN_821 | 11692 | ATCN_2648 | 21879 |
| TTCN_1567 | 11693 | TTCN_4259 | 21880 |
| GTCN_822 | 11694 | GTCN_2287 | 21881 |
| CTCN_1273 | 11695 | CTCN_4048 | 21882 |
| CTCN_1274 | 11696 | CTCN_4049 | 21883 |
| ATCN_945 | 11697 | GTCN_2288 | 21884 |
| ATCN_946 | 11698 | CTCN_4050 | 21885 |
| ATCN_947 | 11699 | CTCN_4051 | 21886 |
| CTCN_1275 | 11700 | TTCN_4260 | 21887 |
| ATCN_948 | 11701 | GTCN_2289 | 21888 |

FIG. 36 (continued)

| | | | |
|---|---|---|---|
| ATCN_949 | 11702 | CTCN_4052 | 21889 |
| ATCN_950 | 11703 | CTCN_4053 | 21890 |
| CTCN_1276 | 11704 | GTCN_2290 | 21891 |
| GTCN_823 | 11705 | CTCN_4054 | 21892 |
| GTCN_824 | 11706 | ATCN_2649 | 21893 |
| GTCN_825 | 11707 | TTCN_4261 | 21894 |
| CTCN_1277 | 11708 | ATCN_2650 | 21895 |
| TTCN_1568 | 11709 | CTCN_4055 | 21896 |
| CTCN_1278 | 11710 | GTCN_2291 | 21897 |
| TTCN_1569 | 11711 | CTCN_4056 | 21898 |
| ATCN_951 | 11712 | CTCN_4057 | 21899 |
| ATCN_952 | 11713 | TTCN_4262 | 21900 |
| GTCN_826 | 11714 | TTCN_4263 | 21901 |
| GTCN_827 | 11715 | TTCN_4264 | 21902 |
| GTCN_828 | 11716 | TTCN_4265 | 21903 |
| ATCN_953 | 11717 | CTCN_4058 | 21904 |
| TTCN_1570 | 11718 | TTCN_4266 | 21905 |
| GTCN_829 | 11719 | GTCN_2292 | 21906 |
| TTCN_1571 | 11720 | CTCN_4059 | 21907 |
| ATCN_954 | 11721 | ATCN_2651 | 21908 |
| CTCN_1279 | 11722 | TTCN_4267 | 21909 |
| TTCN_1572 | 11723 | ATCN_2652 | 21910 |
| GTCN_830 | 11724 | TTCN_4268 | 21911 |
| CTCN_1280 | 11725 | CTCN_4060 | 21912 |
| TTCN_1573 | 11726 | CTCN_4061 | 21913 |
| TTCN_1574 | 11727 | ATCN_2653 | 21914 |
| CTCN_1281 | 11728 | GTCN_2293 | 21915 |
| TTCN_1575 | 11729 | TTCN_4269 | 21916 |
| CTCN_1282 | 11730 | TTCN_4270 | 21917 |
| TTCN_1576 | 11731 | TTCN_4271 | 21918 |
| CTCN_1283 | 11732 | TTCN_4272 | 21919 |
| GTCN_831 | 11733 | TTCN_4273 | 21920 |
| CTCN_1284 | 11734 | TTCN_4274 | 21921 |
| GTCN_832 | 11735 | TTCN_4275 | 21922 |
| CTCN_1285 | 11736 | ATCN_2654 | 21923 |
| CTCN_1286 | 11737 | TTCN_4276 | 21924 |
| TTCN_1577 | 11738 | TTCN_4277 | 21925 |
| TTCN_1578 | 11739 | CTCN_4062 | 21926 |
| ATCN_955 | 11740 | TTCN_4278 | 21927 |
| GTCN_833 | 11741 | TTCN_4279 | 21928 |
| TTCN_1579 | 11742 | GTCN_2294 | 21929 |
| TTCN_1580 | 11743 | TTCN_4280 | 21930 |
| GTCN_834 | 11744 | CTCN_4063 | 21931 |
| ATCN_956 | 11745 | TTCN_4281 | 21932 |
| CTCN_1287 | 11746 | TTCN_4282 | 21933 |
| ATCN_957 | 11747 | ATCN_2655 | 21934 |
| TTCN_1581 | 11748 | TTCN_4283 | 21935 |
| TTCN_1582 | 11749 | CTCN_4064 | 21936 |
| CTCN_1288 | 11750 | CTCN_4065 | 21937 |
| ATCN_958 | 11751 | GTCN_2295 | 21938 |
| ATCN_959 | 11752 | ATCN_2656 | 21939 |
| GTCN_835 | 11753 | TTCN_4284 | 21940 |
| CTCN_1289 | 11754 | GTCN_2296 | 21941 |
| ATCN_960 | 11755 | CTCN_4066 | 21942 |
| ATCN_961 | 11756 | GTCN_2297 | 21943 |

| | | | |
|---|---|---|---|
| TTCN_1583 | 11757 | CTCN_4067 | 21944 |
| GTCN_836 | 11758 | ATCN_2657 | 21945 |
| TTCN_1584 | 11759 | ATCN_2658 | 21946 |
| CTCN_1290 | 11760 | CTCN_4068 | 21947 |
| ATCN_962 | 11761 | GTCN_2298 | 21948 |
| TTCN_1585 | 11762 | CTCN_4069 | 21949 |
| ATCN_963 | 11763 | CTCN_4070 | 21950 |
| CTCN_1291 | 11764 | TTCN_4285 | 21951 |
| GTCN_837 | 11765 | ATCN_2659 | 21952 |
| TTCN_1586 | 11766 | TTCN_4286 | 21953 |
| TTCN_1587 | 11767 | CTCN_4071 | 21954 |
| TTCN_1588 | 11768 | TTCN_4287 | 21955 |
| TTCN_1589 | 11769 | CTCN_4072 | 21956 |
| GTCN_838 | 11770 | ATCN_2660 | 21957 |
| CTCN_1292 | 11771 | CTCN_4073 | 21958 |
| ATCN_964 | 11772 | ATCN_2661 | 21959 |
| GTCN_839 | 11773 | TTCN_4288 | 21960 |
| CTCN_1293 | 11774 | GTCN_2299 | 21961 |
| ATCN_965 | 11775 | GTCN_2300 | 21962 |
| GTCN_840 | 11776 | CTCN_4074 | 21963 |
| TTCN_1590 | 11777 | TTCN_4289 | 21964 |
| ATCN_966 | 11778 | CTCN_4075 | 21965 |
| CTCN_1294 | 11779 | GTCN_2301 | 21966 |
| CTCN_1295 | 11780 | CTCN_4076 | 21967 |
| TTCN_1591 | 11781 | ATCN_2662 | 21968 |
| ATCN_967 | 11782 | ATCN_2663 | 21969 |
| CTCN_1296 | 11783 | CTCN_4077 | 21970 |
| CTCN_1297 | 11784 | ATCN_2664 | 21971 |
| ATCN_968 | 11785 | ATCN_2665 | 21972 |
| CTCN_1298 | 11786 | TTCN_4290 | 21973 |
| GTCN_841 | 11787 | CTCN_4078 | 21974 |
| CTCN_1299 | 11788 | CTCN_4079 | 21975 |
| TTCN_1592 | 11789 | CTCN_4080 | 21976 |
| GTCN_842 | 11790 | GTCN_2302 | 21977 |
| ATCN_969 | 11791 | ATCN_2666 | 21978 |
| ATCN_970 | 11792 | ATCN_2667 | 21979 |
| TTCN_1593 | 11793 | TTCN_4291 | 21980 |
| ATCN_971 | 11794 | TTCN_4292 | 21981 |
| CTCN_1300 | 11795 | GTCN_2303 | 21982 |
| TTCN_1594 | 11796 | TTCN_4293 | 21983 |
| TTCN_1595 | 11797 | TTCN_4294 | 21984 |
| CTCN_1301 | 11798 | ATCN_2668 | 21985 |
| TTCN_1596 | 11799 | ATCN_2669 | 21986 |
| ATCN_972 | 11800 | ATCN_2670 | 21987 |
| CTCN_1302 | 11801 | ATCN_2671 | 21988 |
| TTCN_1597 | 11802 | ATCN_2672 | 21989 |
| CTCN_1303 | 11803 | CTCN_4081 | 21990 |
| CTCN_1304 | 11804 | GTCN_2304 | 21991 |
| ATCN_973 | 11805 | TTCN_4295 | 21992 |
| CTCN_1305 | 11806 | GTCN_2305 | 21993 |
| ATCN_974 | 11807 | CTCN_4082 | 21994 |
| ATCN_975 | 11808 | CTCN_4083 | 21995 |
| TTCN_1598 | 11809 | CTCN_4084 | 21996 |
| ATCN_976 | 11810 | GTCN_2306 | 21997 |
| CTCN_1306 | 11811 | CTCN_4085 | 21998 |

FIG. 36 (continued)

| | | | |
|---|---|---|---|
| CTCN_1307 | 11812 | ATCN_2673 | 21999 |
| GTCN_843 | 11813 | TTCN_4296 | 22000 |
| CTCN_1308 | 11814 | TTCN_4297 | 22001 |
| GTCN_844 | 11815 | TTCN_4298 | 22002 |
| CTCN_1309 | 11816 | ATCN_2674 | 22003 |
| TTCN_1599 | 11817 | ATCN_2675 | 22004 |
| TTCN_1600 | 11818 | TTCN_4299 | 22005 |
| TTCN_1601 | 11819 | CTCN_4086 | 22006 |
| CTCN_1310 | 11820 | ATCN_2676 | 22007 |
| GTCN_845 | 11821 | ATCN_2677 | 22008 |
| CTCN_1311 | 11822 | GTCN_2307 | 22009 |
| GTCN_846 | 11823 | TTCN_4300 | 22010 |
| CTCN_1312 | 11824 | CTCN_4087 | 22011 |
| TTCN_1602 | 11825 | TTCN_4301 | 22012 |
| CTCN_1313 | 11826 | ATCN_2678 | 22013 |
| CTCN_1314 | 11827 | TTCN_4302 | 22014 |
| TTCN_1603 | 11828 | TTCN_4303 | 22015 |
| TTCN_1604 | 11829 | CTCN_4088 | 22016 |
| TTCN_1605 | 11830 | GTCN_2308 | 22017 |
| CTCN_1315 | 11831 | CTCN_4089 | 22018 |
| CTCN_1316 | 11832 | TTCN_4304 | 22019 |
| TTCN_1606 | 11833 | TTCN_4305 | 22020 |
| TTCN_1607 | 11834 | TTCN_4306 | 22021 |
| TTCN_1608 | 11835 | TTCN_4307 | 22022 |
| CTCN_1317 | 11836 | TTCN_4308 | 22023 |
| CTCN_1318 | 11837 | GTCN_2309 | 22024 |
| CTCN_1319 | 11838 | ATCN_2679 | 22025 |
| CTCN_1320 | 11839 | CTCN_4090 | 22026 |
| TTCN_1609 | 11840 | CTCN_4091 | 22027 |
| CTCN_1321 | 11841 | ATCN_2680 | 22028 |
| ATCN_977 | 11842 | ATCN_2681 | 22029 |
| ATCN_978 | 11843 | GTCN_2310 | 22030 |
| ATCN_979 | 11844 | TTCN_4309 | 22031 |
| TTCN_1610 | 11845 | GTCN_2311 | 22032 |
| TTCN_1611 | 11846 | CTCN_4092 | 22033 |
| CTCN_1322 | 11847 | TTCN_4310 | 22034 |
| GTCN_847 | 11848 | GTCN_2312 | 22035 |
| GTCN_848 | 11849 | TTCN_4311 | 22036 |
| TTCN_1612 | 11850 | GTCN_2313 | 22037 |
| CTCN_1323 | 11851 | TTCN_4312 | 22038 |
| CTCN_1324 | 11852 | TTCN_4313 | 22039 |
| CTCN_1325 | 11853 | GTCN_2314 | 22040 |
| TTCN_1613 | 11854 | ATCN_2682 | 22041 |
| ATCN_980 | 11855 | TTCN_4314 | 22042 |
| GTCN_849 | 11856 | ATCN_2683 | 22043 |
| CTCN_1326 | 11857 | ATCN_2684 | 22044 |
| CTCN_1327 | 11858 | TTCN_4315 | 22045 |
| GTCN_850 | 11859 | TTCN_4316 | 22046 |
| ATCN_981 | 11860 | GTCN_2315 | 22047 |
| ATCN_982 | 11861 | CTCN_4093 | 22048 |
| TTCN_1614 | 11862 | ATCN_2685 | 22049 |
| ATCN_983 | 11863 | TTCN_4317 | 22050 |
| TTCN_1615 | 11864 | ATCN_2686 | 22051 |
| CTCN_1328 | 11865 | GTCN_2316 | 22052 |
| CTCN_1329 | 11866 | TTCN_4318 | 22053 |

| | | | |
|---|---|---|---|
| CTCN_1330 | 11867 | TTCN_4319 | 22054 |
| ATCN_984 | 11868 | ATCN_2687 | 22055 |
| ATCN_985 | 11869 | TTCN_4320 | 22056 |
| ATCN_986 | 11870 | TTCN_4321 | 22057 |
| TTCN_1616 | 11871 | CTCN_4094 | 22058 |
| GTCN_851 | 11872 | ATCN_2688 | 22059 |
| CTCN_1331 | 11873 | CTCN_4095 | 22060 |
| TTCN_1617 | 11874 | TTCN_4322 | 22061 |
| TTCN_1618 | 11875 | GTCN_2317 | 22062 |
| TTCN_1619 | 11876 | ATCN_2689 | 22063 |
| TTCN_1620 | 11877 | TTCN_4323 | 22064 |
| TTCN_1621 | 11878 | ATCN_2690 | 22065 |
| TTCN_1622 | 11879 | TTCN_4324 | 22066 |
| GTCN_852 | 11880 | TTCN_4325 | 22067 |
| ATCN_987 | 11881 | TTCN_4326 | 22068 |
| CTCN_1332 | 11882 | ATCN_2691 | 22069 |
| TTCN_1623 | 11883 | CTCN_4096 | 22070 |
| TTCN_1624 | 11884 | ATCN_2692 | 22071 |
| ATCN_988 | 11885 | ATCN_2693 | 22072 |
| ATCN_989 | 11886 | TTCN_4327 | 22073 |
| TTCN_1625 | 11887 | GTCN_2318 | 22074 |
| TTCN_1626 | 11888 | TTCN_4328 | 22075 |
| GTCN_853 | 11889 | TTCN_4329 | 22076 |
| ATCN_990 | 11890 | TTCN_4330 | 22077 |
| ATCN_991 | 11891 | ATCN_2694 | 22078 |
| CTCN_1333 | 11892 | GTCN_2319 | 22079 |
| TTCN_1627 | 11893 | TTCN_4331 | 22080 |
| CTCN_1334 | 11894 | TTCN_4332 | 22081 |
| GTCN_854 | 11895 | TTCN_4333 | 22082 |
| CTCN_1335 | 11896 | CTCN_4097 | 22083 |
| TTCN_1628 | 11897 | TTCN_4334 | 22084 |
| ATCN_992 | 11898 | ATCN_2695 | 22085 |
| GTCN_855 | 11899 | TTCN_4335 | 22086 |
| TTCN_1629 | 11900 | GTCN_2320 | 22087 |
| CTCN_1336 | 11901 | TTCN_4336 | 22088 |
| TTCN_1630 | 11902 | TTCN_4337 | 22089 |
| CTCN_1337 | 11903 | CTCN_4098 | 22090 |
| TTCN_1631 | 11904 | CTCN_4099 | 22091 |
| ATCN_993 | 11905 | ATCN_2696 | 22092 |
| ATCN_994 | 11906 | ATCN_2697 | 22093 |
| ATCN_995 | 11907 | TTCN_4338 | 22094 |
| ATCN_996 | 11908 | ATCN_2698 | 22095 |
| CTCN_1338 | 11909 | TTCN_4339 | 22096 |
| ATCN_997 | 11910 | CTCN_4100 | 22097 |
| ATCN_998 | 11911 | ATCN_2699 | 22098 |
| ATCN_999 | 11912 | CTCN_4101 | 22099 |
| TTCN_1632 | 11913 | TTCN_4340 | 22100 |
| TTCN_1633 | 11914 | ATCN_2700 | 22101 |
| CTCN_1339 | 11915 | GTCN_2321 | 22102 |
| CTCN_1340 | 11916 | ATCN_2701 | 22103 |
| CTCN_1341 | 11917 | GTCN_2322 | 22104 |
| TTCN_1634 | 11918 | CTCN_4102 | 22105 |
| ATCN_1000 | 11919 | GTCN_2323 | 22106 |
| GTCN_856 | 11920 | GTCN_2324 | 22107 |
| ATCN_1001 | 11921 | GTCN_2325 | 22108 |

FIG. 36 (continued)

| | | | |
|---|---|---|---|
| ATCN_1002 | 11922 | GTCN_2326 | 22109 |
| ATCN_1003 | 11923 | TTCN_4341 | 22110 |
| ATCN_1004 | 11924 | TTCN_4342 | 22111 |
| GTCN_857 | 11925 | TTCN_4343 | 22112 |
| CTCN_1342 | 11926 | GTCN_2327 | 22113 |
| CTCN_1343 | 11927 | TTCN_4344 | 22114 |
| CTCN_1344 | 11928 | TTCN_4345 | 22115 |
| TTCN_1635 | 11929 | GTCN_2328 | 22116 |
| ATCN_1005 | 11930 | TTCN_4346 | 22117 |
| ATCN_1006 | 11931 | TTCN_4347 | 22118 |
| TTCN_1636 | 11932 | CTCN_4103 | 22119 |
| TTCN_1637 | 11933 | GTCN_2329 | 22120 |
| CTCN_1345 | 11934 | GTCN_2330 | 22121 |
| TTCN_1638 | 11935 | ATCN_2702 | 22122 |
| GTCN_858 | 11936 | ATCN_2703 | 22123 |
| ATCN_1007 | 11937 | CTCN_4104 | 22124 |
| GTCN_859 | 11938 | GTCN_2331 | 22125 |
| CTCN_1346 | 11939 | GTCN_2332 | 22126 |
| TTCN_1639 | 11940 | CTCN_4105 | 22127 |
| ATCN_1008 | 11941 | GTCN_2333 | 22128 |
| GTCN_860 | 11942 | TTCN_4348 | 22129 |
| CTCN_1347 | 11943 | CTCN_4106 | 22130 |
| ATCN_1009 | 11944 | CTCN_4107 | 22131 |
| CTCN_1348 | 11945 | TTCN_4349 | 22132 |
| ATCN_1010 | 11946 | CTCN_4108 | 22133 |
| TTCN_1640 | 11947 | GTCN_2334 | 22134 |
| TTCN_1641 | 11948 | TTCN_4350 | 22135 |
| CTCN_1349 | 11949 | CTCN_4109 | 22136 |
| GTCN_861 | 11950 | ATCN_2704 | 22137 |
| TTCN_1642 | 11951 | TTCN_4351 | 22138 |
| TTCN_1643 | 11952 | ATCN_2705 | 22139 |
| GTCN_862 | 11953 | TTCN_4352 | 22140 |
| TTCN_1644 | 11954 | ATCN_2706 | 22141 |
| TTCN_1645 | 11955 | ATCN_2707 | 22142 |
| ATCN_1011 | 11956 | CTCN_4110 | 22143 |
| ATCN_1012 | 11957 | TTCN_4353 | 22144 |
| TTCN_1646 | 11958 | TTCN_4354 | 22145 |
| TTCN_1647 | 11959 | TTCN_4355 | 22146 |
| CTCN_1350 | 11960 | ATCN_2708 | 22147 |
| GTCN_863 | 11961 | GTCN_2335 | 22148 |
| TTCN_1648 | 11962 | ATCN_2709 | 22149 |
| TTCN_1649 | 11963 | CTCN_4111 | 22150 |
| TTCN_1650 | 11964 | ATCN_2710 | 22151 |
| CTCN_1351 | 11965 | TTCN_4356 | 22152 |
| CTCN_1352 | 11966 | TTCN_4357 | 22153 |
| TTCN_1651 | 11967 | TTCN_4358 | 22154 |
| CTCN_1353 | 11968 | TTCN_4359 | 22155 |
| GTCN_864 | 11969 | CTCN_4112 | 22156 |
| GTCN_865 | 11970 | GTCN_2336 | 22157 |
| CTCN_1354 | 11971 | ATCN_2711 | 22158 |
| TTCN_1652 | 11972 | ATCN_2712 | 22159 |
| ATCN_1013 | 11973 | CTCN_4113 | 22160 |
| TTCN_1653 | 11974 | CTCN_4114 | 22161 |
| TTCN_1654 | 11975 | GTCN_2337 | 22162 |
| CTCN_1355 | 11976 | TTCN_4360 | 22163 |

| | | | |
|---|---|---|---|
| GTCN_866 | 11977 | TTCN_4361 | 22164 |
| GTCN_867 | 11978 | CTCN_4115 | 22165 |
| TTCN_1655 | 11979 | GTCN_2338 | 22166 |
| CTCN_1356 | 11980 | GTCN_2339 | 22167 |
| GTCN_868 | 11981 | ATCN_2713 | 22168 |
| TTCN_1656 | 11982 | TTCN_4362 | 22169 |
| GTCN_869 | 11983 | CTCN_4116 | 22170 |
| TTCN_1657 | 11984 | GTCN_2340 | 22171 |
| ATCN_1014 | 11985 | TTCN_4363 | 22172 |
| ATCN_1015 | 11986 | ATCN_2714 | 22173 |
| TTCN_1658 | 11987 | ATCN_2715 | 22174 |
| TTCN_1659 | 11988 | TTCN_4364 | 22175 |
| GTCN_870 | 11989 | CTCN_4117 | 22176 |
| CTCN_1357 | 11990 | TTCN_4365 | 22177 |
| CTCN_1358 | 11991 | GTCN_2341 | 22178 |
| GTCN_871 | 11992 | GTCN_2342 | 22179 |
| CTCN_1359 | 11993 | CTCN_4118 | 22180 |
| TTCN_1660 | 11994 | ATCN_2716 | 22181 |
| CTCN_1360 | 11995 | TTCN_4366 | 22182 |
| CTCN_1361 | 11996 | TTCN_4367 | 22183 |
| CTCN_1362 | 11997 | ATCN_2717 | 22184 |
| CTCN_1363 | 11998 | ATCN_2718 | 22185 |
| ATCN_1016 | 11999 | CTCN_4119 | 22186 |
| GTCN_872 | 12000 | ATCN_2719 | 22187 |
| ATCN_1017 | 12001 | TTCN_4368 | 22188 |
| TTCN_1661 | 12002 | TTCN_4369 | 22189 |
| TTCN_1662 | 12003 | ATCN_2720 | 22190 |
| ATCN_1018 | 12004 | TTCN_4370 | 22191 |
| ATCN_1019 | 12005 | TTCN_4371 | 22192 |
| GTCN_873 | 12006 | GTCN_2343 | 22193 |
| TTCN_1663 | 12007 | TTCN_4372 | 22194 |
| CTCN_1364 | 12008 | ATCN_2721 | 22195 |
| TTCN_1664 | 12009 | ATCN_2722 | 22196 |
| CTCN_1365 | 12010 | TTCN_4373 | 22197 |
| CTCN_1366 | 12011 | CTCN_4120 | 22198 |
| TTCN_1665 | 12012 | ATCN_2723 | 22199 |
| TTCN_1666 | 12013 | TTCN_4374 | 22200 |
| TTCN_1667 | 12014 | ATCN_2724 | 22201 |
| TTCN_1668 | 12015 | TTCN_4375 | 22202 |
| CTCN_1367 | 12016 | TTCN_4376 | 22203 |
| TTCN_1669 | 12017 | ATCN_2725 | 22204 |
| CTCN_1368 | 12018 | CTCN_4121 | 22205 |
| TTCN_1670 | 12019 | TTCN_4377 | 22206 |
| GTCN_874 | 12020 | TTCN_4378 | 22207 |
| CTCN_1369 | 12021 | CTCN_4122 | 22208 |
| CTCN_1370 | 12022 | ATCN_2726 | 22209 |
| CTCN_1371 | 12023 | ATCN_2727 | 22210 |
| CTCN_1372 | 12024 | ATCN_2728 | 22211 |
| TTCN_1671 | 12025 | CTCN_4123 | 22212 |
| ATCN_1020 | 12026 | CTCN_4124 | 22213 |
| TTCN_1672 | 12027 | TTCN_4379 | 22214 |
| CTCN_1373 | 12028 | ATCN_2729 | 22215 |
| TTCN_1673 | 12029 | TTCN_4380 | 22216 |
| ATCN_1021 | 12030 | ATCN_2730 | 22217 |
| ATCN_1022 | 12031 | CTCN_4125 | 22218 |

FIG. 36 (continued)

| | | | |
|---|---|---|---|
| CTCN_1374 | 12032 | CTCN_4126 | 22219 |
| CTCN_1375 | 12033 | CTCN_4127 | 22220 |
| TTCN_1674 | 12034 | GTCN_2344 | 22221 |
| ATCN_1023 | 12035 | ATCN_2731 | 22222 |
| GTCN_875 | 12036 | TTCN_4381 | 22223 |
| ATCN_1024 | 12037 | ATCN_2732 | 22224 |
| ATCN_1025 | 12038 | GTCN_2345 | 22225 |
| GTCN_876 | 12039 | ATCN_2733 | 22226 |
| CTCN_1376 | 12040 | CTCN_4128 | 22227 |
| CTCN_1377 | 12041 | CTCN_4129 | 22228 |
| CTCN_1378 | 12042 | GTCN_2346 | 22229 |
| TTCN_1675 | 12043 | CTCN_4130 | 22230 |
| ATCN_1026 | 12044 | TTCN_4382 | 22231 |
| TTCN_1676 | 12045 | CTCN_4131 | 22232 |
| TTCN_1677 | 12046 | CTCN_4132 | 22233 |
| CTCN_1379 | 12047 | CTCN_4133 | 22234 |
| TTCN_1678 | 12048 | GTCN_2347 | 22235 |
| ATCN_1027 | 12049 | TTCN_4383 | 22236 |
| TTCN_1679 | 12050 | CTCN_4134 | 22237 |
| TTCN_1680 | 12051 | GTCN_2348 | 22238 |
| TTCN_1681 | 12052 | TTCN_4384 | 22239 |
| CTCN_1380 | 12053 | ATCN_2734 | 22240 |
| CTCN_1381 | 12054 | CTCN_4135 | 22241 |
| TTCN_1682 | 12055 | GTCN_2349 | 22242 |
| ATCN_1028 | 12056 | TTCN_4385 | 22243 |
| CTCN_1382 | 12057 | CTCN_4136 | 22244 |
| CTCN_1383 | 12058 | CTCN_4137 | 22245 |
| TTCN_1683 | 12059 | GTCN_2350 | 22246 |
| GTCN_877 | 12060 | CTCN_4138 | 22247 |
| ATCN_1029 | 12061 | CTCN_4139 | 22248 |
| GTCN_878 | 12062 | ATCN_2735 | 22249 |
| ATCN_1030 | 12063 | ATCN_2736 | 22250 |
| GTCN_879 | 12064 | TTCN_4386 | 22251 |
| GTCN_880 | 12065 | GTCN_2351 | 22252 |
| CTCN_1384 | 12066 | CTCN_4140 | 22253 |
| ATCN_1031 | 12067 | CTCN_4141 | 22254 |
| ATCN_1032 | 12068 | ATCN_2737 | 22255 |
| CTCN_1385 | 12069 | TTCN_4387 | 22256 |
| CTCN_1386 | 12070 | CTCN_4142 | 22257 |
| CTCN_1387 | 12071 | TTCN_4388 | 22258 |
| GTCN_881 | 12072 | CTCN_4143 | 22259 |
| ATCN_1033 | 12073 | GTCN_2352 | 22260 |
| ATCN_1034 | 12074 | CTCN_4144 | 22261 |
| TTCN_1684 | 12075 | TTCN_4389 | 22262 |
| TTCN_1685 | 12076 | ATCN_2738 | 22263 |
| CTCN_1388 | 12077 | CTCN_4145 | 22264 |
| TTCN_1686 | 12078 | GTCN_2353 | 22265 |
| ATCN_1035 | 12079 | GTCN_2354 | 22266 |
| ATCN_1036 | 12080 | ATCN_2739 | 22267 |
| CTCN_1389 | 12081 | GTCN_2355 | 22268 |
| ATCN_1037 | 12082 | CTCN_4146 | 22269 |
| ATCN_1038 | 12083 | CTCN_4147 | 22270 |
| ATCN_1039 | 12084 | CTCN_4148 | 22271 |
| GTCN_882 | 12085 | ATCN_2740 | 22272 |
| TTCN_1687 | 12086 | ATCN_2741 | 22273 |

| | | | |
|---|---|---|---|
| TTCN_1688 | 12087 | CTCN_4149 | 22274 |
| CTCN_1390 | 12088 | CTCN_4150 | 22275 |
| CTCN_1391 | 12089 | ATCN_2742 | 22276 |
| CTCN_1392 | 12090 | CTCN_4151 | 22277 |
| ATCN_1040 | 12091 | CTCN_4152 | 22278 |
| TTCN_1689 | 12092 | GTCN_2356 | 22279 |
| CTCN_1393 | 12093 | TTCN_4390 | 22280 |
| CTCN_1394 | 12094 | GTCN_2357 | 22281 |
| CTCN_1395 | 12095 | CTCN_4153 | 22282 |
| GTCN_883 | 12096 | CTCN_4154 | 22283 |
| TTCN_1690 | 12097 | TTCN_4391 | 22284 |
| ATCN_1041 | 12098 | CTCN_4155 | 22285 |
| CTCN_1396 | 12099 | CTCN_4156 | 22286 |
| ATCN_1042 | 12100 | TTCN_4392 | 22287 |
| TTCN_1691 | 12101 | ATCN_2743 | 22288 |
| TTCN_1692 | 12102 | TTCN_4393 | 22289 |
| CTCN_1397 | 12103 | TTCN_4394 | 22290 |
| CTCN_1398 | 12104 | TTCN_4395 | 22291 |
| TTCN_1693 | 12105 | ATCN_2744 | 22292 |
| GTCN_884 | 12106 | TTCN_4396 | 22293 |
| TTCN_1694 | 12107 | CTCN_4157 | 22294 |
| CTCN_1399 | 12108 | TTCN_4397 | 22295 |
| TTCN_1695 | 12109 | CTCN_4158 | 22296 |
| CTCN_1400 | 12110 | ATCN_2745 | 22297 |
| CTCN_1401 | 12111 | ATCN_2746 | 22298 |
| GTCN_885 | 12112 | GTCN_2358 | 22299 |
| CTCN_1402 | 12113 | ATCN_2747 | 22300 |
| CTCN_1403 | 12114 | CTCN_4159 | 22301 |
| TTCN_1696 | 12115 | GTCN_2359 | 22302 |
| CTCN_1404 | 12116 | TTCN_4398 | 22303 |
| GTCN_886 | 12117 | GTCN_2360 | 22304 |
| TTCN_1697 | 12118 | CTCN_4160 | 22305 |
| CTCN_1405 | 12119 | CTCN_4161 | 22306 |
| ATCN_1043 | 12120 | CTCN_4162 | 22307 |
| CTCN_1406 | 12121 | GTCN_2361 | 22308 |
| CTCN_1407 | 12122 | CTCN_4163 | 22309 |
| CTCN_1408 | 12123 | CTCN_4164 | 22310 |
| TTCN_1698 | 12124 | CTCN_4165 | 22311 |
| CTCN_1409 | 12125 | CTCN_4166 | 22312 |
| ATCN_1044 | 12126 | TTCN_4399 | 22313 |
| ATCN_1045 | 12127 | CTCN_4167 | 22314 |
| CTCN_1410 | 12128 | CTCN_4168 | 22315 |
| TTCN_1699 | 12129 | CTCN_4169 | 22316 |
| GTCN_887 | 12130 | ATCN_2748 | 22317 |
| TTCN_1700 | 12131 | ATCN_2749 | 22318 |
| GTCN_888 | 12132 | GTCN_2362 | 22319 |
| CTCN_1411 | 12133 | CTCN_4170 | 22320 |
| ATCN_1046 | 12134 | GTCN_2363 | 22321 |
| TTCN_1701 | 12135 | CTCN_4171 | 22322 |
| ATCN_1047 | 12136 | GTCN_2364 | 22323 |
| GTCN_889 | 12137 | CTCN_4172 | 22324 |
| CTCN_1412 | 12138 | TTCN_4400 | 22325 |
| GTCN_890 | 12139 | TTCN_4401 | 22326 |
| TTCN_1702 | 12140 | CTCN_4173 | 22327 |
| GTCN_891 | 12141 | TTCN_4402 | 22328 |

FIG. 36 (continued)

| | | | |
|---|---|---|---|
| CTCN_1413 | 12142 | TTCN_4403 | 22329 |
| TTCN_1703 | 12143 | CTCN_4174 | 22330 |
| GTCN_892 | 12144 | GTCN_2365 | 22331 |
| CTCN_1414 | 12145 | CTCN_4175 | 22332 |
| CTCN_1415 | 12146 | CTCN_4176 | 22333 |
| GTCN_893 | 12147 | CTCN_4177 | 22334 |
| ATCN_1048 | 12148 | TTCN_4404 | 22335 |
| TTCN_1704 | 12149 | TTCN_4405 | 22336 |
| TTCN_1705 | 12150 | TTCN_4406 | 22337 |
| GTCN_894 | 12151 | TTCN_4407 | 22338 |
| TTCN_1706 | 12152 | TTCN_4408 | 22339 |
| GTCN_895 | 12153 | ATCN_2750 | 22340 |
| ATCN_1049 | 12154 | CTCN_4178 | 22341 |
| TTCN_1707 | 12155 | TTCN_4409 | 22342 |
| ATCN_1050 | 12156 | GTCN_2366 | 22343 |
| ATCN_1051 | 12157 | CTCN_4179 | 22344 |
| CTCN_1416 | 12158 | CTCN_4180 | 22345 |
| CTCN_1417 | 12159 | TTCN_4410 | 22346 |
| GTCN_896 | 12160 | GTCN_2367 | 22347 |
| ATCN_1052 | 12161 | TTCN_4411 | 22348 |
| TTCN_1708 | 12162 | CTCN_4181 | 22349 |
| GTCN_897 | 12163 | GTCN_2368 | 22350 |
| GTCN_898 | 12164 | ATCN_2751 | 22351 |
| GTCN_899 | 12165 | CTCN_4182 | 22352 |
| CTCN_1418 | 12166 | ATCN_2752 | 22353 |
| CTCN_1419 | 12167 | CTCN_4183 | 22354 |
| TTCN_1709 | 12168 | TTCN_4412 | 22355 |
| ATCN_1053 | 12169 | TTCN_4413 | 22356 |
| TTCN_1710 | 12170 | TTCN_4414 | 22357 |
| ATCN_1054 | 12171 | TTCN_4281 | 22358 |
| TTCN_1711 | 12172 | TTCN_4282 | 22359 |
| ATCN_1055 | 12173 | ATCN_2655 | 22360 |
| TTCN_1712 | 12174 | TTCN_4283 | 22361 |
| CTCN_1420 | 12175 | CTCN_4064 | 22362 |
| GTCN_900 | 12176 | CTCN_4065 | 22363 |
| CTCN_1421 | 12177 | GTCN_2295 | 22364 |
| GTCN_901 | 12178 | ATCN_2656 | 22365 |
| CTCN_1422 | 12179 | TTCN_4284 | 22366 |
| CTCN_1423 | 12180 | GTCN_2296 | 22367 |
| TTCN_1713 | 12181 | CTCN_4066 | 22368 |
| GTCN_902 | 12182 | GTCN_2297 | 22369 |
| CTCN_1424 | 12183 | CTCN_4067 | 22370 |
| CTCN_1425 | 12184 | ATCN_2657 | 22371 |
| GTCN_903 | 12185 | ATCN_2658 | 22372 |
| TTCN_1714 | 12186 | CTCN_4068 | 22373 |
| CTCN_1426 | 12187 | GTCN_2298 | 22374 |
| ATCN_1056 | 12188 | CTCN_4069 | 22375 |
| CTCN_1427 | 12189 | CTCN_4070 | 22376 |
| CTCN_1428 | 12190 | TTCN_4285 | 22377 |
| GTCN_904 | 12191 | ATCN_2659 | 22378 |
| GTCN_905 | 12192 | TTCN_4286 | 22379 |
| CTCN_1429 | 12193 | CTCN_4071 | 22380 |
| CTCN_1430 | 12194 | TTCN_4287 | 22381 |
| ATCN_1057 | 12195 | CTCN_4072 | 22382 |
| CTCN_1431 | 12196 | ATCN_2660 | 22383 |

| | | | |
|---|---|---|---|
| GTCN_906 | 12197 | CTCN_4073 | 22384 |
| TTCN_1715 | 12198 | ATCN_2661 | 22385 |
| GTCN_907 | 12199 | TTCN_4288 | 22386 |
| CTCN_1432 | 12200 | GTCN_2299 | 22387 |
| TTCN_1716 | 12201 | GTCN_2300 | 22388 |
| TTCN_1717 | 12202 | CTCN_4074 | 22389 |
| CTCN_1433 | 12203 | TTCN_4289 | 22390 |
| TTCN_1718 | 12204 | CTCN_4075 | 22391 |
| ATCN_1058 | 12205 | GTCN_2301 | 22392 |
| ATCN_1059 | 12206 | CTCN_4076 | 22393 |
| TTCN_1719 | 12207 | ATCN_2662 | 22394 |
| TTCN_1720 | 12208 | ATCN_2663 | 22395 |
| TTCN_1721 | 12209 | CTCN_4077 | 22396 |
| CTCN_1434 | 12210 | ATCN_2664 | 22397 |
| TTCN_1722 | 12211 | ATCN_2665 | 22398 |
| TTCN_1723 | 12212 | TTCN_4290 | 22399 |
| TTCN_1724 | 12213 | CTCN_4078 | 22400 |
| GTCN_908 | 12214 | CTCN_4079 | 22401 |
| ATCN_1060 | 12215 | CTCN_4080 | 22402 |
| ATCN_1061 | 12216 | GTCN_2302 | 22403 |
| TTCN_1725 | 12217 | ATCN_2666 | 22404 |
| GTCN_909 | 12218 | ATCN_2667 | 22405 |
| TTCN_1726 | 12219 | TTCN_4291 | 22406 |
| ATCN_1062 | 12220 | TTCN_4292 | 22407 |
| ATCN_1063 | 12221 | GTCN_2303 | 22408 |
| ATCN_1064 | 12222 | TTCN_4293 | 22409 |
| ATCN_1065 | 12223 | TTCN_4294 | 22410 |
| GTCN_910 | 12224 | ATCN_2668 | 22411 |
| TTCN_1727 | 12225 | ATCN_2669 | 22412 |
| CTCN_1435 | 12226 | ATCN_2670 | 22413 |
| CTCN_1436 | 12227 | ATCN_2671 | 22414 |
| ATCN_1066 | 12228 | ATCN_2672 | 22415 |
| ATCN_1067 | 12229 | CTCN_4081 | 22416 |
| CTCN_1437 | 12230 | GTCN_2304 | 22417 |
| TTCN_1728 | 12231 | TTCN_4295 | 22418 |
| TTCN_1729 | 12232 | GTCN_2305 | 22419 |
| ATCN_1068 | 12233 | CTCN_4082 | 22420 |
| ATCN_1069 | 12234 | CTCN_4083 | 22421 |
| TTCN_1730 | 12235 | CTCN_4084 | 22422 |
| TTCN_1731 | 12236 | GTCN_2306 | 22423 |
| TTCN_1732 | 12237 | CTCN_4085 | 22424 |
| CTCN_1438 | 12238 | ATCN_2673 | 22425 |
| CTCN_1439 | 12239 | TTCN_4296 | 22426 |
| TTCN_1733 | 12240 | TTCN_4297 | 22427 |
| ATCN_1070 | 12241 | TTCN_4298 | 22428 |
| ATCN_1071 | 12242 | ATCN_2674 | 22429 |
| TTCN_1734 | 12243 | ATCN_2675 | 22430 |
| CTCN_1440 | 12244 | TTCN_4299 | 22431 |
| CTCN_1441 | 12245 | CTCN_4086 | 22432 |
| TTCN_1735 | 12246 | ATCN_2676 | 22433 |
| GTCN_911 | 12247 | ATCN_2677 | 22434 |
| CTCN_1442 | 12248 | GTCN_2307 | 22435 |
| ATCN_1072 | 12249 | TTCN_4300 | 22436 |
| CTCN_1443 | 12250 | CTCN_4087 | 22437 |
| TTCN_1736 | 12251 | TTCN_4301 | 22438 |

FIG. 36 (continued)

| | | | |
|---|---|---|---|
| ATCN_1073 | 12252 | ATCN_2678 | 22439 |
| TTCN_1737 | 12253 | TTCN_4302 | 22440 |
| CTCN_1444 | 12254 | TTCN_4303 | 22441 |
| TTCN_1738 | 12255 | CTCN_4088 | 22442 |
| TTCN_1739 | 12256 | GTCN_2308 | 22443 |
| CTCN_1445 | 12257 | CTCN_4089 | 22444 |
| CTCN_1446 | 12258 | TTCN_4304 | 22445 |
| TTCN_1740 | 12259 | TTCN_4305 | 22446 |
| TTCN_1741 | 12260 | TTCN_4306 | 22447 |
| CTCN_1447 | 12261 | TTCN_4307 | 22448 |
| ATCN_1074 | 12262 | TTCN_4308 | 22449 |
| TTCN_1742 | 12263 | GTCN_2309 | 22450 |
| ATCN_1075 | 12264 | ATCN_2679 | 22451 |
| ATCN_1076 | 12265 | CTCN_4090 | 22452 |
| TTCN_1743 | 12266 | CTCN_4091 | 22453 |
| GTCN_912 | 12267 | ATCN_2680 | 22454 |
| GTCN_913 | 12268 | ATCN_2681 | 22455 |
| TTCN_1744 | 12269 | GTCN_2310 | 22456 |
| CTCN_1448 | 12270 | TTCN_4309 | 22457 |
| TTCN_1745 | 12271 | GTCN_2311 | 22458 |
| ATCN_1077 | 12272 | CTCN_4092 | 22459 |
| TTCN_1746 | 12273 | TTCN_4310 | 22460 |
| GTCN_914 | 12274 | GTCN_2312 | 22461 |
| GTCN_915 | 12275 | TTCN_4311 | 22462 |
| GTCN_916 | 12276 | GTCN_2313 | 22463 |
| TTCN_1747 | 12277 | TTCN_4312 | 22464 |
| GTCN_917 | 12278 | TTCN_4313 | 22465 |
| GTCN_918 | 12279 | GTCN_2314 | 22466 |
| CTCN_1449 | 12280 | ATCN_2682 | 22467 |
| TTCN_1748 | 12281 | TTCN_4314 | 22468 |
| CTCN_1450 | 12282 | ATCN_2683 | 22469 |
| TTCN_1749 | 12283 | ATCN_2684 | 22470 |
| ATCN_1078 | 12284 | TTCN_4315 | 22471 |
| TTCN_1750 | 12285 | TTCN_4316 | 22472 |
| CTCN_1451 | 12286 | GTCN_2315 | 22473 |
| GTCN_919 | 12287 | CTCN_4093 | 22474 |
| TTCN_1751 | 12288 | ATCN_2685 | 22475 |
| CTCN_1452 | 12289 | TTCN_4317 | 22476 |
| GTCN_920 | 12290 | ATCN_2686 | 22477 |
| TTCN_1752 | 12291 | GTCN_2316 | 22478 |
| GTCN_921 | 12292 | TTCN_4318 | 22479 |
| CTCN_1453 | 12293 | TTCN_4319 | 22480 |
| TTCN_1753 | 12294 | ATCN_2687 | 22481 |
| ATCN_1079 | 12295 | TTCN_4320 | 22482 |
| TTCN_1754 | 12296 | TTCN_4321 | 22483 |
| CTCN_1454 | 12297 | CTCN_4094 | 22484 |
| TTCN_1755 | 12298 | ATCN_2688 | 22485 |
| CTCN_1455 | 12299 | CTCN_4095 | 22486 |
| TTCN_1756 | 12300 | TTCN_4322 | 22487 |
| CTCN_1456 | 12301 | GTCN_2317 | 22488 |
| GTCN_922 | 12302 | ATCN_2689 | 22489 |
| TTCN_1757 | 12303 | TTCN_4323 | 22490 |
| GTCN_923 | 12304 | ATCN_2690 | 22491 |
| GTCN_924 | 12305 | TTCN_4324 | 22492 |
| TTCN_1758 | 12306 | TTCN_4325 | 22493 |

| | | | |
|---|---|---|---|
| CTCN_1457 | 12307 | TTCN_4326 | 22494 |
| GTCN_925 | 12308 | ATCN_2691 | 22495 |
| CTCN_1458 | 12309 | CTCN_4096 | 22496 |
| CTCN_1459 | 12310 | ATCN_2692 | 22497 |
| ATCN_1080 | 12311 | ATCN_2693 | 22498 |
| ATCN_1081 | 12312 | TTCN_4327 | 22499 |
| TTCN_1759 | 12313 | GTCN_2318 | 22500 |
| ATCN_1082 | 12314 | TTCN_4328 | 22501 |
| TTCN_1760 | 12315 | TTCN_4329 | 22502 |
| ATCN_1083 | 12316 | TTCN_4330 | 22503 |
| GTCN_926 | 12317 | ATCN_2694 | 22504 |
| TTCN_1761 | 12318 | GTCN_2319 | 22505 |
| GTCN_927 | 12319 | TTCN_4331 | 22506 |
| ATCN_1084 | 12320 | TTCN_4332 | 22507 |
| ATCN_1085 | 12321 | TTCN_4333 | 22508 |
| TTCN_1762 | 12322 | CTCN_4097 | 22509 |
| ATCN_1086 | 12323 | TTCN_4334 | 22510 |
| CTCN_1460 | 12324 | ATCN_2695 | 22511 |
| CTCN_1461 | 12325 | TTCN_4335 | 22512 |
| GTCN_928 | 12326 | GTCN_2320 | 22513 |
| TTCN_1763 | 12327 | TTCN_4336 | 22514 |
| CTCN_1462 | 12328 | TTCN_4337 | 22515 |
| GTCN_929 | 12329 | CTCN_4098 | 22516 |
| GTCN_930 | 12330 | CTCN_4099 | 22517 |
| TTCN_1764 | 12331 | ATCN_2696 | 22518 |
| ATCN_1087 | 12332 | ATCN_2697 | 22519 |
| CTCN_1463 | 12333 | TTCN_4338 | 22520 |
| TTCN_1765 | 12334 | ATCN_2698 | 22521 |
| CTCN_1464 | 12335 | TTCN_4339 | 22522 |
| TTCN_1766 | 12336 | CTCN_4100 | 22523 |
| CTCN_1465 | 12337 | ATCN_2699 | 22524 |
| ATCN_1088 | 12338 | CTCN_4101 | 22525 |
| ATCN_1089 | 12339 | TTCN_4340 | 22526 |
| TTCN_1767 | 12340 | ATCN_2700 | 22527 |
| TTCN_1768 | 12341 | GTCN_2321 | 22528 |
| GTCN_931 | 12342 | ATCN_2701 | 22529 |
| TTCN_1769 | 12343 | GTCN_2322 | 22530 |
| CTCN_1466 | 12344 | CTCN_4102 | 22531 |
| ATCN_1090 | 12345 | GTCN_2323 | 22532 |
| ATCN_1091 | 12346 | GTCN_2324 | 22533 |
| CTCN_1467 | 12347 | GTCN_2325 | 22534 |
| ATCN_1092 | 12348 | GTCN_2326 | 22535 |
| ATCN_1093 | 12349 | TTCN_4341 | 22536 |
| CTCN_1468 | 12350 | TTCN_4342 | 22537 |
| TTCN_1770 | 12351 | TTCN_4343 | 22538 |
| CTCN_1469 | 12352 | GTCN_2327 | 22539 |
| TTCN_1771 | 12353 | TTCN_4344 | 22540 |
| TTCN_1772 | 12354 | TTCN_4345 | 22541 |
| CTCN_1470 | 12355 | GTCN_2328 | 22542 |
| CTCN_1471 | 12356 | TTCN_4346 | 22543 |
| TTCN_1773 | 12357 | TTCN_4347 | 22544 |
| TTCN_1774 | 12358 | CTCN_4103 | 22545 |
| CTCN_1472 | 12359 | GTCN_2329 | 22546 |
| TTCN_1775 | 12360 | GTCN_2330 | 22547 |
| TTCN_1776 | 12361 | ATCN_2702 | 22548 |

FIG. 36 (continued)

| | | | |
|---|---|---|---|
| CTCN_1473 | 12362 | ATCN_2703 | 22549 |
| TTCN_1777 | 12363 | CTCN_4104 | 22550 |
| GTCN_932 | 12364 | GTCN_2331 | 22551 |
| CTCN_1474 | 12365 | GTCN_2332 | 22552 |
| TTCN_1778 | 12366 | CTCN_4105 | 22553 |
| GTCN_933 | 12367 | GTCN_2333 | 22554 |
| GTCN_934 | 12368 | TTCN_4348 | 22555 |
| TTCN_1779 | 12369 | CTCN_4106 | 22556 |
| CTCN_1475 | 12370 | CTCN_4107 | 22557 |
| CTCN_1476 | 12371 | TTCN_4349 | 22558 |
| GTCN_935 | 12372 | CTCN_4108 | 22559 |
| CTCN_1477 | 12373 | GTCN_2334 | 22560 |
| GTCN_936 | 12374 | TTCN_4350 | 22561 |
| GTCN_937 | 12375 | CTCN_4109 | 22562 |
| CTCN_1478 | 12376 | ATCN_2704 | 22563 |
| ATCN_1094 | 12377 | TTCN_4351 | 22564 |
| CTCN_1479 | 12378 | ATCN_2705 | 22565 |
| ATCN_1095 | 12379 | TTCN_4352 | 22566 |
| ATCN_1096 | 12380 | ATCN_2706 | 22567 |
| TTCN_1780 | 12381 | ATCN_2707 | 22568 |
| GTCN_938 | 12382 | CTCN_4110 | 22569 |
| CTCN_1480 | 12383 | TTCN_4353 | 22570 |
| ATCN_1097 | 12384 | TTCN_4354 | 22571 |
| CTCN_1481 | 12385 | TTCN_4355 | 22572 |
| ATCN_1098 | 12386 | ATCN_2708 | 22573 |
| CTCN_1482 | 12387 | GTCN_2335 | 22574 |
| CTCN_1483 | 12388 | ATCN_2709 | 22575 |
| TTCN_1781 | 12389 | CTCN_4111 | 22576 |
| CTCN_1484 | 12390 | ATCN_2710 | 22577 |
| CTCN_1485 | 12391 | TTCN_4356 | 22578 |
| ATCN_1099 | 12392 | TTCN_4357 | 22579 |
| CTCN_1486 | 12393 | TTCN_4358 | 22580 |
| TTCN_1782 | 12394 | TTCN_4359 | 22581 |
| TTCN_1783 | 12395 | CTCN_4112 | 22582 |
| ATCN_1100 | 12396 | GTCN_2336 | 22583 |
| TTCN_1784 | 12397 | ATCN_2711 | 22584 |
| ATCN_1101 | 12398 | ATCN_2712 | 22585 |
| TTCN_1785 | 12399 | CTCN_4113 | 22586 |
| CTCN_1487 | 12400 | CTCN_4114 | 22587 |
| TTCN_1786 | 12401 | GTCN_2337 | 22588 |
| CTCN_1488 | 12402 | TTCN_4360 | 22589 |
| TTCN_1787 | 12403 | TTCN_4361 | 22590 |
| TTCN_1788 | 12404 | CTCN_4115 | 22591 |
| CTCN_1489 | 12405 | GTCN_2338 | 22592 |
| CTCN_1490 | 12406 | GTCN_2339 | 22593 |
| GTCN_939 | 12407 | ATCN_2713 | 22594 |
| TTCN_1789 | 12408 | TTCN_4362 | 22595 |
| CTCN_1491 | 12409 | CTCN_4116 | 22596 |
| ATCN_1102 | 12410 | GTCN_2340 | 22597 |
| GTCN_940 | 12411 | TTCN_4363 | 22598 |
| TTCN_1790 | 12412 | ATCN_2714 | 22599 |
| TTCN_1791 | 12413 | ATCN_2715 | 22600 |
| TTCN_1792 | 12414 | TTCN_4364 | 22601 |
| TTCN_1793 | 12415 | CTCN_4117 | 22602 |
| GTCN_941 | 12416 | TTCN_4365 | 22603 |

| | | | |
|---|---|---|---|
| CTCN_1492 | 12417 | GTCN_2341 | 22604 |
| GTCN_942 | 12418 | GTCN_2342 | 22605 |
| TTCN_1794 | 12419 | CTCN_4118 | 22606 |
| CTCN_1493 | 12420 | ATCN_2716 | 22607 |
| CTCN_1494 | 12421 | TTCN_4366 | 22608 |
| ATCN_1103 | 12422 | TTCN_4367 | 22609 |
| CTCN_1495 | 12423 | ATCN_2717 | 22610 |
| TTCN_1795 | 12424 | ATCN_2718 | 22611 |
| TTCN_1796 | 12425 | CTCN_4119 | 22612 |
| TTCN_1797 | 12426 | ATCN_2719 | 22613 |
| GTCN_943 | 12427 | TTCN_4368 | 22614 |
| ATCN_1104 | 12428 | TTCN_4369 | 22615 |
| ATCN_1105 | 12429 | ATCN_2720 | 22616 |
| GTCN_944 | 12430 | TTCN_4370 | 22617 |
| TTCN_1798 | 12431 | TTCN_4371 | 22618 |
| TTCN_1799 | 12432 | GTCN_2343 | 22619 |
| TTCN_1800 | 12433 | TTCN_4372 | 22620 |
| ATCN_1106 | 12434 | ATCN_2721 | 22621 |
| GTCN_945 | 12435 | ATCN_2722 | 22622 |
| CTCN_1496 | 12436 | TTCN_4373 | 22623 |
| CTCN_1497 | 12437 | CTCN_4120 | 22624 |
| CTCN_1498 | 12438 | ATCN_2723 | 22625 |
| TTCN_1801 | 12439 | TTCN_4374 | 22626 |
| GTCN_946 | 12440 | ATCN_2724 | 22627 |
| TTCN_1802 | 12441 | TTCN_4375 | 22628 |
| CTCN_1499 | 12442 | TTCN_4376 | 22629 |
| GTCN_947 | 12443 | ATCN_2725 | 22630 |
| TTCN_1803 | 12444 | CTCN_4121 | 22631 |
| TTCN_1804 | 12445 | TTCN_4377 | 22632 |
| TTCN_1805 | 12446 | TTCN_4378 | 22633 |
| GTCN_948 | 12447 | CTCN_4122 | 22634 |
| TTCN_1806 | 12448 | ATCN_2726 | 22635 |
| ATCN_1107 | 12449 | ATCN_2727 | 22636 |
| ATCN_1108 | 12450 | ATCN_2728 | 22637 |
| ATCN_1109 | 12451 | CTCN_4123 | 22638 |
| GTCN_949 | 12452 | CTCN_4124 | 22639 |
| TTCN_1807 | 12453 | TTCN_4379 | 22640 |
| GTCN_950 | 12454 | ATCN_2729 | 22641 |
| TTCN_1808 | 12455 | TTCN_4380 | 22642 |
| TTCN_1809 | 12456 | ATCN_2730 | 22643 |
| TTCN_1810 | 12457 | CTCN_4125 | 22644 |
| ATCN_1110 | 12458 | CTCN_4126 | 22645 |
| CTCN_1500 | 12459 | CTCN_4127 | 22646 |
| ATCN_1111 | 12460 | GTCN_2344 | 22647 |
| GTCN_951 | 12461 | ATCN_2731 | 22648 |
| TTCN_1811 | 12462 | TTCN_4381 | 22649 |
| ATCN_1112 | 12463 | ATCN_2732 | 22650 |
| GTCN_952 | 12464 | GTCN_2345 | 22651 |
| TTCN_1812 | 12465 | ATCN_2733 | 22652 |
| CTCN_1501 | 12466 | CTCN_4128 | 22653 |
| TTCN_1813 | 12467 | CTCN_4129 | 22654 |
| CTCN_1502 | 12468 | GTCN_2346 | 22655 |
| TTCN_1814 | 12469 | CTCN_4130 | 22656 |
| TTCN_1815 | 12470 | TTCN_4382 | 22657 |
| TTCN_1816 | 12471 | CTCN_4131 | 22658 |

FIG. 36 (continued)

| | | | |
|---|---|---|---|
| TTCN_1817 | 12472 | CTCN_4132 | 22659 |
| ATCN_1113 | 12473 | CTCN_4133 | 22660 |
| TTCN_1818 | 12474 | GTCN_2347 | 22661 |
| TTCN_1819 | 12475 | TTCN_4383 | 22662 |
| ATCN_1114 | 12476 | CTCN_4134 | 22663 |
| CTCN_1503 | 12477 | GTCN_2348 | 22664 |
| CTCN_1504 | 12478 | TTCN_4384 | 22665 |
| TTCN_1820 | 12479 | ATCN_2734 | 22666 |
| CTCN_1505 | 12480 | CTCN_4135 | 22667 |
| ATCN_1115 | 12481 | GTCN_2349 | 22668 |
| ATCN_1116 | 12482 | TTCN_4385 | 22669 |
| CTCN_1506 | 12483 | CTCN_4136 | 22670 |
| CTCN_1507 | 12484 | CTCN_4137 | 22671 |
| ATCN_1117 | 12485 | GTCN_2350 | 22672 |
| CTCN_1508 | 12486 | CTCN_4138 | 22673 |
| ATCN_1118 | 12487 | CTCN_4139 | 22674 |
| CTCN_1509 | 12488 | ATCN_2735 | 22675 |
| GTCN_953 | 12489 | ATCN_2736 | 22676 |
| ATCN_1119 | 12490 | TTCN_4386 | 22677 |
| TTCN_1821 | 12491 | GTCN_2351 | 22678 |
| TTCN_1822 | 12492 | CTCN_4140 | 22679 |
| GTCN_954 | 12493 | CTCN_4141 | 22680 |
| CTCN_1510 | 12494 | ATCN_2737 | 22681 |
| TTCN_1823 | 12495 | TTCN_4387 | 22682 |
| TTCN_1824 | 12496 | CTCN_4142 | 22683 |
| TTCN_1825 | 12497 | TTCN_4388 | 22684 |
| TTCN_1826 | 12498 | CTCN_4143 | 22685 |
| ATCN_1120 | 12499 | GTCN_2352 | 22686 |
| ATCN_1121 | 12500 | CTCN_4144 | 22687 |
| CTCN_1511 | 12501 | TTCN_4389 | 22688 |
| CTCN_1512 | 12502 | ATCN_2738 | 22689 |
| ATCN_1122 | 12503 | CTCN_4145 | 22690 |
| GTCN_955 | 12504 | GTCN_2353 | 22691 |
| GTCN_956 | 12505 | GTCN_2354 | 22692 |
| ATCN_1123 | 12506 | ATCN_2739 | 22693 |
| TTCN_1827 | 12507 | GTCN_2355 | 22694 |
| TTCN_1828 | 12508 | CTCN_4146 | 22695 |
| ATCN_1124 | 12509 | CTCN_4147 | 22696 |
| CTCN_1513 | 12510 | CTCN_4148 | 22697 |
| TTCN_1829 | 12511 | ATCN_2740 | 22698 |
| ATCN_1125 | 12512 | ATCN_2741 | 22699 |
| TTCN_1830 | 12513 | CTCN_4149 | 22700 |
| CTCN_1514 | 12514 | CTCN_4150 | 22701 |
| GTCN_957 | 12515 | ATCN_2742 | 22702 |
| CTCN_1515 | 12516 | CTCN_4151 | 22703 |
| TTCN_1831 | 12517 | CTCN_4152 | 22704 |
| CTCN_1516 | 12518 | GTCN_2356 | 22705 |
| CTCN_1517 | 12519 | TTCN_4390 | 22706 |
| TTCN_1832 | 12520 | GTCN_2357 | 22707 |
| TTCN_1833 | 12521 | CTCN_4153 | 22708 |
| GTCN_958 | 12522 | CTCN_4154 | 22709 |
| ATCN_1126 | 12523 | TTCN_4391 | 22710 |
| ATCN_1127 | 12524 | CTCN_4155 | 22711 |
| ATCN_1128 | 12525 | CTCN_4156 | 22712 |
| TTCN_1834 | 12526 | TTCN_4392 | 22713 |

| | | | |
|---|---|---|---|
| CTCN_1518 | 12527 | ATCN_2743 | 22714 |
| TTCN_1835 | 12528 | TTCN_4393 | 22715 |
| TTCN_1836 | 12529 | TTCN_4394 | 22716 |
| ATCN_1129 | 12530 | TTCN_4395 | 22717 |
| ATCN_1130 | 12531 | ATCN_2744 | 22718 |
| TTCN_1837 | 12532 | TTCN_4396 | 22719 |
| TTCN_1838 | 12533 | CTCN_4157 | 22720 |
| CTCN_1519 | 12534 | TTCN_4397 | 22721 |
| CTCN_1520 | 12535 | CTCN_4158 | 22722 |
| TTCN_1839 | 12536 | ATCN_2745 | 22723 |
| CTCN_1521 | 12537 | ATCN_2746 | 22724 |
| GTCN_959 | 12538 | GTCN_2358 | 22725 |
| TTCN_1840 | 12539 | ATCN_2747 | 22726 |
| TTCN_1841 | 12540 | CTCN_4159 | 22727 |
| ATCN_1131 | 12541 | GTCN_2359 | 22728 |
| TTCN_1842 | 12542 | TTCN_4398 | 22729 |
| TTCN_1843 | 12543 | GTCN_2360 | 22730 |
| ATCN_1132 | 12544 | CTCN_4160 | 22731 |
| TTCN_1844 | 12545 | CTCN_4161 | 22732 |
| TTCN_1845 | 12546 | CTCN_4162 | 22733 |
| ATCN_1133 | 12547 | GTCN_2361 | 22734 |
| GTCN_960 | 12548 | CTCN_4163 | 22735 |
| TTCN_1846 | 12549 | CTCN_4164 | 22736 |
| TTCN_1847 | 12550 | CTCN_4165 | 22737 |
| GTCN_961 | 12551 | CTCN_4166 | 22738 |
| TTCN_1848 | 12552 | TTCN_4399 | 22739 |
| GTCN_962 | 12553 | CTCN_4167 | 22740 |
| TTCN_1849 | 12554 | CTCN_4168 | 22741 |
| ATCN_1134 | 12555 | CTCN_4169 | 22742 |
| TTCN_1850 | 12556 | ATCN_2748 | 22743 |
| CTCN_1522 | 12557 | ATCN_2749 | 22744 |
| CTCN_1523 | 12558 | GTCN_2362 | 22745 |
| CTCN_1524 | 12559 | CTCN_4170 | 22746 |
| CTCN_1525 | 12560 | GTCN_2363 | 22747 |
| CTCN_1526 | 12561 | CTCN_4171 | 22748 |
| TTCN_1851 | 12562 | GTCN_2364 | 22749 |
| GTCN_963 | 12563 | CTCN_4172 | 22750 |
| GTCN_964 | 12564 | TTCN_4400 | 22751 |
| ATCN_1135 | 12565 | TTCN_4401 | 22752 |
| TTCN_1852 | 12566 | CTCN_4173 | 22753 |
| TTCN_1853 | 12567 | TTCN_4402 | 22754 |
| GTCN_965 | 12568 | TTCN_4403 | 22755 |
| TTCN_1854 | 12569 | CTCN_4174 | 22756 |
| ATCN_1136 | 12570 | GTCN_2365 | 22757 |
| TTCN_1855 | 12571 | CTCN_4175 | 22758 |
| GTCN_966 | 12572 | CTCN_4176 | 22759 |
| TTCN_1856 | 12573 | CTCN_4177 | 22760 |
| TTCN_1857 | 12574 | TTCN_4404 | 22761 |
| TTCN_1858 | 12575 | TTCN_4405 | 22762 |
| CTCN_1527 | 12576 | TTCN_4406 | 22763 |
| ATCN_1137 | 12577 | TTCN_4407 | 22764 |
| CTCN_1528 | 12578 | TTCN_4408 | 22765 |
| CTCN_1529 | 12579 | ATCN_2750 | 22766 |
| ATCN_1138 | 12580 | CTCN_4178 | 22767 |
| ATCN_1139 | 12581 | TTCN_4409 | 22768 |

FIG. 36 (continued)

| | | | |
|---|---|---|---|
| CTCN_1530 | 12582 | GTCN_2366 | 22769 |
| GTCN_967 | 12583 | CTCN_4179 | 22770 |
| CTCN_1531 | 12584 | CTCN_4180 | 22771 |
| TTCN_1859 | 12585 | TTCN_4410 | 22772 |
| CTCN_1532 | 12586 | GTCN_2367 | 22773 |
| GTCN_968 | 12587 | TTCN_4411 | 22774 |
| ATCN_1140 | 12588 | CTCN_4181 | 22775 |
| TTCN_1860 | 12589 | GTCN_2368 | 22776 |
| GTCN_969 | 12590 | ATCN_2751 | 22777 |
| CTCN_1533 | 12591 | CTCN_4182 | 22778 |
| GTCN_970 | 12592 | ATCN_2752 | 22779 |
| CTCN_1534 | 12593 | CTCN_4183 | 22780 |
| CTCN_1535 | 12594 | TTCN_4412 | 22781 |
| CTCN_1536 | 12595 | TTCN_4413 | 22782 |
| TTCN_1861 | 12596 | TTCN_4414 | 22783 |
| TTCN_1862 | 12597 | ATCN_2753 | 22784 |
| CTCN_1537 | 12598 | TTCN_4415 | 22785 |
| CTCN_1538 | 12599 | ATCN_2754 | 22786 |
| CTCN_1539 | 12600 | TTCN_4416 | 22787 |
| ATCN_1141 | 12601 | TTCN_4417 | 22788 |
| ATCN_1142 | 12602 | CTCN_4184 | 22789 |
| CTCN_1540 | 12603 | TTCN_4418 | 22790 |
| GTCN_971 | 12604 | GTCN_2369 | 22791 |
| CTCN_1541 | 12605 | ATCN_2755 | 22792 |
| CTCN_1542 | 12606 | ATCN_2756 | 22793 |
| GTCN_972 | 12607 | TTCN_4419 | 22794 |
| CTCN_1543 | 12608 | TTCN_4420 | 22795 |
| ATCN_1143 | 12609 | TTCN_4421 | 22796 |
| CTCN_1544 | 12610 | TTCN_4422 | 22797 |
| TTCN_1863 | 12611 | ATCN_2757 | 22798 |
| TTCN_1864 | 12612 | CTCN_4185 | 22799 |
| TTCN_1865 | 12613 | CTCN_4186 | 22800 |
| CTCN_1545 | 12614 | GTCN_2370 | 22801 |
| GTCN_973 | 12615 | GTCN_2371 | 22802 |
| CTCN_1546 | 12616 | TTCN_4423 | 22803 |
| CTCN_1547 | 12617 | CTCN_4187 | 22804 |
| ATCN_1144 | 12618 | CTCN_4188 | 22805 |
| CTCN_1548 | 12619 | ATCN_2758 | 22806 |
| TTCN_1866 | 12620 | ATCN_2759 | 22807 |
| CTCN_1549 | 12621 | GTCN_2372 | 22808 |
| CTCN_1550 | 12622 | CTCN_4189 | 22809 |
| ATCN_1145 | 12623 | TTCN_4424 | 22810 |
| ATCN_1146 | 12624 | CTCN_4190 | 22811 |
| CTCN_1551 | 12625 | GTCN_2373 | 22812 |
| CTCN_1552 | 12626 | ATCN_2760 | 22813 |
| TTCN_1867 | 12627 | CTCN_4191 | 22814 |
| GTCN_974 | 12628 | TTCN_4425 | 22815 |
| CTCN_1553 | 12629 | CTCN_4192 | 22816 |
| GTCN_975 | 12630 | TTCN_4426 | 22817 |
| ATCN_1147 | 12631 | CTCN_4193 | 22818 |
| CTCN_1554 | 12632 | TTCN_4427 | 22819 |
| GTCN_976 | 12633 | ATCN_2761 | 22820 |
| ATCN_1148 | 12634 | GTCN_2374 | 22821 |
| TTCN_1868 | 12635 | CTCN_4194 | 22822 |
| CTCN_1555 | 12636 | ATCN_2762 | 22823 |

| | | | |
|---|---|---|---|
| CTCN_1556 | 12637 | TTCN_4428 | 22824 |
| CTCN_1557 | 12638 | GTCN_2375 | 22825 |
| ATCN_1149 | 12639 | TTCN_4429 | 22826 |
| ATCN_1150 | 12640 | CTCN_4195 | 22827 |
| CTCN_1558 | 12641 | CTCN_4196 | 22828 |
| GTCN_977 | 12642 | CTCN_4197 | 22829 |
| CTCN_1559 | 12643 | CTCN_4198 | 22830 |
| TTCN_1869 | 12644 | GTCN_2376 | 22831 |
| CTCN_1560 | 12645 | TTCN_4430 | 22832 |
| GTCN_978 | 12646 | TTCN_4431 | 22833 |
| ATCN_1151 | 12647 | ATCN_2763 | 22834 |
| ATCN_1152 | 12648 | CTCN_4199 | 22835 |
| GTCN_979 | 12649 | TTCN_4432 | 22836 |
| CTCN_1561 | 12650 | TTCN_4433 | 22837 |
| TTCN_1870 | 12651 | CTCN_4200 | 22838 |
| CTCN_1562 | 12652 | ATCN_2764 | 22839 |
| TTCN_1871 | 12653 | CTCN_4201 | 22840 |
| CTCN_1563 | 12654 | GTCN_2377 | 22841 |
| ATCN_1153 | 12655 | CTCN_4202 | 22842 |
| TTCN_1872 | 12656 | TTCN_4434 | 22843 |
| TTCN_1873 | 12657 | GTCN_2378 | 22844 |
| TTCN_1874 | 12658 | TTCN_4435 | 22845 |
| TTCN_1875 | 12659 | TTCN_4436 | 22846 |
| GTCN_980 | 12660 | CTCN_4203 | 22847 |
| CTCN_1564 | 12661 | CTCN_4204 | 22848 |
| TTCN_1876 | 12662 | CTCN_4205 | 22849 |
| GTCN_981 | 12663 | TTCN_4437 | 22850 |
| TTCN_1877 | 12664 | TTCN_4438 | 22851 |
| CTCN_1565 | 12665 | ATCN_2765 | 22852 |
| GTCN_982 | 12666 | TTCN_4439 | 22853 |
| CTCN_1566 | 12667 | GTCN_2379 | 22854 |
| TTCN_1878 | 12668 | GTCN_2380 | 22855 |
| GTCN_983 | 12669 | GTCN_2381 | 22856 |
| CTCN_1567 | 12670 | TTCN_4440 | 22857 |
| GTCN_984 | 12671 | ATCN_2766 | 22858 |
| CTCN_1568 | 12672 | TTCN_4441 | 22859 |
| GTCN_985 | 12673 | TTCN_4442 | 22860 |
| GTCN_986 | 12674 | CTCN_4206 | 22861 |
| TTCN_1879 | 12675 | GTCN_2382 | 22862 |
| CTCN_1569 | 12676 | TTCN_4443 | 22863 |
| ATCN_1154 | 12677 | TTCN_4444 | 22864 |
| GTCN_987 | 12678 | ATCN_2767 | 22865 |
| TTCN_1880 | 12679 | CTCN_4207 | 22866 |
| TTCN_1881 | 12680 | GTCN_2383 | 22867 |
| CTCN_1570 | 12681 | CTCN_4208 | 22868 |
| TTCN_1882 | 12682 | GTCN_2384 | 22869 |
| ATCN_1155 | 12683 | TTCN_4445 | 22870 |
| CTCN_1571 | 12684 | TTCN_4446 | 22871 |
| CTCN_1572 | 12685 | ATCN_2768 | 22872 |
| CTCN_1573 | 12686 | TTCN_4447 | 22873 |
| TTCN_1883 | 12687 | TTCN_4448 | 22874 |
| GTCN_988 | 12688 | CTCN_4209 | 22875 |
| CTCN_1574 | 12689 | CTCN_4210 | 22876 |
| GTCN_989 | 12690 | CTCN_4211 | 22877 |
| TTCN_1884 | 12691 | CTCN_4212 | 22878 |

FIG. 36 (continued)

| | | | |
|---|---|---|---|
| TTCN_1885 | 12692 | TTCN_4449 | 22879 |
| TTCN_1886 | 12693 | ATCN_2769 | 22880 |
| GTCN_990 | 12694 | TTCN_4450 | 22881 |
| ATCN_1156 | 12695 | ATCN_2770 | 22882 |
| ATCN_1157 | 12696 | TTCN_4451 | 22883 |
| TTCN_1887 | 12697 | TTCN_4452 | 22884 |
| TTCN_1888 | 12698 | CTCN_4213 | 22885 |
| ATCN_1158 | 12699 | TTCN_4453 | 22886 |
| CTCN_1575 | 12700 | ATCN_2771 | 22887 |
| GTCN_991 | 12701 | TTCN_4454 | 22888 |
| GTCN_992 | 12702 | TTCN_4455 | 22889 |
| ATCN_1159 | 12703 | TTCN_4456 | 22890 |
| ATCN_1160 | 12704 | TTCN_4457 | 22891 |
| ATCN_1161 | 12705 | GTCN_2385 | 22892 |
| GTCN_993 | 12706 | CTCN_4214 | 22893 |
| TTCN_1889 | 12707 | TTCN_4458 | 22894 |
| CTCN_1576 | 12708 | TTCN_4459 | 22895 |
| TTCN_1890 | 12709 | ATCN_2772 | 22896 |
| TTCN_1891 | 12710 | ATCN_2773 | 22897 |
| CTCN_1577 | 12711 | TTCN_4460 | 22898 |
| TTCN_1892 | 12712 | GTCN_2386 | 22899 |
| TTCN_1893 | 12713 | CTCN_4215 | 22900 |
| ATCN_1162 | 12714 | CTCN_4216 | 22901 |
| TTCN_1894 | 12715 | TTCN_4461 | 22902 |
| GTCN_994 | 12716 | GTCN_2387 | 22903 |
| CTCN_1578 | 12717 | CTCN_4217 | 22904 |
| TTCN_1895 | 12718 | ATCN_2774 | 22905 |
| GTCN_995 | 12719 | CTCN_4218 | 22906 |
| GTCN_996 | 12720 | CTCN_4219 | 22907 |
| CTCN_1579 | 12721 | CTCN_4220 | 22908 |
| CTCN_1580 | 12722 | TTCN_4462 | 22909 |
| CTCN_1581 | 12723 | GTCN_2388 | 22910 |
| TTCN_1896 | 12724 | TTCN_4463 | 22911 |
| TTCN_1897 | 12725 | TTCN_4464 | 22912 |
| TTCN_1898 | 12726 | TTCN_4465 | 22913 |
| ATCN_1163 | 12727 | GTCN_2389 | 22914 |
| CTCN_1582 | 12728 | TTCN_4466 | 22915 |
| TTCN_1899 | 12729 | ATCN_2775 | 22916 |
| TTCN_1900 | 12730 | TTCN_4467 | 22917 |
| TTCN_1901 | 12731 | TTCN_4468 | 22918 |
| ATCN_1164 | 12732 | CTCN_4221 | 22919 |
| GTCN_997 | 12733 | ATCN_2776 | 22920 |
| GTCN_998 | 12734 | ATCN_2777 | 22921 |
| CTCN_1583 | 12735 | TTCN_4469 | 22922 |
| TTCN_1902 | 12736 | GTCN_2390 | 22923 |
| TTCN_1903 | 12737 | TTCN_4470 | 22924 |
| ATCN_1165 | 12738 | TTCN_4471 | 22925 |
| TTCN_1904 | 12739 | CTCN_4222 | 22926 |
| GTCN_999 | 12740 | TTCN_4472 | 22927 |
| GTCN_1000 | 12741 | TTCN_4473 | 22928 |
| ATCN_1166 | 12742 | CTCN_4223 | 22929 |
| GTCN_1001 | 12743 | ATCN_2778 | 22930 |
| TTCN_1905 | 12744 | GTCN_2391 | 22931 |
| CTCN_1584 | 12745 | CTCN_4224 | 22932 |
| CTCN_1585 | 12746 | ATCN_2779 | 22933 |

| | | | |
|---|---|---|---|
| TTCN_1906 | 12747 | CTCN_4225 | 22934 |
| ATCN_1167 | 12748 | TTCN_4344 | 22935 |
| TTCN_1907 | 12749 | TTCN_4345 | 22936 |
| CTCN_1586 | 12750 | GTCN_2328 | 22937 |
| ATCN_1168 | 12751 | TTCN_4346 | 22938 |
| TTCN_1908 | 12752 | TTCN_4347 | 22939 |
| CTCN_1587 | 12753 | CTCN_4103 | 22940 |
| TTCN_1909 | 12754 | GTCN_2329 | 22941 |
| GTCN_1002 | 12755 | GTCN_2330 | 22942 |
| ATCN_1169 | 12756 | ATCN_2702 | 22943 |
| CTCN_1588 | 12757 | ATCN_2703 | 22944 |
| CTCN_1589 | 12758 | CTCN_4104 | 22945 |
| GTCN_1003 | 12759 | GTCN_2331 | 22946 |
| TTCN_1910 | 12760 | GTCN_2332 | 22947 |
| GTCN_1004 | 12761 | CTCN_4105 | 22948 |
| GTCN_1005 | 12762 | GTCN_2333 | 22949 |
| GTCN_1006 | 12763 | TTCN_4348 | 22950 |
| CTCN_1590 | 12764 | CTCN_4106 | 22951 |
| GTCN_1007 | 12765 | CTCN_4107 | 22952 |
| GTCN_1008 | 12766 | TTCN_4349 | 22953 |
| CTCN_1591 | 12767 | CTCN_4108 | 22954 |
| CTCN_1592 | 12768 | GTCN_2334 | 22955 |
| GTCN_1009 | 12769 | TTCN_4350 | 22956 |
| CTCN_1593 | 12770 | CTCN_4109 | 22957 |
| GTCN_1010 | 12771 | ATCN_2704 | 22958 |
| GTCN_1011 | 12772 | TTCN_4351 | 22959 |
| TTCN_1911 | 12773 | ATCN_2705 | 22960 |
| TTCN_1912 | 12774 | TTCN_4352 | 22961 |
| TTCN_1913 | 12775 | ATCN_2706 | 22962 |
| TTCN_1914 | 12776 | ATCN_2707 | 22963 |
| CTCN_1594 | 12777 | CTCN_4110 | 22964 |
| GTCN_1012 | 12778 | TTCN_4353 | 22965 |
| GTCN_1013 | 12779 | TTCN_4354 | 22966 |
| ATCN_1170 | 12780 | TTCN_4355 | 22967 |
| GTCN_1014 | 12781 | ATCN_2708 | 22968 |
| TTCN_1915 | 12782 | GTCN_2335 | 22969 |
| TTCN_1916 | 12783 | ATCN_2709 | 22970 |
| GTCN_1015 | 12784 | CTCN_4111 | 22971 |
| TTCN_1917 | 12785 | ATCN_2710 | 22972 |
| CTCN_1595 | 12786 | TTCN_4356 | 22973 |
| CTCN_1596 | 12787 | TTCN_4357 | 22974 |
| ATCN_1171 | 12788 | TTCN_4358 | 22975 |
| ATCN_1172 | 12789 | TTCN_4359 | 22976 |
| TTCN_1918 | 12790 | CTCN_4112 | 22977 |
| TTCN_1919 | 12791 | GTCN_2336 | 22978 |
| ATCN_1173 | 12792 | ATCN_2711 | 22979 |
| CTCN_1597 | 12793 | ATCN_2712 | 22980 |
| CTCN_1598 | 12794 | CTCN_4113 | 22981 |
| ATCN_1174 | 12795 | CTCN_4114 | 22982 |
| CTCN_1599 | 12796 | GTCN_2337 | 22983 |
| CTCN_1600 | 12797 | TTCN_4360 | 22984 |
| CTCN_1601 | 12798 | TTCN_4361 | 22985 |
| TTCN_1920 | 12799 | CTCN_4115 | 22986 |
| TTCN_1921 | 12800 | GTCN_2338 | 22987 |
| GTCN_1016 | 12801 | GTCN_2339 | 22988 |

FIG. 36 (continued)

| | | | |
|---|---|---|---|
| CTCN_1602 | 12802 | ATCN_2713 | 22989 |
| ATCN_1175 | 12803 | TTCN_4362 | 22990 |
| TTCN_1922 | 12804 | CTCN_4116 | 22991 |
| CTCN_1603 | 12805 | GTCN_2340 | 22992 |
| GTCN_1017 | 12806 | TTCN_4363 | 22993 |
| TTCN_1923 | 12807 | ATCN_2714 | 22994 |
| CTCN_1604 | 12808 | ATCN_2715 | 22995 |
| CTCN_1605 | 12809 | TTCN_4364 | 22996 |
| ATCN_1176 | 12810 | CTCN_4117 | 22997 |
| ATCN_1177 | 12811 | TTCN_4365 | 22998 |
| CTCN_1606 | 12812 | GTCN_2341 | 22999 |
| CTCN_1607 | 12813 | GTCN_2342 | 23000 |
| CTCN_1608 | 12814 | CTCN_4118 | 23001 |
| TTCN_1924 | 12815 | ATCN_2716 | 23002 |
| ATCN_1178 | 12816 | TTCN_4366 | 23003 |
| CTCN_1609 | 12817 | TTCN_4367 | 23004 |
| CTCN_1610 | 12818 | ATCN_2717 | 23005 |
| CTCN_1611 | 12819 | ATCN_2718 | 23006 |
| CTCN_1612 | 12820 | CTCN_4119 | 23007 |
| GTCN_1018 | 12821 | ATCN_2719 | 23008 |
| GTCN_1019 | 12822 | TTCN_4368 | 23009 |
| TTCN_1925 | 12823 | TTCN_4369 | 23010 |
| CTCN_1613 | 12824 | ATCN_2720 | 23011 |
| ATCN_1179 | 12825 | TTCN_4370 | 23012 |
| CTCN_1614 | 12826 | TTCN_4371 | 23013 |
| TTCN_1926 | 12827 | GTCN_2343 | 23014 |
| CTCN_1615 | 12828 | TTCN_4372 | 23015 |
| TTCN_1927 | 12829 | ATCN_2721 | 23016 |
| CTCN_1616 | 12830 | ATCN_2722 | 23017 |
| GTCN_1020 | 12831 | TTCN_4373 | 23018 |
| TTCN_1928 | 12832 | CTCN_4120 | 23019 |
| TTCN_1929 | 12833 | ATCN_2723 | 23020 |
| TTCN_1930 | 12834 | TTCN_4374 | 23021 |
| CTCN_1617 | 12835 | ATCN_2724 | 23022 |
| ATCN_1180 | 12836 | TTCN_4375 | 23023 |
| GTCN_1021 | 12837 | TTCN_4376 | 23024 |
| TTCN_1931 | 12838 | ATCN_2725 | 23025 |
| ATCN_1181 | 12839 | CTCN_4121 | 23026 |
| CTCN_1618 | 12840 | TTCN_4377 | 23027 |
| CTCN_1619 | 12841 | TTCN_4378 | 23028 |
| CTCN_1620 | 12842 | CTCN_4122 | 23029 |
| CTCN_1621 | 12843 | ATCN_2726 | 23030 |
| TTCN_1932 | 12844 | ATCN_2727 | 23031 |
| TTCN_1933 | 12845 | ATCN_2728 | 23032 |
| CTCN_1622 | 12846 | CTCN_4123 | 23033 |
| GTCN_1022 | 12847 | CTCN_4124 | 23034 |
| GTCN_0 | 12848 | TTCN_4379 | 23035 |
| TTCN_0 | 12849 | ATCN_2729 | 23036 |
| CTCN_0 | 12850 | TTCN_4380 | 23037 |
| ATCN_0 | 12851 | ATCN_2730 | 23038 |
| ATCN_1 | 12852 | CTCN_4125 | 23039 |
| GTCN_1 | 12853 | CTCN_4126 | 23040 |
| GTCN_2 | 12854 | CTCN_4127 | 23041 |
| CTCN_1 | 12855 | GTCN_2344 | 23042 |
| CTCN_2 | 12856 | ATCN_2731 | 23043 |

| | | | |
|---|---|---|---|
| CTCN_3 | 12857 | TTCN_4381 | 23044 |
| ATCN_2 | 12858 | ATCN_2732 | 23045 |
| TTCN_1 | 12859 | GTCN_2345 | 23046 |
| TTCN_2 | 12860 | ATCN_2733 | 23047 |
| TTCN_3 | 12861 | CTCN_4128 | 23048 |
| ATCN_3 | 12862 | CTCN_4129 | 23049 |
| TTCN_4 | 12863 | GTCN_2346 | 23050 |
| TTCN_5 | 12864 | CTCN_4130 | 23051 |
| ATCN_4 | 12865 | TTCN_4382 | 23052 |
| TTCN_6 | 12866 | CTCN_4131 | 23053 |
| CTCN_4 | 12867 | CTCN_4132 | 23054 |
| CTCN_5 | 12868 | CTCN_4133 | 23055 |
| GTCN_3 | 12869 | GTCN_2347 | 23056 |
| CTCN_6 | 12870 | TTCN_4383 | 23057 |
| GTCN_4 | 12871 | CTCN_4134 | 23058 |
| TTCN_7 | 12872 | GTCN_2348 | 23059 |
| CTCN_7 | 12873 | TTCN_4384 | 23060 |
| ATCN_5 | 12874 | ATCN_2734 | 23061 |
| TTCN_8 | 12875 | CTCN_4135 | 23062 |
| TTCN_9 | 12876 | GTCN_2349 | 23063 |
| GTCN_5 | 12877 | TTCN_4385 | 23064 |
| CTCN_8 | 12878 | CTCN_4136 | 23065 |
| TTCN_10 | 12879 | CTCN_4137 | 23066 |
| GTCN_6 | 12880 | GTCN_2350 | 23067 |
| TTCN_11 | 12881 | CTCN_4138 | 23068 |
| CTCN_9 | 12882 | CTCN_4139 | 23069 |
| TTCN_12 | 12883 | ATCN_2735 | 23070 |
| CTCN_10 | 12884 | ATCN_2736 | 23071 |
| GTCN_7 | 12885 | TTCN_4386 | 23072 |
| TTCN_13 | 12886 | GTCN_2351 | 23073 |
| ATCN_6 | 12887 | CTCN_4140 | 23074 |
| TTCN_14 | 12888 | CTCN_4141 | 23075 |
| ATCN_7 | 12889 | ATCN_2737 | 23076 |
| ATCN_8 | 12890 | TTCN_4387 | 23077 |
| TTCN_15 | 12891 | CTCN_4142 | 23078 |
| GTCN_8 | 12892 | TTCN_4388 | 23079 |
| TTCN_16 | 12893 | CTCN_4143 | 23080 |
| GTCN_9 | 12894 | GTCN_2352 | 23081 |
| TTCN_17 | 12895 | CTCN_4144 | 23082 |
| CTCN_11 | 12896 | TTCN_4389 | 23083 |
| GTCN_10 | 12897 | ATCN_2738 | 23084 |
| GTCN_11 | 12898 | CTCN_4145 | 23085 |
| GTCN_12 | 12899 | GTCN_2353 | 23086 |
| ATCN_9 | 12900 | GTCN_2354 | 23087 |
| ATCN_10 | 12901 | ATCN_2739 | 23088 |
| CTCN_12 | 12902 | GTCN_2355 | 23089 |
| GTCN_13 | 12903 | CTCN_4146 | 23090 |
| CTCN_13 | 12904 | CTCN_4147 | 23091 |
| TTCN_18 | 12905 | CTCN_4148 | 23092 |
| ATCN_11 | 12906 | ATCN_2740 | 23093 |
| TTCN_19 | 12907 | ATCN_2741 | 23094 |
| ATCN_12 | 12908 | CTCN_4149 | 23095 |
| TTCN_20 | 12909 | CTCN_4150 | 23096 |
| CTCN_14 | 12910 | ATCN_2742 | 23097 |
| TTCN_21 | 12911 | CTCN_4151 | 23098 |

FIG. 36 (continued)

| | | | |
|---|---|---|---|
| CTCN_15 | 12912 | CTCN_4152 | 23099 |
| TTCN_22 | 12913 | GTCN_2356 | 23100 |
| CTCN_16 | 12914 | TTCN_4390 | 23101 |
| GTCN_14 | 12915 | GTCN_2357 | 23102 |
| ATCN_13 | 12916 | CTCN_4153 | 23103 |
| CTCN_17 | 12917 | CTCN_4154 | 23104 |
| GTCN_15 | 12918 | TTCN_4391 | 23105 |
| TTCN_23 | 12919 | CTCN_4155 | 23106 |
| ATCN_14 | 12920 | CTCN_4156 | 23107 |
| ATCN_15 | 12921 | TTCN_4392 | 23108 |
| CTCN_18 | 12922 | ATCN_2743 | 23109 |
| CTCN_19 | 12923 | TTCN_4393 | 23110 |
| CTCN_20 | 12924 | TTCN_4394 | 23111 |
| CTCN_21 | 12925 | TTCN_4395 | 23112 |
| CTCN_22 | 12926 | ATCN_2744 | 23113 |
| TTCN_24 | 12927 | TTCN_4396 | 23114 |
| TTCN_25 | 12928 | CTCN_4157 | 23115 |
| TTCN_26 | 12929 | TTCN_4397 | 23116 |
| CTCN_23 | 12930 | CTCN_4158 | 23117 |
| CTCN_24 | 12931 | ATCN_2745 | 23118 |
| CTCN_25 | 12932 | ATCN_2746 | 23119 |
| ATCN_16 | 12933 | GTCN_2358 | 23120 |
| CTCN_26 | 12934 | ATCN_2747 | 23121 |
| TTCN_27 | 12935 | CTCN_4159 | 23122 |
| CTCN_27 | 12936 | GTCN_2359 | 23123 |
| ATCN_17 | 12937 | TTCN_4398 | 23124 |
| TTCN_28 | 12938 | GTCN_2360 | 23125 |
| GTCN_16 | 12939 | CTCN_4160 | 23126 |
| TTCN_29 | 12940 | CTCN_4161 | 23127 |
| GTCN_17 | 12941 | CTCN_4162 | 23128 |
| CTCN_28 | 12942 | GTCN_2361 | 23129 |
| CTCN_29 | 12943 | CTCN_4163 | 23130 |
| GTCN_18 | 12944 | CTCN_4164 | 23131 |
| TTCN_30 | 12945 | CTCN_4165 | 23132 |
| TTCN_31 | 12946 | CTCN_4166 | 23133 |
| CTCN_30 | 12947 | TTCN_4399 | 23134 |
| CTCN_31 | 12948 | CTCN_4167 | 23135 |
| TTCN_32 | 12949 | CTCN_4168 | 23136 |
| GTCN_19 | 12950 | CTCN_4169 | 23137 |
| CTCN_32 | 12951 | ATCN_2748 | 23138 |
| GTCN_20 | 12952 | ATCN_2749 | 23139 |
| ATCN_18 | 12953 | GTCN_2362 | 23140 |
| CTCN_33 | 12954 | CTCN_4170 | 23141 |
| ATCN_19 | 12955 | GTCN_2363 | 23142 |
| TTCN_33 | 12956 | CTCN_4171 | 23143 |
| TTCN_34 | 12957 | GTCN_2364 | 23144 |
| GTCN_21 | 12958 | CTCN_4172 | 23145 |
| TTCN_35 | 12959 | TTCN_4400 | 23146 |
| CTCN_34 | 12960 | TTCN_4401 | 23147 |
| ATCN_20 | 12961 | CTCN_4173 | 23148 |
| TTCN_36 | 12962 | TTCN_4402 | 23149 |
| TTCN_37 | 12963 | TTCN_4403 | 23150 |
| CTCN_35 | 12964 | CTCN_4174 | 23151 |
| GTCN_22 | 12965 | GTCN_2365 | 23152 |
| CTCN_36 | 12966 | CTCN_4175 | 23153 |

| | | | |
|---|---|---|---|
| TTCN_38 | 12967 | CTCN_4176 | 23154 |
| CTCN_37 | 12968 | CTCN_4177 | 23155 |
| TTCN_39 | 12969 | TTCN_4404 | 23156 |
| ATCN_21 | 12970 | TTCN_4405 | 23157 |
| TTCN_40 | 12971 | TTCN_4406 | 23158 |
| CTCN_38 | 12972 | TTCN_4407 | 23159 |
| CTCN_39 | 12973 | TTCN_4408 | 23160 |
| CTCN_40 | 12974 | ATCN_2750 | 23161 |
| TTCN_41 | 12975 | CTCN_4178 | 23162 |
| GTCN_23 | 12976 | TTCN_4409 | 23163 |
| CTCN_41 | 12977 | GTCN_2366 | 23164 |
| TTCN_42 | 12978 | CTCN_4179 | 23165 |
| GTCN_24 | 12979 | CTCN_4180 | 23166 |
| TTCN_43 | 12980 | TTCN_4410 | 23167 |
| CTCN_42 | 12981 | GTCN_2367 | 23168 |
| GTCN_25 | 12982 | TTCN_4411 | 23169 |
| ATCN_22 | 12983 | CTCN_4181 | 23170 |
| TTCN_44 | 12984 | GTCN_2368 | 23171 |
| CTCN_43 | 12985 | ATCN_2751 | 23172 |
| TTCN_45 | 12986 | CTCN_4182 | 23173 |
| TTCN_46 | 12987 | ATCN_2752 | 23174 |
| TTCN_47 | 12988 | CTCN_4183 | 23175 |
| GTCN_26 | 12989 | TTCN_4412 | 23176 |
| TTCN_48 | 12990 | TTCN_4413 | 23177 |
| CTCN_44 | 12991 | TTCN_4414 | 23178 |
| TTCN_49 | 12992 | ATCN_2753 | 23179 |
| CTCN_45 | 12993 | TTCN_4415 | 23180 |
| TTCN_50 | 12994 | ATCN_2754 | 23181 |
| GTCN_27 | 12995 | TTCN_4416 | 23182 |
| TTCN_51 | 12996 | TTCN_4417 | 23183 |
| TTCN_52 | 12997 | CTCN_4184 | 23184 |
| CTCN_46 | 12998 | TTCN_4418 | 23185 |
| GTCN_28 | 12999 | GTCN_2369 | 23186 |
| ATCN_23 | 13000 | ATCN_2755 | 23187 |
| TTCN_53 | 13001 | ATCN_2756 | 23188 |
| GTCN_29 | 13002 | TTCN_4419 | 23189 |
| TTCN_54 | 13003 | TTCN_4420 | 23190 |
| TTCN_55 | 13004 | TTCN_4421 | 23191 |
| TTCN_56 | 13005 | TTCN_4422 | 23192 |
| TTCN_57 | 13006 | ATCN_2757 | 23193 |
| GTCN_30 | 13007 | CTCN_4185 | 23194 |
| CTCN_47 | 13008 | CTCN_4186 | 23195 |
| GTCN_31 | 13009 | GTCN_2370 | 23196 |
| CTCN_48 | 13010 | GTCN_2371 | 23197 |
| CTCN_49 | 13011 | TTCN_4423 | 23198 |
| TTCN_58 | 13012 | CTCN_4187 | 23199 |
| ATCN_24 | 13013 | CTCN_4188 | 23200 |
| GTCN_32 | 13014 | ATCN_2758 | 23201 |
| TTCN_59 | 13015 | ATCN_2759 | 23202 |
| GTCN_33 | 13016 | GTCN_2372 | 23203 |
| TTCN_60 | 13017 | CTCN_4189 | 23204 |
| TTCN_61 | 13018 | TTCN_4424 | 23205 |
| GTCN_34 | 13019 | CTCN_4190 | 23206 |
| GTCN_35 | 13020 | GTCN_2373 | 23207 |
| ATCN_25 | 13021 | ATCN_2760 | 23208 |

FIG. 36 (continued)

| | | | | | | | |
|---|---|---|---|---|---|---|---|
| ATCN_26 | 13022 | CTCN_4191 | 23209 | TTCN_85 | 13077 | GTCN_2384 | 23264 |
| ATCN_27 | 13023 | TTCN_4425 | 23210 | CTCN_61 | 13078 | TTCN_4445 | 23265 |
| ATCN_28 | 13024 | CTCN_4192 | 23211 | GTCN_43 | 13079 | TTCN_4446 | 23266 |
| TTCN_62 | 13025 | TTCN_4426 | 23212 | ATCN_40 | 13080 | ATCN_2768 | 23267 |
| ATCN_29 | 13026 | CTCN_4193 | 23213 | ATCN_41 | 13081 | TTCN_4447 | 23268 |
| ATCN_30 | 13027 | TTCN_4427 | 23214 | TTCN_86 | 13082 | TTCN_4448 | 23269 |
| TTCN_63 | 13028 | ATCN_2761 | 23215 | TTCN_87 | 13083 | CTCN_4209 | 23270 |
| TTCN_64 | 13029 | GTCN_2374 | 23216 | ATCN_42 | 13084 | CTCN_4210 | 23271 |
| TTCN_65 | 13030 | CTCN_4194 | 23217 | TTCN_88 | 13085 | CTCN_4211 | 23272 |
| GTCN_36 | 13031 | ATCN_2762 | 23218 | CTCN_62 | 13086 | CTCN_4212 | 23273 |
| ATCN_31 | 13032 | TTCN_4428 | 23219 | ATCN_43 | 13087 | TTCN_4449 | 23274 |
| GTCN_37 | 13033 | GTCN_2375 | 23220 | ATCN_44 | 13088 | ATCN_2769 | 23275 |
| GTCN_38 | 13034 | TTCN_4429 | 23221 | CTCN_63 | 13089 | TTCN_4450 | 23276 |
| CTCN_50 | 13035 | CTCN_4195 | 23222 | TTCN_89 | 13090 | ATCN_2770 | 23277 |
| ATCN_32 | 13036 | CTCN_4196 | 23223 | CTCN_64 | 13091 | TTCN_4451 | 23278 |
| TTCN_66 | 13037 | CTCN_4197 | 23224 | GTCN_44 | 13092 | TTCN_4452 | 23279 |
| TTCN_67 | 13038 | CTCN_4198 | 23225 | CTCN_65 | 13093 | CTCN_4213 | 23280 |
| TTCN_68 | 13039 | GTCN_2376 | 23226 | TTCN_90 | 13094 | TTCN_4453 | 23281 |
| TTCN_69 | 13040 | TTCN_4430 | 23227 | CTCN_66 | 13095 | ATCN_2771 | 23282 |
| TTCN_70 | 13041 | TTCN_4431 | 23228 | CTCN_67 | 13096 | TTCN_4454 | 23283 |
| ATCN_33 | 13042 | ATCN_2763 | 23229 | CTCN_68 | 13097 | TTCN_4455 | 23284 |
| TTCN_71 | 13043 | CTCN_4199 | 23230 | CTCN_69 | 13098 | TTCN_4456 | 23285 |
| TTCN_72 | 13044 | TTCN_4432 | 23231 | GTCN_45 | 13099 | TTCN_4457 | 23286 |
| ATCN_34 | 13045 | TTCN_4433 | 23232 | CTCN_70 | 13100 | GTCN_2385 | 23287 |
| CTCN_51 | 13046 | CTCN_4200 | 23233 | CTCN_71 | 13101 | CTCN_4214 | 23288 |
| TTCN_73 | 13047 | ATCN_2764 | 23234 | GTCN_46 | 13102 | TTCN_4458 | 23289 |
| ATCN_35 | 13048 | CTCN_4201 | 23235 | TTCN_91 | 13103 | TTCN_4459 | 23290 |
| TTCN_74 | 13049 | GTCN_2377 | 23236 | TTCN_92 | 13104 | ATCN_2772 | 23291 |
| TTCN_75 | 13050 | CTCN_4202 | 23237 | ATCN_45 | 13105 | ATCN_2773 | 23292 |
| ATCN_36 | 13051 | TTCN_4434 | 23238 | TTCN_93 | 13106 | TTCN_4460 | 23293 |
| CTCN_52 | 13052 | GTCN_2378 | 23239 | ATCN_46 | 13107 | GTCN_2386 | 23294 |
| GTCN_39 | 13053 | TTCN_4435 | 23240 | CTCN_72 | 13108 | CTCN_4215 | 23295 |
| ATCN_37 | 13054 | TTCN_4436 | 23241 | TTCN_94 | 13109 | CTCN_4216 | 23296 |
| TTCN_76 | 13055 | CTCN_4203 | 23242 | GTCN_47 | 13110 | TTCN_4461 | 23297 |
| CTCN_53 | 13056 | CTCN_4204 | 23243 | TTCN_95 | 13111 | GTCN_2387 | 23298 |
| TTCN_77 | 13057 | CTCN_4205 | 23244 | TTCN_96 | 13112 | CTCN_4217 | 23299 |
| ATCN_38 | 13058 | TTCN_4437 | 23245 | TTCN_97 | 13113 | ATCN_2774 | 23300 |
| TTCN_78 | 13059 | TTCN_4438 | 23246 | TTCN_98 | 13114 | CTCN_4218 | 23301 |
| CTCN_54 | 13060 | ATCN_2765 | 23247 | CTCN_73 | 13115 | CTCN_4219 | 23302 |
| TTCN_79 | 13061 | TTCN_4439 | 23248 | TTCN_99 | 13116 | CTCN_4220 | 23303 |
| TTCN_80 | 13062 | GTCN_2379 | 23249 | TTCN_100 | 13117 | TTCN_4462 | 23304 |
| TTCN_81 | 13063 | GTCN_2380 | 23250 | ATCN_47 | 13118 | GTCN_2388 | 23305 |
| CTCN_55 | 13064 | GTCN_2381 | 23251 | GTCN_48 | 13119 | TTCN_4463 | 23306 |
| CTCN_56 | 13065 | TTCN_4440 | 23252 | TTCN_101 | 13120 | TTCN_4464 | 23307 |
| GTCN_40 | 13066 | ATCN_2766 | 23253 | TTCN_102 | 13121 | TTCN_4465 | 23308 |
| CTCN_57 | 13067 | TTCN_4441 | 23254 | TTCN_103 | 13122 | GTCN_2389 | 23309 |
| ATCN_39 | 13068 | TTCN_4442 | 23255 | CTCN_74 | 13123 | TTCN_4466 | 23310 |
| CTCN_58 | 13069 | CTCN_4206 | 23256 | TTCN_104 | 13124 | ATCN_2775 | 23311 |
| CTCN_59 | 13070 | GTCN_2382 | 23257 | GTCN_49 | 13125 | TTCN_4467 | 23312 |
| GTCN_41 | 13071 | TTCN_4443 | 23258 | ATCN_48 | 13126 | TTCN_4468 | 23313 |
| TTCN_82 | 13072 | TTCN_4444 | 23259 | CTCN_75 | 13127 | CTCN_4221 | 23314 |
| TTCN_83 | 13073 | ATCN_2767 | 23260 | GTCN_50 | 13128 | ATCN_2776 | 23315 |
| CTCN_60 | 13074 | CTCN_4207 | 23261 | CTCN_76 | 13129 | ATCN_2777 | 23316 |
| TTCN_84 | 13075 | GTCN_2383 | 23262 | GTCN_51 | 13130 | TTCN_4469 | 23317 |
| GTCN_42 | 13076 | CTCN_4208 | 23263 | TTCN_105 | 13131 | GTCN_2390 | 23318 |

FIG. 36 (continued)

| | | | |
|---|---|---|---|
| CTCN_77 | 13132 | TTCN_4470 | 23319 |
| GTCN_52 | 13133 | TTCN_4471 | 23320 |
| TTCN_106 | 13134 | CTCN_4222 | 23321 |
| GTCN_53 | 13135 | TTCN_4472 | 23322 |
| CTCN_78 | 13136 | TTCN_4473 | 23323 |
| TTCN_107 | 13137 | CTCN_4223 | 23324 |
| GTCN_54 | 13138 | ATCN_2778 | 23325 |
| CTCN_79 | 13139 | GTCN_2391 | 23326 |
| CTCN_80 | 13140 | CTCN_4224 | 23327 |
| GTCN_55 | 13141 | ATCN_2779 | 23328 |
| CTCN_81 | 13142 | CTCN_4225 | 23329 |
| CTCN_82 | 13143 | TTCN_4474 | 23330 |
| CTCN_83 | 13144 | CTCN_4226 | 23331 |
| TTCN_108 | 13145 | ATCN_2780 | 23332 |
| ATCN_49 | 13146 | CTCN_4227 | 23333 |
| CTCN_84 | 13147 | CTCN_4228 | 23334 |
| GTCN_56 | 13148 | ATCN_2781 | 23335 |
| CTCN_85 | 13149 | ATCN_2782 | 23336 |
| CTCN_86 | 13150 | CTCN_4229 | 23337 |
| TTCN_109 | 13151 | GTCN_2392 | 23338 |
| ATCN_50 | 13152 | CTCN_4230 | 23339 |
| ATCN_51 | 13153 | TTCN_4475 | 23340 |
| ATCN_52 | 13154 | CTCN_4231 | 23341 |
| TTCN_110 | 13155 | TTCN_4476 | 23342 |
| ATCN_53 | 13156 | ATCN_2783 | 23343 |
| ATCN_54 | 13157 | CTCN_4232 | 23344 |
| CTCN_87 | 13158 | GTCN_2393 | 23345 |
| TTCN_111 | 13159 | CTCN_4233 | 23346 |
| CTCN_88 | 13160 | CTCN_4234 | 23347 |
| TTCN_112 | 13161 | CTCN_4235 | 23348 |
| ATCN_55 | 13162 | TTCN_4477 | 23349 |
| CTCN_89 | 13163 | TTCN_4478 | 23350 |
| CTCN_90 | 13164 | CTCN_4236 | 23351 |
| TTCN_113 | 13165 | CTCN_4237 | 23352 |
| TTCN_114 | 13166 | GTCN_2394 | 23353 |
| GTCN_57 | 13167 | CTCN_4238 | 23354 |
| TTCN_115 | 13168 | GTCN_2395 | 23355 |
| TTCN_116 | 13169 | GTCN_2396 | 23356 |
| ATCN_56 | 13170 | CTCN_4239 | 23357 |
| TTCN_117 | 13171 | GTCN_2397 | 23358 |
| CTCN_91 | 13172 | CTCN_4240 | 23359 |
| ATCN_57 | 13173 | TTCN_4479 | 23360 |
| ATCN_58 | 13174 | TTCN_4480 | 23361 |
| GTCN_58 | 13175 | TTCN_4481 | 23362 |
| ATCN_59 | 13176 | TTCN_4482 | 23363 |
| ATCN_60 | 13177 | TTCN_4483 | 23364 |
| ATCN_61 | 13178 | TTCN_4484 | 23365 |
| TTCN_118 | 13179 | TTCN_4485 | 23366 |
| ATCN_62 | 13180 | ATCN_2784 | 23367 |
| TTCN_119 | 13181 | CTCN_4241 | 23368 |
| CTCN_92 | 13182 | TTCN_4486 | 23369 |
| CTCN_93 | 13183 | TTCN_4487 | 23370 |
| GTCN_59 | 13184 | GTCN_2398 | 23371 |
| ATCN_63 | 13185 | TTCN_4374 | 23372 |
| CTCN_94 | 13186 | ATCN_2724 | 23373 |

| | | | |
|---|---|---|---|
| ATCN_64 | 13187 | TTCN_4375 | 23374 |
| TTCN_120 | 13188 | TTCN_4376 | 23375 |
| ATCN_65 | 13189 | ATCN_2725 | 23376 |
| TTCN_121 | 13190 | CTCN_4121 | 23377 |
| TTCN_122 | 13191 | TTCN_4377 | 23378 |
| GTCN_60 | 13192 | TTCN_4378 | 23379 |
| TTCN_123 | 13193 | CTCN_4122 | 23380 |
| CTCN_95 | 13194 | ATCN_2726 | 23381 |
| CTCN_96 | 13195 | ATCN_2727 | 23382 |
| GTCN_61 | 13196 | ATCN_2728 | 23383 |
| TTCN_124 | 13197 | CTCN_4123 | 23384 |
| ATCN_66 | 13198 | CTCN_4124 | 23385 |
| TTCN_125 | 13199 | TTCN_4379 | 23386 |
| ATCN_67 | 13200 | ATCN_2729 | 23387 |
| TTCN_126 | 13201 | TTCN_4380 | 23388 |
| TTCN_127 | 13202 | ATCN_2730 | 23389 |
| GTCN_62 | 13203 | CTCN_4125 | 23390 |
| CTCN_97 | 13204 | CTCN_4126 | 23391 |
| TTCN_128 | 13205 | CTCN_4127 | 23392 |
| CTCN_98 | 13206 | GTCN_2344 | 23393 |
| TTCN_129 | 13207 | ATCN_2731 | 23394 |
| CTCN_99 | 13208 | TTCN_4381 | 23395 |
| GTCN_63 | 13209 | ATCN_2732 | 23396 |
| TTCN_130 | 13210 | GTCN_2345 | 23397 |
| TTCN_131 | 13211 | ATCN_2733 | 23398 |
| TTCN_132 | 13212 | CTCN_4128 | 23399 |
| GTCN_64 | 13213 | CTCN_4129 | 23400 |
| ATCN_68 | 13214 | GTCN_2346 | 23401 |
| ATCN_69 | 13215 | CTCN_4130 | 23402 |
| TTCN_133 | 13216 | TTCN_4382 | 23403 |
| ATCN_70 | 13217 | CTCN_4131 | 23404 |
| CTCN_100 | 13218 | CTCN_4132 | 23405 |
| GTCN_65 | 13219 | CTCN_4133 | 23406 |
| CTCN_101 | 13220 | GTCN_2347 | 23407 |
| TTCN_134 | 13221 | TTCN_4383 | 23408 |
| ATCN_71 | 13222 | CTCN_4134 | 23409 |
| TTCN_135 | 13223 | GTCN_2348 | 23410 |
| ATCN_72 | 13224 | TTCN_4384 | 23411 |
| GTCN_66 | 13225 | ATCN_2734 | 23412 |
| GTCN_67 | 13226 | CTCN_4135 | 23413 |
| ATCN_73 | 13227 | GTCN_2349 | 23414 |
| ATCN_74 | 13228 | TTCN_4385 | 23415 |
| TTCN_136 | 13229 | CTCN_4136 | 23416 |
| ATCN_75 | 13230 | CTCN_4137 | 23417 |
| CTCN_102 | 13231 | GTCN_2350 | 23418 |
| TTCN_137 | 13232 | CTCN_4138 | 23419 |
| TTCN_138 | 13233 | CTCN_4139 | 23420 |
| GTCN_68 | 13234 | ATCN_2735 | 23421 |
| TTCN_139 | 13235 | ATCN_2736 | 23422 |
| GTCN_69 | 13236 | TTCN_4386 | 23423 |
| TTCN_140 | 13237 | GTCN_2351 | 23424 |
| ATCN_76 | 13238 | CTCN_4140 | 23425 |
| CTCN_103 | 13239 | CTCN_4141 | 23426 |
| TTCN_141 | 13240 | ATCN_2737 | 23427 |
| ATCN_77 | 13241 | TTCN_4387 | 23428 |

FIG. 36 (continued)

| | | | |
|---|---|---|---|
| GTCN_70 | 13242 | CTCN_4142 | 23429 |
| GTCN_71 | 13243 | TTCN_4388 | 23430 |
| GTCN_72 | 13244 | CTCN_4143 | 23431 |
| CTCN_104 | 13245 | GTCN_2352 | 23432 |
| GTCN_73 | 13246 | CTCN_4144 | 23433 |
| TTCN_142 | 13247 | TTCN_4389 | 23434 |
| ATCN_78 | 13248 | ATCN_2738 | 23435 |
| GTCN_74 | 13249 | CTCN_4145 | 23436 |
| TTCN_143 | 13250 | GTCN_2353 | 23437 |
| TTCN_144 | 13251 | GTCN_2354 | 23438 |
| CTCN_105 | 13252 | ATCN_2739 | 23439 |
| TTCN_145 | 13253 | GTCN_2355 | 23440 |
| TTCN_146 | 13254 | CTCN_4146 | 23441 |
| GTCN_75 | 13255 | CTCN_4147 | 23442 |
| GTCN_76 | 13256 | CTCN_4148 | 23443 |
| GTCN_77 | 13257 | ATCN_2740 | 23444 |
| CTCN_106 | 13258 | ATCN_2741 | 23445 |
| ATCN_79 | 13259 | CTCN_4149 | 23446 |
| ATCN_80 | 13260 | CTCN_4150 | 23447 |
| ATCN_81 | 13261 | ATCN_2742 | 23448 |
| ATCN_82 | 13262 | CTCN_4151 | 23449 |
| CTCN_107 | 13263 | CTCN_4152 | 23450 |
| CTCN_108 | 13264 | GTCN_2356 | 23451 |
| TTCN_147 | 13265 | TTCN_4390 | 23452 |
| CTCN_109 | 13266 | GTCN_2357 | 23453 |
| GTCN_1022 | 13267 | CTCN_4153 | 23454 |
| TTCN_1934 | 13268 | CTCN_4154 | 23455 |
| CTCN_1623 | 13269 | TTCN_4391 | 23456 |
| ATCN_1182 | 13270 | CTCN_4155 | 23457 |
| GTCN_1023 | 13271 | CTCN_4156 | 23458 |
| TTCN_1935 | 13272 | TTCN_4392 | 23459 |
| CTCN_1624 | 13273 | ATCN_2743 | 23460 |
| ATCN_1183 | 13274 | TTCN_4393 | 23461 |
| TTCN_1936 | 13275 | TTCN_4394 | 23462 |
| GTCN_1024 | 13276 | TTCN_4395 | 23463 |
| CTCN_1625 | 13277 | ATCN_2744 | 23464 |
| ATCN_1184 | 13278 | TTCN_4396 | 23465 |
| ATCN_1185 | 13279 | CTCN_4157 | 23466 |
| TTCN_1937 | 13280 | TTCN_4397 | 23467 |
| CTCN_1626 | 13281 | CTCN_4158 | 23468 |
| TTCN_1938 | 13282 | ATCN_2745 | 23469 |
| GTCN_1025 | 13283 | ATCN_2746 | 23470 |
| ATCN_1186 | 13284 | GTCN_2358 | 23471 |
| TTCN_1939 | 13285 | ATCN_2747 | 23472 |
| TTCN_1940 | 13286 | CTCN_4159 | 23473 |
| TTCN_1941 | 13287 | GTCN_2359 | 23474 |
| TTCN_1942 | 13288 | TTCN_4398 | 23475 |
| GTCN_1026 | 13289 | GTCN_2360 | 23476 |
| CTCN_1627 | 13290 | CTCN_4160 | 23477 |
| CTCN_1628 | 13291 | CTCN_4161 | 23478 |
| TTCN_1943 | 13292 | CTCN_4162 | 23479 |
| GTCN_1027 | 13293 | GTCN_2361 | 23480 |
| CTCN_1629 | 13294 | CTCN_4163 | 23481 |
| GTCN_1028 | 13295 | CTCN_4164 | 23482 |
| GTCN_1029 | 13296 | CTCN_4165 | 23483 |

| | | | |
|---|---|---|---|
| ATCN_1187 | 13297 | CTCN_4166 | 23484 |
| GTCN_1030 | 13298 | TTCN_4399 | 23485 |
| TTCN_1944 | 13299 | CTCN_4167 | 23486 |
| TTCN_1945 | 13300 | CTCN_4168 | 23487 |
| ATCN_1188 | 13301 | CTCN_4169 | 23488 |
| TTCN_1946 | 13302 | ATCN_2748 | 23489 |
| GTCN_1031 | 13303 | ATCN_2749 | 23490 |
| TTCN_1947 | 13304 | GTCN_2362 | 23491 |
| ATCN_1189 | 13305 | CTCN_4170 | 23492 |
| TTCN_1948 | 13306 | GTCN_2363 | 23493 |
| CTCN_1630 | 13307 | CTCN_4171 | 23494 |
| CTCN_1631 | 13308 | GTCN_2364 | 23495 |
| GTCN_1032 | 13309 | CTCN_4172 | 23496 |
| GTCN_1033 | 13310 | TTCN_4400 | 23497 |
| TTCN_1949 | 13311 | TTCN_4401 | 23498 |
| TTCN_1950 | 13312 | CTCN_4173 | 23499 |
| TTCN_1951 | 13313 | TTCN_4402 | 23500 |
| CTCN_1632 | 13314 | TTCN_4403 | 23501 |
| GTCN_1034 | 13315 | CTCN_4174 | 23502 |
| GTCN_1035 | 13316 | GTCN_2365 | 23503 |
| TTCN_1952 | 13317 | CTCN_4175 | 23504 |
| TTCN_1953 | 13318 | CTCN_4176 | 23505 |
| ATCN_1190 | 13319 | CTCN_4177 | 23506 |
| GTCN_1036 | 13320 | TTCN_4404 | 23507 |
| TTCN_1954 | 13321 | TTCN_4405 | 23508 |
| GTCN_1037 | 13322 | TTCN_4406 | 23509 |
| CTCN_1633 | 13323 | TTCN_4407 | 23510 |
| TTCN_1955 | 13324 | TTCN_4408 | 23511 |
| ATCN_1191 | 13325 | ATCN_2750 | 23512 |
| TTCN_1956 | 13326 | CTCN_4178 | 23513 |
| TTCN_1957 | 13327 | TTCN_4409 | 23514 |
| TTCN_1958 | 13328 | GTCN_2366 | 23515 |
| GTCN_1038 | 13329 | CTCN_4179 | 23516 |
| ATCN_1192 | 13330 | CTCN_4180 | 23517 |
| TTCN_1959 | 13331 | TTCN_4410 | 23518 |
| CTCN_1634 | 13332 | GTCN_2367 | 23519 |
| TTCN_1960 | 13333 | TTCN_4411 | 23520 |
| TTCN_1961 | 13334 | CTCN_4181 | 23521 |
| ATCN_1193 | 13335 | GTCN_2368 | 23522 |
| GTCN_1039 | 13336 | ATCN_2751 | 23523 |
| TTCN_1962 | 13337 | CTCN_4182 | 23524 |
| GTCN_1040 | 13338 | ATCN_2752 | 23525 |
| TTCN_1963 | 13339 | CTCN_4183 | 23526 |
| ATCN_1194 | 13340 | TTCN_4412 | 23527 |
| GTCN_1041 | 13341 | TTCN_4413 | 23528 |
| TTCN_1964 | 13342 | TTCN_4414 | 23529 |
| ATCN_1195 | 13343 | ATCN_2753 | 23530 |
| TTCN_1965 | 13344 | TTCN_4415 | 23531 |
| ATCN_1196 | 13345 | ATCN_2754 | 23532 |
| TTCN_1966 | 13346 | TTCN_4416 | 23533 |
| TTCN_1967 | 13347 | TTCN_4417 | 23534 |
| ATCN_1197 | 13348 | CTCN_4184 | 23535 |
| ATCN_1198 | 13349 | TTCN_4418 | 23536 |
| TTCN_1968 | 13350 | GTCN_2369 | 23537 |
| TTCN_1969 | 13351 | ATCN_2755 | 23538 |

FIG. 36 (continued)

| | | | |
|---|---|---|---|
| CTCN_1635 | 13352 | ATCN_2756 | 23539 |
| ATCN_1199 | 13353 | TTCN_4419 | 23540 |
| ATCN_1200 | 13354 | TTCN_4420 | 23541 |
| ATCN_1201 | 13355 | TTCN_4421 | 23542 |
| ATCN_1202 | 13356 | TTCN_4422 | 23543 |
| GTCN_1042 | 13357 | ATCN_2757 | 23544 |
| GTCN_1043 | 13358 | CTCN_4185 | 23545 |
| TTCN_1970 | 13359 | CTCN_4186 | 23546 |
| GTCN_1044 | 13360 | GTCN_2370 | 23547 |
| GTCN_1045 | 13361 | GTCN_2371 | 23548 |
| GTCN_1046 | 13362 | TTCN_4423 | 23549 |
| ATCN_1203 | 13363 | CTCN_4187 | 23550 |
| ATCN_1204 | 13364 | CTCN_4188 | 23551 |
| CTCN_1636 | 13365 | ATCN_2758 | 23552 |
| CTCN_1637 | 13366 | ATCN_2759 | 23553 |
| ATCN_1205 | 13367 | GTCN_2372 | 23554 |
| TTCN_1971 | 13368 | CTCN_4189 | 23555 |
| TTCN_1972 | 13369 | TTCN_4424 | 23556 |
| TTCN_1973 | 13370 | CTCN_4190 | 23557 |
| GTCN_1047 | 13371 | GTCN_2373 | 23558 |
| CTCN_1638 | 13372 | ATCN_2760 | 23559 |
| GTCN_1048 | 13373 | CTCN_4191 | 23560 |
| TTCN_1974 | 13374 | TTCN_4425 | 23561 |
| TTCN_1975 | 13375 | CTCN_4192 | 23562 |
| TTCN_1976 | 13376 | TTCN_4426 | 23563 |
| TTCN_1977 | 13377 | CTCN_4193 | 23564 |
| GTCN_1049 | 13378 | TTCN_4427 | 23565 |
| TTCN_1978 | 13379 | ATCN_2761 | 23566 |
| GTCN_1050 | 13380 | GTCN_2374 | 23567 |
| ATCN_1206 | 13381 | CTCN_4194 | 23568 |
| ATCN_1207 | 13382 | ATCN_2762 | 23569 |
| ATCN_1208 | 13383 | TTCN_4428 | 23570 |
| CTCN_1639 | 13384 | GTCN_2375 | 23571 |
| ATCN_1209 | 13385 | TTCN_4429 | 23572 |
| GTCN_1051 | 13386 | CTCN_4195 | 23573 |
| GTCN_1052 | 13387 | CTCN_4196 | 23574 |
| TTCN_1979 | 13388 | CTCN_4197 | 23575 |
| CTCN_1640 | 13389 | CTCN_4198 | 23576 |
| CTCN_1641 | 13390 | GTCN_2376 | 23577 |
| CTCN_1642 | 13391 | TTCN_4430 | 23578 |
| ATCN_1210 | 13392 | TTCN_4431 | 23579 |
| ATCN_1211 | 13393 | ATCN_2763 | 23580 |
| CTCN_1643 | 13394 | CTCN_4199 | 23581 |
| ATCN_1212 | 13395 | TTCN_4432 | 23582 |
| GTCN_1053 | 13396 | TTCN_4433 | 23583 |
| GTCN_1054 | 13397 | CTCN_4200 | 23584 |
| CTCN_1644 | 13398 | ATCN_2764 | 23585 |
| ATCN_1213 | 13399 | CTCN_4201 | 23586 |
| GTCN_1055 | 13400 | GTCN_2377 | 23587 |
| GTCN_1056 | 13401 | CTCN_4202 | 23588 |
| ATCN_1214 | 13402 | TTCN_4434 | 23589 |
| GTCN_1057 | 13403 | GTCN_2378 | 23590 |
| TTCN_1980 | 13404 | TTCN_4435 | 23591 |
| TTCN_1981 | 13405 | TTCN_4436 | 23592 |
| CTCN_1645 | 13406 | CTCN_4203 | 23593 |

| | | | |
|---|---|---|---|
| TTCN_1982 | 13407 | CTCN_4204 | 23594 |
| TTCN_1983 | 13408 | CTCN_4205 | 23595 |
| TTCN_1984 | 13409 | TTCN_4437 | 23596 |
| TTCN_1985 | 13410 | TTCN_4438 | 23597 |
| TTCN_1986 | 13411 | ATCN_2765 | 23598 |
| CTCN_1646 | 13412 | TTCN_4439 | 23599 |
| CTCN_1647 | 13413 | GTCN_2379 | 23600 |
| ATCN_1215 | 13414 | GTCN_2380 | 23601 |
| ATCN_1216 | 13415 | GTCN_2381 | 23602 |
| CTCN_1648 | 13416 | TTCN_4440 | 23603 |
| CTCN_1649 | 13417 | ATCN_2766 | 23604 |
| CTCN_1650 | 13418 | TTCN_4441 | 23605 |
| CTCN_1651 | 13419 | TTCN_4442 | 23606 |
| TTCN_1987 | 13420 | CTCN_4206 | 23607 |
| ATCN_1217 | 13421 | GTCN_2382 | 23608 |
| TTCN_1988 | 13422 | TTCN_4443 | 23609 |
| CTCN_1652 | 13423 | TTCN_4444 | 23610 |
| GTCN_1058 | 13424 | ATCN_2767 | 23611 |
| CTCN_1653 | 13425 | CTCN_4207 | 23612 |
| CTCN_1654 | 13426 | GTCN_2383 | 23613 |
| CTCN_1655 | 13427 | CTCN_4208 | 23614 |
| ATCN_1218 | 13428 | GTCN_2384 | 23615 |
| TTCN_1989 | 13429 | TTCN_4445 | 23616 |
| TTCN_1990 | 13430 | TTCN_4446 | 23617 |
| GTCN_1059 | 13431 | ATCN_2768 | 23618 |
| TTCN_1991 | 13432 | TTCN_4447 | 23619 |
| CTCN_1656 | 13433 | TTCN_4448 | 23620 |
| GTCN_1060 | 13434 | CTCN_4209 | 23621 |
| CTCN_1657 | 13435 | CTCN_4210 | 23622 |
| ATCN_1219 | 13436 | CTCN_4211 | 23623 |
| ATCN_1220 | 13437 | CTCN_4212 | 23624 |
| CTCN_1658 | 13438 | TTCN_4449 | 23625 |
| ATCN_1221 | 13439 | ATCN_2769 | 23626 |
| TTCN_1992 | 13440 | TTCN_4450 | 23627 |
| TTCN_1993 | 13441 | ATCN_2770 | 23628 |
| TTCN_1994 | 13442 | TTCN_4451 | 23629 |
| CTCN_1659 | 13443 | TTCN_4452 | 23630 |
| CTCN_1660 | 13444 | CTCN_4213 | 23631 |
| CTCN_1661 | 13445 | TTCN_4453 | 23632 |
| CTCN_1662 | 13446 | ATCN_2771 | 23633 |
| TTCN_1995 | 13447 | TTCN_4454 | 23634 |
| TTCN_1996 | 13448 | TTCN_4455 | 23635 |
| ATCN_1222 | 13449 | TTCN_4456 | 23636 |
| TTCN_1997 | 13450 | TTCN_4457 | 23637 |
| TTCN_1998 | 13451 | GTCN_2385 | 23638 |
| CTCN_1663 | 13452 | CTCN_4214 | 23639 |
| ATCN_1223 | 13453 | TTCN_4458 | 23640 |
| TTCN_1999 | 13454 | TTCN_4459 | 23641 |
| TTCN_2000 | 13455 | ATCN_2772 | 23642 |
| CTCN_1664 | 13456 | ATCN_2773 | 23643 |
| GTCN_1061 | 13457 | TTCN_4460 | 23644 |
| ATCN_1224 | 13458 | GTCN_2386 | 23645 |
| GTCN_1062 | 13459 | CTCN_4215 | 23646 |
| CTCN_1665 | 13460 | CTCN_4216 | 23647 |
| ATCN_1225 | 13461 | TTCN_4461 | 23648 |

FIG. 36 (continued)

| | | | |
|---|---|---|---|
| ATCN_1226 | 13462 | GTCN_2387 | 23649 |
| TTCN_2001 | 13463 | CTCN_4217 | 23650 |
| CTCN_1666 | 13464 | ATCN_2774 | 23651 |
| ATCN_1227 | 13465 | CTCN_4218 | 23652 |
| TTCN_2002 | 13466 | CTCN_4219 | 23653 |
| TTCN_2003 | 13467 | CTCN_4220 | 23654 |
| TTCN_2004 | 13468 | TTCN_4462 | 23655 |
| TTCN_2005 | 13469 | GTCN_2388 | 23656 |
| CTCN_1667 | 13470 | TTCN_4463 | 23657 |
| TTCN_2006 | 13471 | TTCN_4464 | 23658 |
| TTCN_2007 | 13472 | TTCN_4465 | 23659 |
| TTCN_2008 | 13473 | GTCN_2389 | 23660 |
| TTCN_2009 | 13474 | TTCN_4466 | 23661 |
| CTCN_1668 | 13475 | ATCN_2775 | 23662 |
| CTCN_1669 | 13476 | TTCN_4467 | 23663 |
| GTCN_1063 | 13477 | TTCN_4468 | 23664 |
| ATCN_1228 | 13478 | CTCN_4221 | 23665 |
| GTCN_1064 | 13479 | ATCN_2776 | 23666 |
| ATCN_1229 | 13480 | ATCN_2777 | 23667 |
| GTCN_1065 | 13481 | TTCN_4469 | 23668 |
| TTCN_2010 | 13482 | GTCN_2390 | 23669 |
| ATCN_1230 | 13483 | TTCN_4470 | 23670 |
| ATCN_1231 | 13484 | TTCN_4471 | 23671 |
| CTCN_1670 | 13485 | CTCN_4222 | 23672 |
| ATCN_1232 | 13486 | TTCN_4472 | 23673 |
| CTCN_1671 | 13487 | TTCN_4473 | 23674 |
| TTCN_2011 | 13488 | CTCN_4223 | 23675 |
| TTCN_2012 | 13489 | ATCN_2778 | 23676 |
| CTCN_1672 | 13490 | GTCN_2391 | 23677 |
| GTCN_1066 | 13491 | CTCN_4224 | 23678 |
| GTCN_1067 | 13492 | ATCN_2779 | 23679 |
| GTCN_1068 | 13493 | CTCN_4225 | 23680 |
| CTCN_1673 | 13494 | TTCN_4474 | 23681 |
| ATCN_1233 | 13495 | CTCN_4226 | 23682 |
| ATCN_1234 | 13496 | ATCN_2780 | 23683 |
| TTCN_2013 | 13497 | CTCN_4227 | 23684 |
| GTCN_1069 | 13498 | CTCN_4228 | 23685 |
| TTCN_2014 | 13499 | ATCN_2781 | 23686 |
| GTCN_1070 | 13500 | ATCN_2782 | 23687 |
| ATCN_1235 | 13501 | CTCN_4229 | 23688 |
| ATCN_1236 | 13502 | GTCN_2392 | 23689 |
| ATCN_1237 | 13503 | CTCN_4230 | 23690 |
| GTCN_1071 | 13504 | TTCN_4475 | 23691 |
| GTCN_1072 | 13505 | CTCN_4231 | 23692 |
| CTCN_1674 | 13506 | TTCN_4476 | 23693 |
| CTCN_1675 | 13507 | ATCN_2783 | 23694 |
| ATCN_1238 | 13508 | CTCN_4232 | 23695 |
| GTCN_1073 | 13509 | GTCN_2393 | 23696 |
| CTCN_1676 | 13510 | CTCN_4233 | 23697 |
| CTCN_1677 | 13511 | CTCN_4234 | 23698 |
| CTCN_1678 | 13512 | CTCN_4235 | 23699 |
| GTCN_1074 | 13513 | TTCN_4477 | 23700 |
| TTCN_2015 | 13514 | TTCN_4478 | 23701 |
| ATCN_1239 | 13515 | CTCN_4236 | 23702 |
| TTCN_2016 | 13516 | CTCN_4237 | 23703 |

| | | | |
|---|---|---|---|
| GTCN_1075 | 13517 | GTCN_2394 | 23704 |
| CTCN_1679 | 13518 | CTCN_4238 | 23705 |
| GTCN_1076 | 13519 | GTCN_2395 | 23706 |
| CTCN_1680 | 13520 | GTCN_2396 | 23707 |
| GTCN_1077 | 13521 | CTCN_4239 | 23708 |
| CTCN_1681 | 13522 | GTCN_2397 | 23709 |
| CTCN_1682 | 13523 | CTCN_4240 | 23710 |
| CTCN_1683 | 13524 | TTCN_4479 | 23711 |
| TTCN_2017 | 13525 | TTCN_4480 | 23712 |
| GTCN_1078 | 13526 | TTCN_4481 | 23713 |
| CTCN_1684 | 13527 | TTCN_4482 | 23714 |
| GTCN_1079 | 13528 | TTCN_4483 | 23715 |
| TTCN_2018 | 13529 | TTCN_4484 | 23716 |
| TTCN_2019 | 13530 | TTCN_4485 | 23717 |
| TTCN_2020 | 13531 | ATCN_2784 | 23718 |
| CTCN_1685 | 13532 | CTCN_4241 | 23719 |
| CTCN_1686 | 13533 | TTCN_4486 | 23720 |
| CTCN_1687 | 13534 | TTCN_4487 | 23721 |
| CTCN_1688 | 13535 | GTCN_2398 | 23722 |
| TTCN_2021 | 13536 | ATCN_2785 | 23723 |
| ATCN_1240 | 13537 | TTCN_4488 | 23724 |
| TTCN_2022 | 13538 | TTCN_4489 | 23725 |
| CTCN_1689 | 13539 | ATCN_2786 | 23726 |
| ATCN_1241 | 13540 | ATCN_2787 | 23727 |
| CTCN_1690 | 13541 | TTCN_4490 | 23728 |
| TTCN_2023 | 13542 | ATCN_2788 | 23729 |
| CTCN_1691 | 13543 | TTCN_4491 | 23730 |
| TTCN_2024 | 13544 | GTCN_2399 | 23731 |
| TTCN_2025 | 13545 | TTCN_4492 | 23732 |
| CTCN_1692 | 13546 | CTCN_4242 | 23733 |
| TTCN_2026 | 13547 | CTCN_4243 | 23734 |
| CTCN_1693 | 13548 | TTCN_4493 | 23735 |
| TTCN_2027 | 13549 | TTCN_4494 | 23736 |
| TTCN_2028 | 13550 | GTCN_2400 | 23737 |
| GTCN_1080 | 13551 | CTCN_4244 | 23738 |
| GTCN_1081 | 13552 | GTCN_2401 | 23739 |
| TTCN_2029 | 13553 | TTCN_4495 | 23740 |
| TTCN_2030 | 13554 | ATCN_2789 | 23741 |
| GTCN_1082 | 13555 | ATCN_2790 | 23742 |
| CTCN_1694 | 13556 | ATCN_2791 | 23743 |
| CTCN_1695 | 13557 | ATCN_2792 | 23744 |
| GTCN_1083 | 13558 | ATCN_2793 | 23745 |
| ATCN_1242 | 13559 | TTCN_4496 | 23746 |
| CTCN_1696 | 13560 | CTCN_4245 | 23747 |
| GTCN_1084 | 13561 | TTCN_4497 | 23748 |
| CTCN_1697 | 13562 | CTCN_4246 | 23749 |
| CTCN_1698 | 13563 | GTCN_2402 | 23750 |
| ATCN_1243 | 13564 | CTCN_4247 | 23751 |
| CTCN_1699 | 13565 | CTCN_4248 | 23752 |
| CTCN_1700 | 13566 | TTCN_4498 | 23753 |
| GTCN_1085 | 13567 | CTCN_4249 | 23754 |
| CTCN_1701 | 13568 | CTCN_4250 | 23755 |
| GTCN_1086 | 13569 | CTCN_4251 | 23756 |
| CTCN_1702 | 13570 | TTCN_4499 | 23757 |
| TTCN_2031 | 13571 | ATCN_2794 | 23758 |

FIG. 36 (continued)

| | | | |
|---|---|---|---|
| ATCN_1244 | 13572 | TTCN_4500 | 23759 |
| GTCN_1087 | 13573 | CTCN_4252 | 23760 |
| GTCN_1088 | 13574 | CTCN_4253 | 23761 |
| GTCN_1089 | 13575 | CTCN_4254 | 23762 |
| CTCN_1703 | 13576 | ATCN_2795 | 23763 |
| TTCN_2032 | 13577 | GTCN_2403 | 23764 |
| TTCN_2033 | 13578 | CTCN_4255 | 23765 |
| ATCN_1245 | 13579 | GTCN_2404 | 23766 |
| GTCN_1090 | 13580 | CTCN_4256 | 23767 |
| GTCN_1091 | 13581 | TTCN_4501 | 23768 |
| CTCN_1704 | 13582 | GTCN_2405 | 23769 |
| TTCN_2034 | 13583 | CTCN_4257 | 23770 |
| TTCN_2035 | 13584 | CTCN_4258 | 23771 |
| GTCN_1092 | 13585 | GTCN_2406 | 23772 |
| GTCN_1093 | 13586 | CTCN_4259 | 23773 |
| CTCN_1705 | 13587 | ATCN_2796 | 23774 |
| ATCN_1246 | 13588 | ATCN_2797 | 23775 |
| CTCN_1706 | 13589 | CTCN_4260 | 23776 |
| CTCN_1707 | 13590 | CTCN_4261 | 23777 |
| CTCN_1708 | 13591 | ATCN_2798 | 23778 |
| TTCN_2036 | 13592 | ATCN_2799 | 23779 |
| GTCN_1094 | 13593 | CTCN_4262 | 23780 |
| TTCN_2037 | 13594 | ATCN_2800 | 23781 |
| CTCN_1709 | 13595 | CTCN_4263 | 23782 |
| ATCN_1247 | 13596 | CTCN_4264 | 23783 |
| TTCN_2038 | 13597 | CTCN_4265 | 23784 |
| CTCN_1710 | 13598 | TTCN_4502 | 23785 |
| GTCN_1095 | 13599 | TTCN_4503 | 23786 |
| GTCN_1096 | 13600 | CTCN_4266 | 23787 |
| ATCN_1248 | 13601 | ATCN_2801 | 23788 |
| TTCN_2039 | 13602 | CTCN_4267 | 23789 |
| GTCN_1097 | 13603 | TTCN_4504 | 23790 |
| TTCN_2040 | 13604 | ATCN_2802 | 23791 |
| GTCN_1098 | 13605 | CTCN_4268 | 23792 |
| TTCN_2041 | 13606 | TTCN_4505 | 23793 |
| ATCN_1249 | 13607 | TTCN_4506 | 23794 |
| TTCN_2042 | 13608 | TTCN_4507 | 23795 |
| GTCN_1099 | 13609 | ATCN_2803 | 23796 |
| TTCN_2043 | 13610 | TTCN_4508 | 23797 |
| GTCN_1100 | 13611 | TTCN_4509 | 23798 |
| ATCN_1250 | 13612 | CTCN_4269 | 23799 |
| CTCN_1711 | 13613 | CTCN_4270 | 23800 |
| ATCN_1251 | 13614 | ATCN_2804 | 23801 |
| ATCN_1252 | 13615 | TTCN_4510 | 23802 |
| GTCN_1101 | 13616 | TTCN_4511 | 23803 |
| TTCN_2044 | 13617 | TTCN_4512 | 23804 |
| TTCN_2045 | 13618 | TTCN_4513 | 23805 |
| CTCN_1712 | 13619 | GTCN_2407 | 23806 |
| ATCN_1253 | 13620 | CTCN_4271 | 23807 |
| GTCN_1102 | 13621 | TTCN_4514 | 23808 |
| CTCN_1713 | 13622 | CTCN_4272 | 23809 |
| TTCN_2046 | 13623 | CTCN_4273 | 23810 |
| ATCN_1254 | 13624 | GTCN_2408 | 23811 |
| CTCN_1714 | 13625 | TTCN_4515 | 23812 |
| TTCN_2047 | 13626 | ATCN_2805 | 23813 |

| | | | |
|---|---|---|---|
| GTCN_1103 | 13627 | ATCN_2806 | 23814 |
| TTCN_2048 | 13628 | TTCN_4516 | 23815 |
| CTCN_1715 | 13629 | ATCN_2807 | 23816 |
| TTCN_2049 | 13630 | CTCN_4274 | 23817 |
| ATCN_1255 | 13631 | CTCN_4275 | 23818 |
| TTCN_2050 | 13632 | TTCN_4517 | 23819 |
| CTCN_1716 | 13633 | GTCN_2409 | 23820 |
| TTCN_2051 | 13634 | TTCN_4518 | 23821 |
| TTCN_2052 | 13635 | ATCN_2808 | 23822 |
| TTCN_2053 | 13636 | TTCN_4519 | 23823 |
| TTCN_2054 | 13637 | TTCN_4520 | 23824 |
| GTCN_1104 | 13638 | CTCN_4276 | 23825 |
| TTCN_2055 | 13639 | CTCN_4277 | 23826 |
| ATCN_1256 | 13640 | TTCN_4521 | 23827 |
| CTCN_1717 | 13641 | TTCN_4522 | 23828 |
| CTCN_1718 | 13642 | CTCN_4278 | 23829 |
| GTCN_1105 | 13643 | TTCN_4523 | 23830 |
| GTCN_1106 | 13644 | CTCN_4279 | 23831 |
| TTCN_2056 | 13645 | CTCN_4280 | 23832 |
| TTCN_2057 | 13646 | CTCN_4281 | 23833 |
| TTCN_2058 | 13647 | GTCN_2410 | 23834 |
| CTCN_1719 | 13648 | TTCN_4524 | 23835 |
| TTCN_2059 | 13649 | TTCN_4525 | 23836 |
| CTCN_1720 | 13650 | ATCN_2809 | 23837 |
| GTCN_1107 | 13651 | ATCN_2810 | 23838 |
| CTCN_1721 | 13652 | CTCN_4282 | 23839 |
| CTCN_1722 | 13653 | TTCN_4526 | 23840 |
| ATCN_1257 | 13654 | ATCN_2811 | 23841 |
| TTCN_2060 | 13655 | ATCN_2812 | 23842 |
| CTCN_1723 | 13656 | CTCN_4283 | 23843 |
| CTCN_1724 | 13657 | CTCN_4284 | 23844 |
| TTCN_2061 | 13658 | TTCN_4527 | 23845 |
| GTCN_1108 | 13659 | ATCN_2813 | 23846 |
| CTCN_1725 | 13660 | ATCN_2814 | 23847 |
| GTCN_1109 | 13661 | ATCN_2815 | 23848 |
| CTCN_1726 | 13662 | CTCN_4285 | 23849 |
| TTCN_2062 | 13663 | ATCN_2816 | 23850 |
| CTCN_1727 | 13664 | TTCN_4528 | 23851 |
| TTCN_2063 | 13665 | CTCN_4286 | 23852 |
| CTCN_1728 | 13666 | GTCN_2411 | 23853 |
| TTCN_2064 | 13667 | GTCN_2412 | 23854 |
| ATCN_1258 | 13668 | TTCN_4529 | 23855 |
| ATCN_1259 | 13669 | CTCN_4287 | 23856 |
| ATCN_1260 | 13670 | GTCN_2413 | 23857 |
| GTCN_1110 | 13671 | GTCN_2414 | 23858 |
| CTCN_1729 | 13672 | GTCN_2415 | 23859 |
| TTCN_2065 | 13673 | TTCN_4530 | 23860 |
| TTCN_2066 | 13674 | CTCN_4288 | 23861 |
| TTCN_2067 | 13675 | CTCN_4289 | 23862 |
| CTCN_1730 | 13676 | CTCN_4290 | 23863 |
| TTCN_2068 | 13677 | GTCN_2416 | 23864 |
| TTCN_2069 | 13678 | TTCN_4531 | 23865 |
| CTCN_1731 | 13679 | CTCN_4291 | 23866 |
| GTCN_1111 | 13680 | ATCN_2817 | 23867 |
| CTCN_1732 | 13681 | GTCN_2417 | 23868 |

FIG. 36 (continued)

| | | | |
|---|---|---|---|
| ATCN_1261 | 13682 | TTCN_4532 | 23869 |
| TTCN_2070 | 13683 | TTCN_4533 | 23870 |
| CTCN_1733 | 13684 | ATCN_2818 | 23871 |
| CTCN_1734 | 13685 | ATCN_2819 | 23872 |
| TTCN_2071 | 13686 | CTCN_4292 | 23873 |
| CTCN_1735 | 13687 | CTCN_4293 | 23874 |
| ATCN_1262 | 13688 | TTCN_4534 | 23875 |
| ATCN_1263 | 13689 | ATCN_2820 | 23876 |
| TTCN_2072 | 13690 | TTCN_4535 | 23877 |
| TTCN_2073 | 13691 | GTCN_2418 | 23878 |
| CTCN_1736 | 13692 | TTCN_4536 | 23879 |
| TTCN_2074 | 13693 | GTCN_2419 | 23880 |
| TTCN_2075 | 13694 | CTCN_4294 | 23881 |
| ATCN_1264 | 13695 | ATCN_2821 | 23882 |
| GTCN_1112 | 13696 | TTCN_4537 | 23883 |
| GTCN_1113 | 13697 | TTCN_4538 | 23884 |
| TTCN_2076 | 13698 | TTCN_4539 | 23885 |
| TTCN_2077 | 13699 | TTCN_4540 | 23886 |
| CTCN_1737 | 13700 | ATCN_2822 | 23887 |
| CTCN_1738 | 13701 | CTCN_4295 | 23888 |
| CTCN_1739 | 13702 | ATCN_2823 | 23889 |
| TTCN_2078 | 13703 | TTCN_4541 | 23890 |
| TTCN_2079 | 13704 | GTCN_2420 | 23891 |
| GTCN_1114 | 13705 | GTCN_2421 | 23892 |
| ATCN_1265 | 13706 | TTCN_4542 | 23893 |
| GTCN_1115 | 13707 | TTCN_4543 | 23894 |
| ATCN_1266 | 13708 | CTCN_4296 | 23895 |
| CTCN_1740 | 13709 | ATCN_2824 | 23896 |
| CTCN_1741 | 13710 | TTCN_4544 | 23897 |
| CTCN_1742 | 13711 | TTCN_4545 | 23898 |
| CTCN_1743 | 13712 | CTCN_4297 | 23899 |
| TTCN_2080 | 13713 | TTCN_4546 | 23900 |
| CTCN_1744 | 13714 | CTCN_4298 | 23901 |
| ATCN_1267 | 13715 | GTCN_2422 | 23902 |
| CTCN_1745 | 13716 | TTCN_4547 | 23903 |
| CTCN_1746 | 13717 | TTCN_4548 | 23904 |
| CTCN_1747 | 13718 | TTCN_4549 | 23905 |
| ATCN_1268 | 13719 | TTCN_4550 | 23906 |
| CTCN_1748 | 13720 | CTCN_4299 | 23907 |
| GTCN_1116 | 13721 | GTCN_2423 | 23908 |
| ATCN_1269 | 13722 | ATCN_2825 | 23909 |
| CTCN_1749 | 13723 | TTCN_4551 | 23910 |
| ATCN_1270 | 13724 | TTCN_4552 | 23911 |
| GTCN_1117 | 13725 | CTCN_4300 | 23912 |
| TTCN_2081 | 13726 | ATCN_2826 | 23913 |
| TTCN_2082 | 13727 | ATCN_2827 | 23914 |
| TTCN_2083 | 13728 | GTCN_2424 | 23915 |
| CTCN_1750 | 13729 | TTCN_4553 | 23916 |
| TTCN_2084 | 13730 | CTCN_4301 | 23917 |
| GTCN_1118 | 13731 | TTCN_4554 | 23918 |
| CTCN_1751 | 13732 | TTCN_4555 | 23919 |
| CTCN_1752 | 13733 | GTCN_2425 | 23920 |
| TTCN_2085 | 13734 | TTCN_4556 | 23921 |
| TTCN_2086 | 13735 | ATCN_2828 | 23922 |
| GTCN_1119 | 13736 | ATCN_2829 | 23923 |

| | | | |
|---|---|---|---|
| TTCN_2087 | 13737 | ATCN_2830 | 23924 |
| TTCN_2088 | 13738 | GTCN_2426 | 23925 |
| TTCN_2089 | 13739 | GTCN_2427 | 23926 |
| TTCN_2090 | 13740 | ATCN_2831 | 23927 |
| GTCN_1120 | 13741 | CTCN_4302 | 23928 |
| CTCN_1753 | 13742 | ATCN_2832 | 23929 |
| TTCN_2091 | 13743 | ATCN_2833 | 23930 |
| CTCN_1754 | 13744 | ATCN_2834 | 23931 |
| TTCN_2092 | 13745 | TTCN_4557 | 23932 |
| ATCN_1271 | 13746 | ATCN_2835 | 23933 |
| CTCN_1755 | 13747 | GTCN_2428 | 23934 |
| TTCN_2093 | 13748 | CTCN_4303 | 23935 |
| TTCN_2094 | 13749 | TTCN_4558 | 23936 |
| ATCN_1272 | 13750 | ATCN_2836 | 23937 |
| ATCN_1273 | 13751 | CTCN_4304 | 23938 |
| CTCN_1756 | 13752 | CTCN_4305 | 23939 |
| GTCN_1121 | 13753 | TTCN_4559 | 23940 |
| CTCN_1757 | 13754 | CTCN_4306 | 23941 |
| CTCN_1758 | 13755 | TTCN_4560 | 23942 |
| ATCN_1274 | 13756 | TTCN_4561 | 23943 |
| CTCN_1759 | 13757 | ATCN_2837 | 23944 |
| TTCN_2095 | 13758 | TTCN_4562 | 23945 |
| ATCN_1275 | 13759 | TTCN_4563 | 23946 |
| TTCN_2096 | 13760 | TTCN_4564 | 23947 |
| GTCN_1122 | 13761 | GTCN_2429 | 23948 |
| TTCN_2097 | 13762 | GTCN_2430 | 23949 |
| CTCN_1760 | 13763 | CTCN_4307 | 23950 |
| CTCN_1761 | 13764 | ATCN_2838 | 23951 |
| GTCN_1123 | 13765 | TTCN_4565 | 23952 |
| CTCN_1762 | 13766 | ATCN_2839 | 23953 |
| ATCN_1276 | 13767 | ATCN_2840 | 23954 |
| TTCN_2098 | 13768 | GTCN_2431 | 23955 |
| TTCN_2099 | 13769 | TTCN_4566 | 23956 |
| TTCN_2100 | 13770 | TTCN_4567 | 23957 |
| CTCN_1763 | 13771 | GTCN_2432 | 23958 |
| CTCN_1764 | 13772 | CTCN_4308 | 23959 |
| GTCN_1124 | 13773 | ATCN_2841 | 23960 |
| CTCN_1765 | 13774 | ATCN_2842 | 23961 |
| TTCN_2101 | 13775 | GTCN_2433 | 23962 |
| TTCN_2102 | 13776 | ATCN_2843 | 23963 |
| ATCN_1277 | 13777 | TTCN_4568 | 23964 |
| TTCN_2103 | 13778 | CTCN_4309 | 23965 |
| CTCN_1766 | 13779 | TTCN_4569 | 23966 |
| TTCN_2104 | 13780 | ATCN_2844 | 23967 |
| TTCN_2105 | 13781 | GTCN_2434 | 23968 |
| CTCN_1767 | 13782 | GTCN_2435 | 23969 |
| CTCN_1768 | 13783 | ATCN_2845 | 23970 |
| GTCN_1125 | 13784 | ATCN_2846 | 23971 |
| CTCN_1769 | 13785 | ATCN_2847 | 23972 |
| TTCN_2106 | 13786 | TTCN_4570 | 23973 |
| TTCN_2107 | 13787 | GTCN_2436 | 23974 |
| TTCN_2108 | 13788 | CTCN_4310 | 23975 |
| GTCN_1126 | 13789 | CTCN_4311 | 23976 |
| CTCN_1770 | 13790 | CTCN_4312 | 23977 |
| CTCN_1771 | 13791 | CTCN_4313 | 23978 |

FIG. 36 (continued)

| | | | |
|---|---|---|---|
| ATCN_1278 | 13792 | TTCN_4571 | 23979 |
| TTCN_2109 | 13793 | ATCN_2848 | 23980 |
| CTCN_1772 | 13794 | TTCN_4572 | 23981 |
| TTCN_2110 | 13795 | TTCN_4573 | 23982 |
| ATCN_1279 | 13796 | GTCN_2437 | 23983 |
| GTCN_1127 | 13797 | ATCN_2849 | 23984 |
| ATCN_1280 | 13798 | CTCN_4314 | 23985 |
| TTCN_2111 | 13799 | TTCN_4574 | 23986 |
| CTCN_1773 | 13800 | ATCN_2850 | 23987 |
| ATCN_1281 | 13801 | CTCN_4315 | 23988 |
| ATCN_1282 | 13802 | CTCN_4316 | 23989 |
| TTCN_2112 | 13803 | CTCN_4317 | 23990 |
| TTCN_2113 | 13804 | ATCN_2851 | 23991 |
| GTCN_1128 | 13805 | TTCN_4575 | 23992 |
| TTCN_2114 | 13806 | ATCN_2852 | 23993 |
| TTCN_2115 | 13807 | TTCN_4576 | 23994 |
| CTCN_1774 | 13808 | ATCN_2853 | 23995 |
| ATCN_1283 | 13809 | ATCN_2854 | 23996 |
| CTCN_1775 | 13810 | TTCN_4577 | 23997 |
| GTCN_1129 | 13811 | CTCN_4318 | 23998 |
| CTCN_1776 | 13812 | TTCN_4578 | 23999 |
| ATCN_1284 | 13813 | ATCN_2855 | 24000 |
| CTCN_1777 | 13814 | TTCN_4579 | 24001 |
| GTCN_1130 | 13815 | GTCN_2438 | 24002 |
| ATCN_1285 | 13816 | CTCN_4319 | 24003 |
| CTCN_1778 | 13817 | GTCN_2439 | 24004 |
| TTCN_2116 | 13818 | TTCN_4580 | 24005 |
| TTCN_2117 | 13819 | CTCN_4320 | 24006 |
| CTCN_1779 | 13820 | TTCN_4581 | 24007 |
| CTCN_1780 | 13821 | TTCN_4582 | 24008 |
| ATCN_1286 | 13822 | ATCN_2856 | 24009 |
| CTCN_1781 | 13823 | TTCN_4583 | 24010 |
| ATCN_1287 | 13824 | ATCN_2857 | 24011 |
| CTCN_1782 | 13825 | TTCN_4584 | 24012 |
| TTCN_2118 | 13826 | ATCN_2858 | 24013 |
| GTCN_1131 | 13827 | GTCN_2440 | 24014 |
| CTCN_1783 | 13828 | TTCN_4585 | 24015 |
| ATCN_1288 | 13829 | GTCN_2441 | 24016 |
| TTCN_2119 | 13830 | TTCN_4586 | 24017 |
| TTCN_2120 | 13831 | TTCN_4587 | 24018 |
| TTCN_2121 | 13832 | ATCN_2859 | 24019 |
| CTCN_1784 | 13833 | TTCN_4588 | 24020 |
| TTCN_2122 | 13834 | TTCN_4589 | 24021 |
| ATCN_1289 | 13835 | TTCN_4590 | 24022 |
| ATCN_1290 | 13836 | CTCN_4321 | 24023 |
| CTCN_1785 | 13837 | TTCN_4591 | 24024 |
| TTCN_2123 | 13838 | ATCN_2860 | 24025 |
| GTCN_1132 | 13839 | ATCN_2861 | 24026 |
| CTCN_1786 | 13840 | TTCN_4592 | 24027 |
| TTCN_2124 | 13841 | TTCN_4593 | 24028 |
| TTCN_2125 | 13842 | ATCN_2862 | 24029 |
| ATCN_1291 | 13843 | TTCN_4594 | 24030 |
| ATCN_1292 | 13844 | TTCN_4595 | 24031 |
| CTCN_1787 | 13845 | ATCN_2863 | 24032 |
| TTCN_2126 | 13846 | ATCN_2864 | 24033 |

| | | | |
|---|---|---|---|
| GTCN_1133 | 13847 | CTCN_4322 | 24034 |
| GTCN_1134 | 13848 | GTCN_2442 | 24035 |
| GTCN_1135 | 13849 | TTCN_4596 | 24036 |
| ATCN_1293 | 13850 | GTCN_2443 | 24037 |
| GTCN_1136 | 13851 | CTCN_4323 | 24038 |
| GTCN_1137 | 13852 | ATCN_2865 | 24039 |
| TTCN_2127 | 13853 | GTCN_2444 | 24040 |
| GTCN_1138 | 13854 | GTCN_2445 | 24041 |
| TTCN_2128 | 13855 | TTCN_4597 | 24042 |
| TTCN_2129 | 13856 | GTCN_2446 | 24043 |
| TTCN_2130 | 13857 | ATCN_2866 | 24044 |
| TTCN_2131 | 13858 | CTCN_4324 | 24045 |
| ATCN_1294 | 13859 | GTCN_2447 | 24046 |
| GTCN_1139 | 13860 | CTCN_4325 | 24047 |
| CTCN_1788 | 13861 | TTCN_4598 | 24048 |
| TTCN_2132 | 13862 | TTCN_4599 | 24049 |
| ATCN_1295 | 13863 | TTCN_4600 | 24050 |
| CTCN_1789 | 13864 | ATCN_2867 | 24051 |
| TTCN_2133 | 13865 | GTCN_2448 | 24052 |
| ATCN_1296 | 13866 | GTCN_2449 | 24053 |
| ATCN_1297 | 13867 | CTCN_4326 | 24054 |
| ATCN_1298 | 13868 | CTCN_4327 | 24055 |
| ATCN_1299 | 13869 | GTCN_2450 | 24056 |
| TTCN_2134 | 13870 | CTCN_4328 | 24057 |
| CTCN_1790 | 13871 | GTCN_2451 | 24058 |
| TTCN_2135 | 13872 | CTCN_4329 | 24059 |
| CTCN_1791 | 13873 | ATCN_2868 | 24060 |
| TTCN_2136 | 13874 | TTCN_4601 | 24061 |
| CTCN_1792 | 13875 | ATCN_2869 | 24062 |
| TTCN_2137 | 13876 | ATCN_2870 | 24063 |
| CTCN_1793 | 13877 | ATCN_2871 | 24064 |
| TTCN_2138 | 13878 | ATCN_2872 | 24065 |
| CTCN_1794 | 13879 | GTCN_2452 | 24066 |
| TTCN_2139 | 13880 | ATCN_2873 | 24067 |
| CTCN_1795 | 13881 | TTCN_4602 | 24068 |
| GTCN_1140 | 13882 | CTCN_4330 | 24069 |
| TTCN_2140 | 13883 | TTCN_4603 | 24070 |
| CTCN_1796 | 13884 | TTCN_4604 | 24071 |
| CTCN_1797 | 13885 | CTCN_4331 | 24072 |
| GTCN_1141 | 13886 | CTCN_4332 | 24073 |
| GTCN_1142 | 13887 | TTCN_4605 | 24074 |
| ATCN_1300 | 13888 | CTCN_4333 | 24075 |
| GTCN_1143 | 13889 | TTCN_4606 | 24076 |
| CTCN_1798 | 13890 | CTCN_4334 | 24077 |
| CTCN_1799 | 13891 | TTCN_4607 | 24078 |
| GTCN_1144 | 13892 | CTCN_4335 | 24079 |
| GTCN_1145 | 13893 | CTCN_4336 | 24080 |
| GTCN_1146 | 13894 | ATCN_2874 | 24081 |
| ATCN_1301 | 13895 | ATCN_2875 | 24082 |
| TTCN_2141 | 13896 | TTCN_4608 | 24083 |
| GTCN_1147 | 13897 | ATCN_2876 | 24084 |
| CTCN_1800 | 13898 | ATCN_2877 | 24085 |
| ATCN_1302 | 13899 | CTCN_4337 | 24086 |
| TTCN_2142 | 13900 | GTCN_2453 | 24087 |
| TTCN_2143 | 13901 | TTCN_4609 | 24088 |

FIG. 36 (continued)

| | | | |
|---|---|---|---|
| TTCN_2144 | 13902 | ATCN_2878 | 24089 |
| GTCN_1148 | 13903 | TTCN_4610 | 24090 |
| TTCN_2145 | 13904 | TTCN_4611 | 24091 |
| CTCN_1801 | 13905 | CTCN_4338 | 24092 |
| ATCN_1303 | 13906 | TTCN_4612 | 24093 |
| ATCN_1304 | 13907 | CTCN_4339 | 24094 |
| GTCN_1149 | 13908 | ATCN_2879 | 24095 |
| CTCN_1802 | 13909 | ATCN_2880 | 24096 |
| GTCN_1150 | 13910 | ATCN_2881 | 24097 |
| TTCN_2146 | 13911 | ATCN_2882 | 24098 |
| ATCN_1305 | 13912 | CTCN_4340 | 24099 |
| ATCN_1306 | 13913 | TTCN_4613 | 24100 |
| GTCN_1151 | 13914 | TTCN_4614 | 24101 |
| ATCN_1307 | 13915 | GTCN_2454 | 24102 |
| CTCN_1803 | 13916 | CTCN_4341 | 24103 |
| TTCN_2147 | 13917 | TTCN_4615 | 24104 |
| GTCN_1152 | 13918 | GTCN_2455 | 24105 |
| TTCN_2148 | 13919 | CTCN_4342 | 24106 |
| CTCN_1804 | 13920 | CTCN_4343 | 24107 |
| TTCN_2149 | 13921 | ATCN_2883 | 24108 |
| CTCN_1805 | 13922 | CTCN_4344 | 24109 |
| TTCN_2150 | 13923 | CTCN_4345 | 24110 |
| GTCN_1153 | 13924 | TTCN_4616 | 24111 |
| TTCN_2151 | 13925 | CTCN_4346 | 24112 |
| GTCN_1154 | 13926 | CTCN_4347 | 24113 |
| ATCN_1308 | 13927 | CTCN_4348 | 24114 |
| ATCN_1309 | 13928 | ATCN_2884 | 24115 |
| CTCN_1806 | 13929 | TTCN_4617 | 24116 |
| TTCN_2152 | 13930 | ATCN_2885 | 24117 |
| CTCN_1807 | 13931 | TTCN_4618 | 24118 |
| CTCN_1808 | 13932 | GTCN_2456 | 24119 |
| CTCN_1809 | 13933 | GTCN_2457 | 24120 |
| CTCN_1810 | 13934 | TTCN_4619 | 24121 |
| GTCN_1155 | 13935 | TTCN_4620 | 24122 |
| ATCN_1310 | 13936 | CTCN_4349 | 24123 |
| GTCN_1156 | 13937 | TTCN_4621 | 24124 |
| TTCN_2153 | 13938 | TTCN_4622 | 24125 |
| CTCN_1811 | 13939 | ATCN_2886 | 24126 |
| TTCN_2154 | 13940 | ATCN_2887 | 24127 |
| TTCN_2155 | 13941 | TTCN_4623 | 24128 |
| GTCN_1157 | 13942 | CTCN_4350 | 24129 |
| ATCN_1311 | 13943 | TTCN_4624 | 24130 |
| ATCN_1312 | 13944 | ATCN_2888 | 24131 |
| TTCN_2156 | 13945 | ATCN_2889 | 24132 |
| ATCN_1313 | 13946 | ATCN_2890 | 24133 |
| CTCN_1812 | 13947 | TTCN_4625 | 24134 |
| GTCN_1158 | 13948 | ATCN_2891 | 24135 |
| CTCN_1813 | 13949 | ATCN_2892 | 24136 |
| ATCN_1314 | 13950 | TTCN_4626 | 24137 |
| CTCN_1814 | 13951 | ATCN_2893 | 24138 |
| TTCN_2157 | 13952 | GTCN_2458 | 24139 |
| GTCN_1159 | 13953 | TTCN_4627 | 24140 |
| TTCN_2158 | 13954 | CTCN_4351 | 24141 |
| TTCN_2159 | 13955 | CTCN_4352 | 24142 |
| CTCN_1815 | 13956 | GTCN_2459 | 24143 |

| | | | |
|---|---|---|---|
| TTCN_2160 | 13957 | TTCN_4628 | 24144 |
| TTCN_2161 | 13958 | TTCN_4629 | 24145 |
| GTCN_1160 | 13959 | ATCN_2894 | 24146 |
| CTCN_1816 | 13960 | ATCN_2895 | 24147 |
| TTCN_2162 | 13961 | TTCN_4630 | 24148 |
| TTCN_2163 | 13962 | ATCN_2896 | 24149 |
| CTCN_1817 | 13963 | GTCN_2460 | 24150 |
| TTCN_2164 | 13964 | GTCN_2461 | 24151 |
| ATCN_1315 | 13965 | GTCN_2462 | 24152 |
| ATCN_1316 | 13966 | TTCN_4631 | 24153 |
| GTCN_1161 | 13967 | TTCN_4632 | 24154 |
| TTCN_2165 | 13968 | ATCN_2897 | 24155 |
| CTCN_1818 | 13969 | TTCN_4633 | 24156 |
| TTCN_2166 | 13970 | TTCN_4634 | 24157 |
| ATCN_1317 | 13971 | ATCN_2898 | 24158 |
| TTCN_2167 | 13972 | CTCN_4353 | 24159 |
| CTCN_1819 | 13973 | CTCN_4354 | 24160 |
| GTCN_1162 | 13974 | ATCN_2899 | 24161 |
| ATCN_1318 | 13975 | ATCN_2900 | 24162 |
| TTCN_2168 | 13976 | GTCN_2463 | 24163 |
| TTCN_2169 | 13977 | TTCN_4635 | 24164 |
| ATCN_1319 | 13978 | ATCN_2901 | 24165 |
| TTCN_2170 | 13979 | TTCN_4636 | 24166 |
| CTCN_1820 | 13980 | GTCN_2464 | 24167 |
| TTCN_2171 | 13981 | TTCN_4637 | 24168 |
| CTCN_1821 | 13982 | TTCN_4638 | 24169 |
| CTCN_1822 | 13983 | TTCN_4639 | 24170 |
| GTCN_1163 | 13984 | GTCN_2465 | 24171 |
| CTCN_1823 | 13985 | ATCN_2902 | 24172 |
| GTCN_1164 | 13986 | ATCN_2903 | 24173 |
| TTCN_2172 | 13987 | TTCN_4640 | 24174 |
| TTCN_2173 | 13988 | ATCN_2904 | 24175 |
| CTCN_1824 | 13989 | TTCN_4641 | 24176 |
| CTCN_1825 | 13990 | TTCN_4642 | 24177 |
| TTCN_2174 | 13991 | TTCN_4643 | 24178 |
| TTCN_2175 | 13992 | CTCN_4355 | 24179 |
| TTCN_2176 | 13993 | GTCN_2466 | 24180 |
| TTCN_2177 | 13994 | ATCN_2905 | 24181 |
| GTCN_1165 | 13995 | GTCN_2467 | 24182 |
| CTCN_1826 | 13996 | CTCN_4356 | 24183 |
| TTCN_2178 | 13997 | CTCN_4357 | 24184 |
| ATCN_1320 | 13998 | TTCN_4644 | 24185 |
| CTCN_1827 | 13999 | CTCN_4358 | 24186 |
| ATCN_1321 | 14000 | TTCN_4645 | 24187 |
| CTCN_1828 | 14001 | TTCN_4646 | 24188 |
| CTCN_1829 | 14002 | ATCN_2906 | 24189 |
| TTCN_2179 | 14003 | TTCN_4647 | 24190 |
| CTCN_1830 | 14004 | ATCN_2907 | 24191 |
| GTCN_1166 | 14005 | ATCN_2908 | 24192 |
| TTCN_2180 | 14006 | CTCN_4359 | 24193 |
| ATCN_1322 | 14007 | ATCN_2909 | 24194 |
| GTCN_1167 | 14008 | TTCN_4648 | 24195 |
| CTCN_1831 | 14009 | TTCN_4649 | 24196 |
| TTCN_2181 | 14010 | CTCN_4360 | 24197 |
| ATCN_1323 | 14011 | TTCN_4650 | 24198 |

FIG. 36 (continued)

| | | | |
|---|---|---|---|
| GTCN_1168 | 14012 | ATCN_2910 | 24199 |
| GTCN_1169 | 14013 | CTCN_4361 | 24200 |
| CTCN_1832 | 14014 | TTCN_4651 | 24201 |
| GTCN_1170 | 14015 | CTCN_4362 | 24202 |
| ATCN_1324 | 14016 | ATCN_2911 | 24203 |
| TTCN_2182 | 14017 | ATCN_2912 | 24204 |
| CTCN_1833 | 14018 | TTCN_4652 | 24205 |
| ATCN_1325 | 14019 | GTCN_2468 | 24206 |
| GTCN_1171 | 14020 | CTCN_4363 | 24207 |
| ATCN_1326 | 14021 | CTCN_4364 | 24208 |
| ATCN_1327 | 14022 | TTCN_4653 | 24209 |
| ATCN_1328 | 14023 | ATCN_2913 | 24210 |
| TTCN_2183 | 14024 | TTCN_4654 | 24211 |
| GTCN_1172 | 14025 | CTCN_4365 | 24212 |
| GTCN_1173 | 14026 | TTCN_4655 | 24213 |
| TTCN_2184 | 14027 | GTCN_2469 | 24214 |
| TTCN_2185 | 14028 | TTCN_4656 | 24215 |
| CTCN_1834 | 14029 | TTCN_4657 | 24216 |
| ATCN_1329 | 14030 | ATCN_2914 | 24217 |
| TTCN_2186 | 14031 | CTCN_4366 | 24218 |
| GTCN_1174 | 14032 | ATCN_2915 | 24219 |
| CTCN_1835 | 14033 | GTCN_2470 | 24220 |
| CTCN_1836 | 14034 | TTCN_4658 | 24221 |
| TTCN_2187 | 14035 | ATCN_2916 | 24222 |
| CTCN_1837 | 14036 | GTCN_2471 | 24223 |
| CTCN_1838 | 14037 | ATCN_2917 | 24224 |
| TTCN_2188 | 14038 | TTCN_4659 | 24225 |
| TTCN_2189 | 14039 | TTCN_4660 | 24226 |
| TTCN_2190 | 14040 | TTCN_4661 | 24227 |
| GTCN_1175 | 14041 | GTCN_2472 | 24228 |
| GTCN_1176 | 14042 | CTCN_4367 | 24229 |
| CTCN_1839 | 14043 | CTCN_4368 | 24230 |
| TTCN_2191 | 14044 | TTCN_4662 | 24231 |
| CTCN_1840 | 14045 | CTCN_4369 | 24232 |
| CTCN_1841 | 14046 | CTCN_4370 | 24233 |
| GTCN_1177 | 14047 | CTCN_4371 | 24234 |
| GTCN_1178 | 14048 | TTCN_4663 | 24235 |
| CTCN_1842 | 14049 | GTCN_2473 | 24236 |
| TTCN_2192 | 14050 | TTCN_4664 | 24237 |
| CTCN_1843 | 14051 | ATCN_2918 | 24238 |
| TTCN_2193 | 14052 | TTCN_4665 | 24239 |
| CTCN_1844 | 14053 | ATCN_2919 | 24240 |
| CTCN_1845 | 14054 | CTCN_4372 | 24241 |
| TTCN_2194 | 14055 | TTCN_4666 | 24242 |
| GTCN_1179 | 14056 | GTCN_2474 | 24243 |
| CTCN_1846 | 14057 | TTCN_4667 | 24244 |
| TTCN_2195 | 14058 | CTCN_4373 | 24245 |
| CTCN_1847 | 14059 | ATCN_2920 | 24246 |
| TTCN_2196 | 14060 | CTCN_4374 | 24247 |
| ATCN_1330 | 14061 | ATCN_2921 | 24248 |
| GTCN_1180 | 14062 | GTCN_2475 | 24249 |
| GTCN_1181 | 14063 | GTCN_2476 | 24250 |
| TTCN_2197 | 14064 | GTCN_2477 | 24251 |
| TTCN_2198 | 14065 | ATCN_2922 | 24252 |
| GTCN_1182 | 14066 | ATCN_2923 | 24253 |

| | | | |
|---|---|---|---|
| TTCN_2199 | 14067 | TTCN_4668 | 24254 |
| GTCN_1183 | 14068 | GTCN_2478 | 24255 |
| CTCN_1848 | 14069 | GTCN_2479 | 24256 |
| GTCN_1184 | 14070 | TTCN_4669 | 24257 |
| CTCN_1849 | 14071 | GTCN_2480 | 24258 |
| ATCN_1331 | 14072 | CTCN_4375 | 24259 |
| CTCN_1850 | 14073 | TTCN_4670 | 24260 |
| ATCN_1332 | 14074 | GTCN_2481 | 24261 |
| TTCN_2200 | 14075 | CTCN_4376 | 24262 |
| GTCN_1185 | 14076 | ATCN_2924 | 24263 |
| CTCN_1851 | 14077 | TTCN_4671 | 24264 |
| GTCN_1186 | 14078 | ATCN_2925 | 24265 |
| CTCN_1852 | 14079 | CTCN_4377 | 24266 |
| CTCN_1853 | 14080 | ATCN_2926 | 24267 |
| TTCN_2201 | 14081 | CTCN_4378 | 24268 |
| CTCN_1854 | 14082 | TTCN_4672 | 24269 |
| ATCN_1333 | 14083 | ATCN_2927 | 24270 |
| TTCN_2202 | 14084 | GTCN_2482 | 24271 |
| CTCN_1855 | 14085 | TTCN_4673 | 24272 |
| CTCN_1856 | 14086 | TTCN_4674 | 24273 |
| ATCN_1334 | 14087 | TTCN_4675 | 24274 |
| TTCN_2203 | 14088 | CTCN_4379 | 24275 |
| ATCN_1335 | 14089 | ATCN_2928 | 24276 |
| ATCN_1336 | 14090 | CTCN_4380 | 24277 |
| ATCN_1337 | 14091 | CTCN_4381 | 24278 |
| CTCN_1857 | 14092 | CTCN_4382 | 24279 |
| CTCN_1858 | 14093 | CTCN_4383 | 24280 |
| TTCN_2204 | 14094 | TTCN_4676 | 24281 |
| TTCN_2205 | 14095 | CTCN_4384 | 24282 |
| ATCN_1338 | 14096 | ATCN_2929 | 24283 |
| CTCN_1859 | 14097 | CTCN_4385 | 24284 |
| CTCN_1860 | 14098 | GTCN_2483 | 24285 |
| ATCN_1339 | 14099 | CTCN_4386 | 24286 |
| GTCN_1187 | 14100 | CTCN_4387 | 24287 |
| CTCN_1861 | 14101 | GTCN_2484 | 24288 |
| TTCN_2206 | 14102 | GTCN_2485 | 24289 |
| ATCN_1340 | 14103 | CTCN_4388 | 24290 |
| CTCN_1862 | 14104 | GTCN_2486 | 24291 |
| GTCN_1188 | 14105 | TTCN_4677 | 24292 |
| CTCN_1863 | 14106 | TTCN_4678 | 24293 |
| CTCN_1864 | 14107 | GTCN_2487 | 24294 |
| CTCN_1865 | 14108 | TTCN_4679 | 24295 |
| ATCN_1341 | 14109 | CTCN_4389 | 24296 |
| CTCN_1866 | 14110 | ATCN_2930 | 24297 |
| TTCN_2207 | 14111 | CTCN_4390 | 24298 |
| CTCN_1867 | 14112 | CTCN_4391 | 24299 |
| CTCN_1868 | 14113 | GTCN_2488 | 24300 |
| TTCN_2208 | 14114 | CTCN_4392 | 24301 |
| ATCN_1342 | 14115 | TTCN_4680 | 24302 |
| TTCN_2209 | 14116 | TTCN_4681 | 24303 |
| ATCN_1343 | 14117 | TTCN_4682 | 24304 |
| GTCN_1189 | 14118 | CTCN_4393 | 24305 |
| CTCN_1869 | 14119 | CTCN_4394 | 24306 |
| TTCN_2210 | 14120 | GTCN_2489 | 24307 |
| CTCN_1870 | 14121 | TTCN_4683 | 24308 |

FIG. 36 (continued)

| | | | |
|---|---|---|---|
| ATCN_1344 | 14122 | CTCN_4395 | 24309 |
| ATCN_1345 | 14123 | CTCN_4396 | 24310 |
| GTCN_1190 | 14124 | TTCN_4684 | 24311 |
| TTCN_2211 | 14125 | TTCN_4685 | 24312 |
| ATCN_1346 | 14126 | TTCN_4686 | 24313 |
| TTCN_2212 | 14127 | TTCN_4687 | 24314 |
| TTCN_2213 | 14128 | TTCN_4688 | 24315 |
| TTCN_2214 | 14129 | TTCN_4689 | 24316 |
| TTCN_2215 | 14130 | CTCN_4397 | 24317 |
| GTCN_1191 | 14131 | GTCN_2490 | 24318 |
| TTCN_2216 | 14132 | GTCN_2491 | 24319 |
| TTCN_2217 | 14133 | CTCN_4398 | 24320 |
| ATCN_1347 | 14134 | TTCN_4690 | 24321 |
| CTCN_1871 | 14135 | TTCN_4691 | 24322 |
| CTCN_1872 | 14136 | TTCN_4692 | 24323 |
| TTCN_2218 | 14137 | TTCN_4693 | 24324 |
| CTCN_1873 | 14138 | TTCN_4694 | 24325 |
| ATCN_1348 | 14139 | TTCN_4695 | 24326 |
| GTCN_1192 | 14140 | ATCN_2931 | 24327 |
| TTCN_2219 | 14141 | TTCN_4696 | 24328 |
| CTCN_1874 | 14142 | TTCN_4697 | 24329 |
| ATCN_1349 | 14143 | ATCN_2932 | 24330 |
| CTCN_1875 | 14144 | TTCN_4698 | 24331 |
| TTCN_2220 | 14145 | ATCN_2933 | 24332 |
| TTCN_2221 | 14146 | ATCN_2934 | 24333 |
| CTCN_1876 | 14147 | GTCN_2492 | 24334 |
| ATCN_1350 | 14148 | ATCN_2935 | 24335 |
| TTCN_2222 | 14149 | TTCN_4699 | 24336 |
| ATCN_1351 | 14150 | ATCN_2936 | 24337 |
| TTCN_2223 | 14151 | ATCN_2937 | 24338 |
| TTCN_2224 | 14152 | CTCN_4399 | 24339 |
| TTCN_2225 | 14153 | CTCN_4400 | 24340 |
| GTCN_1193 | 14154 | TTCN_4700 | 24341 |
| CTCN_1877 | 14155 | TTCN_4701 | 24342 |
| TTCN_2226 | 14156 | GTCN_2493 | 24343 |
| TTCN_2227 | 14157 | TTCN_4702 | 24344 |
| TTCN_2228 | 14158 | CTCN_4401 | 24345 |
| TTCN_2229 | 14159 | TTCN_4703 | 24346 |
| CTCN_1878 | 14160 | TTCN_4704 | 24347 |
| TTCN_2230 | 14161 | TTCN_4705 | 24348 |
| ATCN_1352 | 14162 | ATCN_2938 | 24349 |
| TTCN_2231 | 14163 | ATCN_2939 | 24350 |
| TTCN_2232 | 14164 | TTCN_4706 | 24351 |
| TTCN_2233 | 14165 | TTCN_4707 | 24352 |
| CTCN_1879 | 14166 | CTCN_4402 | 24353 |
| GTCN_1194 | 14167 | TTCN_4708 | 24354 |
| TTCN_2234 | 14168 | CTCN_4403 | 24355 |
| GTCN_1195 | 14169 | ATCN_2940 | 24356 |
| TTCN_2235 | 14170 | TTCN_4709 | 24357 |
| ATCN_1353 | 14171 | TTCN_4710 | 24358 |
| TTCN_2236 | 14172 | TTCN_4711 | 24359 |
| ATCN_1354 | 14173 | CTCN_4404 | 24360 |
| ATCN_1355 | 14174 | TTCN_4712 | 24361 |
| ATCN_1356 | 14175 | TTCN_4713 | 24362 |
| ATCN_1357 | 14176 | TTCN_4714 | 24363 |

| | | | |
|---|---|---|---|
| TTCN_2237 | 14177 | TTCN_4715 | 24364 |
| TTCN_2238 | 14178 | CTCN_4405 | 24365 |
| TTCN_2239 | 14179 | TTCN_4716 | 24366 |
| TTCN_2240 | 14180 | ATCN_2941 | 24367 |
| TTCN_2241 | 14181 | CTCN_4406 | 24368 |
| TTCN_2242 | 14182 | TTCN_4717 | 24369 |
| TTCN_2243 | 14183 | GTCN_2494 | 24370 |
| CTCN_1880 | 14184 | GTCN_2495 | 24371 |
| GTCN_1196 | 14185 | TTCN_4718 | 24372 |
| TTCN_2244 | 14186 | GTCN_2496 | 24373 |
| TTCN_2245 | 14187 | CTCN_4407 | 24374 |
| TTCN_2246 | 14188 | CTCN_4408 | 24375 |
| TTCN_2247 | 14189 | TTCN_4719 | 24376 |
| GTCN_1197 | 14190 | CTCN_4409 | 24377 |
| GTCN_1198 | 14191 | CTCN_4410 | 24378 |
| TTCN_2248 | 14192 | TTCN_4720 | 24379 |
| ATCN_1358 | 14193 | GTCN_2497 | 24380 |
| ATCN_1359 | 14194 | GTCN_2498 | 24381 |
| CTCN_1881 | 14195 | CTCN_4411 | 24382 |
| TTCN_2249 | 14196 | ATCN_2942 | 24383 |
| GTCN_1199 | 14197 | CTCN_4412 | 24384 |
| ATCN_1360 | 14198 | CTCN_4413 | 24385 |
| TTCN_2250 | 14199 | GTCN_2499 | 24386 |
| CTCN_1882 | 14200 | TTCN_4721 | 24387 |
| CTCN_1883 | 14201 | TTCN_4722 | 24388 |
| ATCN_1361 | 14202 | TTCN_4723 | 24389 |
| ATCN_1362 | 14203 | CTCN_4414 | 24390 |
| CTCN_1884 | 14204 | CTCN_4415 | 24391 |
| GTCN_1200 | 14205 | TTCN_4724 | 24392 |
| CTCN_1885 | 14206 | GTCN_2500 | 24393 |
| TTCN_2251 | 14207 | TTCN_4725 | 24394 |
| GTCN_1201 | 14208 | TTCN_4726 | 24395 |
| TTCN_2252 | 14209 | TTCN_4727 | 24396 |
| GTCN_1202 | 14210 | GTCN_2501 | 24397 |
| CTCN_1886 | 14211 | GTCN_2502 | 24398 |
| ATCN_1363 | 14212 | CTCN_4416 | 24399 |
| ATCN_1364 | 14213 | CTCN_4417 | 24400 |
| TTCN_2253 | 14214 | CTCN_4418 | 24401 |
| TTCN_2254 | 14215 | GTCN_2503 | 24402 |
| CTCN_1887 | 14216 | ATCN_2943 | 24403 |
| GTCN_1203 | 14217 | ATCN_2944 | 24404 |
| CTCN_1888 | 14218 | GTCN_2504 | 24405 |
| GTCN_1204 | 14219 | ATCN_2945 | 24406 |
| CTCN_1889 | 14220 | TTCN_4728 | 24407 |
| CTCN_1890 | 14221 | ATCN_2946 | 24408 |
| GTCN_1205 | 14222 | GTCN_2505 | 24409 |
| CTCN_1891 | 14223 | TTCN_4729 | 24410 |
| ATCN_1365 | 14224 | CTCN_4419 | 24411 |
| ATCN_1366 | 14225 | ATCN_2947 | 24412 |
| CTCN_1892 | 14226 | TTCN_4730 | 24413 |
| CTCN_1893 | 14227 | ATCN_2948 | 24414 |
| CTCN_1894 | 14228 | TTCN_4731 | 24415 |
| CTCN_1895 | 14229 | ATCN_2949 | 24416 |
| TTCN_2255 | 14230 | TTCN_4732 | 24417 |
| TTCN_2256 | 14231 | GTCN_2506 | 24418 |

FIG. 36 (continued)

| | | | |
|---|---|---|---|
| CTCN_1896 | 14232 | ATCN_2950 | 24419 |
| CTCN_1897 | 14233 | TTCN_4733 | 24420 |
| CTCN_1898 | 14234 | GTCN_2507 | 24421 |
| GTCN_1206 | 14235 | CTCN_4420 | 24422 |
| CTCN_1899 | 14236 | CTCN_4421 | 24423 |
| GTCN_1207 | 14237 | GTCN_2508 | 24424 |
| CTCN_1900 | 14238 | TTCN_4734 | 24425 |
| GTCN_1208 | 14239 | CTCN_4422 | 24426 |
| TTCN_2257 | 14240 | GTCN_2509 | 24427 |
| ATCN_1367 | 14241 | CTCN_4423 | 24428 |
| ATCN_1368 | 14242 | ATCN_2951 | 24429 |
| ATCN_1369 | 14243 | TTCN_4735 | 24430 |
| CTCN_1901 | 14244 | TTCN_4736 | 24431 |
| ATCN_1370 | 14245 | TTCN_4737 | 24432 |
| ATCN_1371 | 14246 | CTCN_4424 | 24433 |
| CTCN_1902 | 14247 | ATCN_2952 | 24434 |
| GTCN_1209 | 14248 | CTCN_4425 | 24435 |
| CTCN_1903 | 14249 | TTCN_4738 | 24436 |
| ATCN_1372 | 14250 | TTCN_4739 | 24437 |
| ATCN_1373 | 14251 | ATCN_2953 | 24438 |
| CTCN_1904 | 14252 | TTCN_4740 | 24439 |
| CTCN_1905 | 14253 | TTCN_4741 | 24440 |
| ATCN_1374 | 14254 | TTCN_4742 | 24441 |
| CTCN_1906 | 14255 | TTCN_4743 | 24442 |
| TTCN_2258 | 14256 | GTCN_2510 | 24443 |
| TTCN_2259 | 14257 | GTCN_2511 | 24444 |
| ATCN_1375 | 14258 | CTCN_4426 | 24445 |
| TTCN_2260 | 14259 | GTCN_2512 | 24446 |
| CTCN_1907 | 14260 | GTCN_2513 | 24447 |
| TTCN_2261 | 14261 | TTCN_4744 | 24448 |
| ATCN_1376 | 14262 | ATCN_2954 | 24449 |
| GTCN_1210 | 14263 | CTCN_4427 | 24450 |
| CTCN_1908 | 14264 | CTCN_4428 | 24451 |
| ATCN_1377 | 14265 | TTCN_4745 | 24452 |
| TTCN_2262 | 14266 | TTCN_4746 | 24453 |
| CTCN_1909 | 14267 | TTCN_4747 | 24454 |
| ATCN_1378 | 14268 | CTCN_4429 | 24455 |
| CTCN_1910 | 14269 | GTCN_2514 | 24456 |
| GTCN_1211 | 14270 | ATCN_2955 | 24457 |
| CTCN_1911 | 14271 | GTCN_2515 | 24458 |
| CTCN_1912 | 14272 | CTCN_4430 | 24459 |
| GTCN_1212 | 14273 | TTCN_4748 | 24460 |
| GTCN_1213 | 14274 | CTCN_4431 | 24461 |
| ATCN_1379 | 14275 | ATCN_2956 | 24462 |
| TTCN_2263 | 14276 | ATCN_2957 | 24463 |
| ATCN_1380 | 14277 | ATCN_2958 | 24464 |
| ATCN_1381 | 14278 | GTCN_2516 | 24465 |
| CTCN_1913 | 14279 | ATCN_2959 | 24466 |
| TTCN_2264 | 14280 | TTCN_4749 | 24467 |
| GTCN_1214 | 14281 | ATCN_2960 | 24468 |
| ATCN_1382 | 14282 | GTCN_2517 | 24469 |
| ATCN_1383 | 14283 | CTCN_4432 | 24470 |
| CTCN_1914 | 14284 | TTCN_4750 | 24471 |
| CTCN_1915 | 14285 | ATCN_2961 | 24472 |
| CTCN_1916 | 14286 | ATCN_2962 | 24473 |

| | | | |
|---|---|---|---|
| ATCN_1384 | 14287 | CTCN_4433 | 24474 |
| ATCN_1385 | 14288 | CTCN_4434 | 24475 |
| TTCN_2265 | 14289 | GTCN_2518 | 24476 |
| CTCN_1917 | 14290 | TTCN_4751 | 24477 |
| CTCN_1918 | 14291 | CTCN_4435 | 24478 |
| CTCN_1919 | 14292 | TTCN_4752 | 24479 |
| CTCN_1920 | 14293 | TTCN_4753 | 24480 |
| ATCN_1386 | 14294 | TTCN_4754 | 24481 |
| ATCN_1387 | 14295 | GTCN_2519 | 24482 |
| CTCN_1921 | 14296 | CTCN_4436 | 24483 |
| GTCN_1215 | 14297 | CTCN_4437 | 24484 |
| CTCN_1922 | 14298 | CTCN_4438 | 24485 |
| CTCN_1923 | 14299 | TTCN_4755 | 24486 |
| GTCN_1216 | 14300 | TTCN_4756 | 24487 |
| CTCN_1924 | 14301 | TTCN_4757 | 24488 |
| ATCN_1388 | 14302 | CTCN_4439 | 24489 |
| CTCN_1925 | 14303 | TTCN_4758 | 24490 |
| ATCN_1389 | 14304 | ATCN_2963 | 24491 |
| TTCN_2266 | 14305 | ATCN_2964 | 24492 |
| TTCN_2267 | 14306 | TTCN_4759 | 24493 |
| TTCN_2268 | 14307 | TTCN_4760 | 24494 |
| ATCN_1390 | 14308 | CTCN_4440 | 24495 |
| TTCN_2269 | 14309 | ATCN_2965 | 24496 |
| CTCN_1926 | 14310 | TTCN_4761 | 24497 |
| CTCN_1927 | 14311 | TTCN_4762 | 24498 |
| GTCN_1217 | 14312 | ATCN_2966 | 24499 |
| TTCN_2270 | 14313 | GTCN_2520 | 24500 |
| ATCN_1391 | 14314 | TTCN_4763 | 24501 |
| CTCN_1928 | 14315 | GTCN_2521 | 24502 |
| TTCN_2271 | 14316 | CTCN_4441 | 24503 |
| CTCN_1929 | 14317 | TTCN_4764 | 24504 |
| TTCN_2272 | 14318 | TTCN_4765 | 24505 |
| TTCN_2273 | 14319 | ATCN_2967 | 24506 |
| ATCN_1392 | 14320 | ATCN_2968 | 24507 |
| ATCN_1393 | 14321 | GTCN_2522 | 24508 |
| TTCN_2274 | 14322 | TTCN_4766 | 24509 |
| TTCN_2275 | 14323 | CTCN_4442 | 24510 |
| CTCN_1930 | 14324 | ATCN_2969 | 24511 |
| CTCN_1931 | 14325 | TTCN_4767 | 24512 |
| TTCN_2276 | 14326 | GTCN_2523 | 24513 |
| CTCN_1932 | 14327 | GTCN_2524 | 24514 |
| GTCN_1218 | 14328 | TTCN_4768 | 24515 |
| ATCN_1394 | 14329 | ATCN_2970 | 24516 |
| TTCN_2277 | 14330 | TTCN_4769 | 24517 |
| ATCN_1395 | 14331 | TTCN_4770 | 24518 |
| TTCN_2278 | 14332 | ATCN_2971 | 24519 |
| ATCN_1396 | 14333 | TTCN_4771 | 24520 |
| ATCN_1397 | 14334 | ATCN_2972 | 24521 |
| CTCN_1933 | 14335 | TTCN_4772 | 24522 |
| TTCN_2279 | 14336 | CTCN_4443 | 24523 |
| CTCN_1934 | 14337 | CTCN_4444 | 24524 |
| CTCN_1935 | 14338 | TTCN_4773 | 24525 |
| GTCN_1219 | 14339 | GTCN_2525 | 24526 |
| GTCN_1220 | 14340 | TTCN_4774 | 24527 |
| GTCN_1221 | 14341 | ATCN_2973 | 24528 |

FIG. 36 (continued)

| | | | |
|---|---|---|---|
| GTCN_1222 | 14342 | ATCN_2974 | 24529 |
| GTCN_1223 | 14343 | TTCN_4775 | 24530 |
| CTCN_1936 | 14344 | CTCN_4445 | 24531 |
| GTCN_1224 | 14345 | ATCN_2975 | 24532 |
| CTCN_1937 | 14346 | TTCN_4776 | 24533 |
| ATCN_1398 | 14347 | GTCN_2526 | 24534 |
| ATCN_1399 | 14348 | GTCN_2527 | 24535 |
| TTCN_2280 | 14349 | GTCN_2528 | 24536 |
| ATCN_1400 | 14350 | GTCN_2529 | 24537 |
| GTCN_1225 | 14351 | ATCN_2976 | 24538 |
| CTCN_1938 | 14352 | GTCN_2530 | 24539 |
| TTCN_2281 | 14353 | GTCN_2531 | 24540 |
| GTCN_1226 | 14354 | ATCN_2977 | 24541 |
| GTCN_1227 | 14355 | TTCN_4777 | 24542 |
| CTCN_1939 | 14356 | GTCN_2532 | 24543 |
| CTCN_1940 | 14357 | ATCN_2978 | 24544 |
| GTCN_1228 | 14358 | ATCN_2979 | 24545 |
| CTCN_1941 | 14359 | CTCN_4446 | 24546 |
| CTCN_1942 | 14360 | GTCN_2533 | 24547 |
| TTCN_2282 | 14361 | TTCN_4778 | 24548 |
| GTCN_1229 | 14362 | TTCN_4779 | 24549 |
| TTCN_2283 | 14363 | ATCN_2980 | 24550 |
| CTCN_1943 | 14364 | CTCN_4447 | 24551 |
| TTCN_2284 | 14365 | GTCN_2534 | 24552 |
| CTCN_1944 | 14366 | TTCN_4780 | 24553 |
| CTCN_1945 | 14367 | TTCN_4781 | 24554 |
| GTCN_1230 | 14368 | GTCN_2535 | 24555 |
| GTCN_1231 | 14369 | GTCN_2536 | 24556 |
| CTCN_1946 | 14370 | GTCN_2537 | 24557 |
| GTCN_1232 | 14371 | ATCN_2981 | 24558 |
| CTCN_1947 | 14372 | ATCN_2982 | 24559 |
| CTCN_1948 | 14373 | TTCN_4782 | 24560 |
| CTCN_1949 | 14374 | TTCN_4783 | 24561 |
| GTCN_1233 | 14375 | TTCN_4784 | 24562 |
| ATCN_1401 | 14376 | TTCN_4785 | 24563 |
| TTCN_2285 | 14377 | GTCN_2538 | 24564 |
| CTCN_1950 | 14378 | ATCN_2983 | 24565 |
| ATCN_1402 | 14379 | ATCN_2984 | 24566 |
| CTCN_1951 | 14380 | CTCN_4448 | 24567 |
| TTCN_2286 | 14381 | ATCN_2985 | 24568 |
| CTCN_1952 | 14382 | TTCN_4786 | 24569 |
| CTCN_1953 | 14383 | GTCN_2539 | 24570 |
| CTCN_1954 | 14384 | ATCN_2986 | 24571 |
| CTCN_1955 | 14385 | ATCN_2987 | 24572 |
| TTCN_2287 | 14386 | CTCN_4449 | 24573 |
| TTCN_2288 | 14387 | GTCN_2540 | 24574 |
| GTCN_1234 | 14388 | TTCN_4787 | 24575 |
| CTCN_1956 | 14389 | CTCN_4450 | 24576 |
| CTCN_1957 | 14390 | GTCN_2541 | 24577 |
| GTCN_1235 | 14391 | ATCN_2988 | 24578 |
| TTCN_2289 | 14392 | TTCN_4788 | 24579 |
| TTCN_2290 | 14393 | ATCN_2989 | 24580 |
| TTCN_2291 | 14394 | TTCN_4789 | 24581 |
| TTCN_2292 | 14395 | CTCN_4451 | 24582 |
| TTCN_2293 | 14396 | TTCN_4790 | 24583 |

| | | | |
|---|---|---|---|
| CTCN_1958 | 14397 | TTCN_4791 | 24584 |
| TTCN_2294 | 14398 | TTCN_4792 | 24585 |
| GTCN_1236 | 14399 | GTCN_2542 | 24586 |
| TTCN_2295 | 14400 | CTCN_4452 | 24587 |
| ATCN_1403 | 14401 | TTCN_4793 | 24588 |
| TTCN_2296 | 14402 | TTCN_4794 | 24589 |
| GTCN_1237 | 14403 | TTCN_4795 | 24590 |
| TTCN_2297 | 14404 | GTCN_2543 | 24591 |
| ATCN_1404 | 14405 | ATCN_2990 | 24592 |
| TTCN_2298 | 14406 | CTCN_4453 | 24593 |
| TTCN_2299 | 14407 | TTCN_4796 | 24594 |
| TTCN_2300 | 14408 | ATCN_2991 | 24595 |
| GTCN_1238 | 14409 | ATCN_2992 | 24596 |
| ATCN_1405 | 14410 | TTCN_4797 | 24597 |
| GTCN_1239 | 14411 | ATCN_2993 | 24598 |
| CTCN_1959 | 14412 | TTCN_4798 | 24599 |
| CTCN_1960 | 14413 | CTCN_4454 | 24600 |
| TTCN_2301 | 14414 | CTCN_4455 | 24601 |
| TTCN_2302 | 14415 | ATCN_2994 | 24602 |
| CTCN_1961 | 14416 | TTCN_4799 | 24603 |
| TTCN_2303 | 14417 | CTCN_4456 | 24604 |
| TTCN_2304 | 14418 | CTCN_4457 | 24605 |
| GTCN_1240 | 14419 | TTCN_4800 | 24606 |
| TTCN_2305 | 14420 | CTCN_4458 | 24607 |
| TTCN_2306 | 14421 | TTCN_4801 | 24608 |
| TTCN_2307 | 14422 | TTCN_4802 | 24609 |
| ATCN_1406 | 14423 | GTCN_2544 | 24610 |
| TTCN_2308 | 14424 | CTCN_4459 | 24611 |
| CTCN_1962 | 14425 | CTCN_4460 | 24612 |
| TTCN_2309 | 14426 | GTCN_2545 | 24613 |
| ATCN_1407 | 14427 | TTCN_4803 | 24614 |
| ATCN_1408 | 14428 | GTCN_2546 | 24615 |
| CTCN_1963 | 14429 | GTCN_2547 | 24616 |
| GTCN_1241 | 14430 | TTCN_4804 | 24617 |
| CTCN_1964 | 14431 | GTCN_2548 | 24618 |
| CTCN_1965 | 14432 | CTCN_4461 | 24619 |
| TTCN_2310 | 14433 | CTCN_4462 | 24620 |
| TTCN_2311 | 14434 | CTCN_4463 | 24621 |
| CTCN_1966 | 14435 | CTCN_4464 | 24622 |
| CTCN_1967 | 14436 | TTCN_4805 | 24623 |
| TTCN_2312 | 14437 | TTCN_4806 | 24624 |
| TTCN_2313 | 14438 | TTCN_4807 | 24625 |
| TTCN_2314 | 14439 | GTCN_2549 | 24626 |
| CTCN_1968 | 14440 | GTCN_2550 | 24627 |
| TTCN_2315 | 14441 | GTCN_2551 | 24628 |
| CTCN_1969 | 14442 | GTCN_2552 | 24629 |
| TTCN_2316 | 14443 | CTCN_4465 | 24630 |
| CTCN_1970 | 14444 | GTCN_2553 | 24631 |
| GTCN_1242 | 14445 | CTCN_4466 | 24632 |
| ATCN_1409 | 14446 | CTCN_4467 | 24633 |
| CTCN_1971 | 14447 | GTCN_2554 | 24634 |
| TTCN_2317 | 14448 | GTCN_2555 | 24635 |
| TTCN_2318 | 14449 | GTCN_2556 | 24636 |
| CTCN_1972 | 14450 | ATCN_2995 | 24637 |
| CTCN_1973 | 14451 | CTCN_4468 | 24638 |

FIG. 36 (continued)

| | | | |
|---|---|---|---|
| GTCN_1243 | 14452 | GTCN_2557 | 24639 |
| TTCN_2319 | 14453 | CTCN_4469 | 24640 |
| CTCN_1974 | 14454 | CTCN_4470 | 24641 |
| CTCN_1975 | 14455 | CTCN_4471 | 24642 |
| GTCN_1244 | 14456 | GTCN_2558 | 24643 |
| GTCN_1245 | 14457 | GTCN_2559 | 24644 |
| ATCN_1410 | 14458 | ATCN_2996 | 24645 |
| ATCN_1411 | 14459 | GTCN_2560 | 24646 |
| GTCN_1246 | 14460 | CTCN_4472 | 24647 |
| CTCN_1976 | 14461 | CTCN_4473 | 24648 |
| TTCN_2320 | 14462 | TTCN_4808 | 24649 |
| TTCN_2321 | 14463 | GTCN_2561 | 24650 |
| TTCN_2322 | 14464 | ATCN_2997 | 24651 |
| TTCN_2323 | 14465 | CTCN_4474 | 24652 |
| ATCN_1412 | 14466 | GTCN_2562 | 24653 |
| ATCN_1413 | 14467 | CTCN_4475 | 24654 |
| TTCN_2324 | 14468 | TTCN_4809 | 24655 |
| GTCN_1247 | 14469 | TTCN_4810 | 24656 |
| ATCN_1414 | 14470 | TTCN_4811 | 24657 |
| ATCN_1415 | 14471 | GTCN_2563 | 24658 |
| CTCN_1977 | 14472 | CTCN_4476 | 24659 |
| TTCN_2325 | 14473 | GTCN_2564 | 24660 |
| TTCN_2326 | 14474 | CTCN_4477 | 24661 |
| CTCN_1978 | 14475 | GTCN_2565 | 24662 |
| CTCN_1979 | 14476 | CTCN_4478 | 24663 |
| TTCN_2327 | 14477 | TTCN_4812 | 24664 |
| CTCN_1980 | 14478 | CTCN_4479 | 24665 |
| TTCN_2328 | 14479 | TTCN_4813 | 24666 |
| CTCN_1981 | 14480 | GTCN_2566 | 24667 |
| ATCN_1416 | 14481 | CTCN_4480 | 24668 |
| CTCN_1982 | 14482 | TTCN_4814 | 24669 |
| GTCN_1248 | 14483 | CTCN_4481 | 24670 |
| CTCN_1983 | 14484 | CTCN_4482 | 24671 |
| CTCN_1984 | 14485 | CTCN_4483 | 24672 |
| CTCN_1985 | 14486 | CTCN_4484 | 24673 |
| TTCN_2329 | 14487 | TTCN_4815 | 24674 |
| CTCN_1986 | 14488 | TTCN_4816 | 24675 |
| CTCN_1987 | 14489 | TTCN_4817 | 24676 |
| TTCN_2330 | 14490 | TTCN_4818 | 24677 |
| TTCN_2331 | 14491 | ATCN_2998 | 24678 |
| CTCN_1988 | 14492 | CTCN_4485 | 24679 |
| TTCN_2332 | 14493 | CTCN_4486 | 24680 |
| CTCN_1989 | 14494 | TTCN_4819 | 24681 |
| CTCN_1990 | 14495 | GTCN_2567 | 24682 |
| GTCN_1249 | 14496 | TTCN_4820 | 24683 |
| TTCN_2333 | 14497 | CTCN_4487 | 24684 |
| TTCN_2334 | 14498 | ATCN_2999 | 24685 |
| CTCN_1991 | 14499 | TTCN_4821 | 24686 |
| GTCN_1250 | 14500 | ATCN_3000 | 24687 |
| TTCN_2335 | 14501 | TTCN_4822 | 24688 |
| ATCN_1417 | 14502 | CTCN_4488 | 24689 |
| ATCN_1418 | 14503 | GTCN_2568 | 24690 |
| CTCN_1992 | 14504 | TTCN_4823 | 24691 |
| ATCN_1419 | 14505 | TTCN_4824 | 24692 |
| ATCN_1420 | 14506 | CTCN_4489 | 24693 |

| | | | |
|---|---|---|---|
| ATCN_1421 | 14507 | CTCN_4490 | 24694 |
| GTCN_1251 | 14508 | CTCN_4491 | 24695 |
| ATCN_1422 | 14509 | ATCN_3001 | 24696 |
| TTCN_2336 | 14510 | CTCN_4492 | 24697 |
| ATCN_1423 | 14511 | TTCN_4825 | 24698 |
| CTCN_1993 | 14512 | TTCN_4826 | 24699 |
| CTCN_1994 | 14513 | TTCN_4827 | 24700 |
| TTCN_2337 | 14514 | ATCN_3002 | 24701 |
| TTCN_2338 | 14515 | ATCN_3003 | 24702 |
| TTCN_2339 | 14516 | TTCN_4828 | 24703 |
| CTCN_1995 | 14517 | ATCN_3004 | 24704 |
| ATCN_1424 | 14518 | TTCN_4829 | 24705 |
| ATCN_1425 | 14519 | TTCN_4830 | 24706 |
| ATCN_1426 | 14520 | CTCN_4493 | 24707 |
| CTCN_1996 | 14521 | TTCN_4831 | 24708 |
| ATCN_1427 | 14522 | TTCN_4832 | 24709 |
| ATCN_1428 | 14523 | ATCN_3005 | 24710 |
| TTCN_2340 | 14524 | CTCN_4494 | 24711 |
| TTCN_2341 | 14525 | TTCN_4833 | 24712 |
| TTCN_2342 | 14526 | TTCN_4834 | 24713 |
| CTCN_1997 | 14527 | CTCN_4495 | 24714 |
| ATCN_1429 | 14528 | GTCN_2569 | 24715 |
| ATCN_1430 | 14529 | ATCN_3006 | 24716 |
| CTCN_1998 | 14530 | ATCN_3007 | 24717 |
| TTCN_2343 | 14531 | GTCN_2570 | 24718 |
| ATCN_1431 | 14532 | ATCN_3008 | 24719 |
| TTCN_2344 | 14533 | ATCN_3009 | 24720 |
| CTCN_1999 | 14534 | ATCN_3010 | 24721 |
| CTCN_2000 | 14535 | ATCN_3011 | 24722 |
| CTCN_2001 | 14536 | CTCN_4496 | 24723 |
| CTCN_2002 | 14537 | TTCN_4835 | 24724 |
| GTCN_1252 | 14538 | CTCN_4497 | 24725 |
| GTCN_1253 | 14539 | CTCN_4498 | 24726 |
| GTCN_1254 | 14540 | CTCN_4499 | 24727 |
| CTCN_2003 | 14541 | CTCN_4500 | 24728 |
| GTCN_1255 | 14542 | TTCN_4836 | 24729 |
| CTCN_2004 | 14543 | TTCN_4837 | 24730 |
| CTCN_2005 | 14544 | CTCN_4501 | 24731 |
| ATCN_1432 | 14545 | ATCN_3012 | 24732 |
| ATCN_1433 | 14546 | TTCN_4838 | 24733 |
| TTCN_2345 | 14547 | GTCN_2571 | 24734 |
| TTCN_2346 | 14548 | TTCN_4839 | 24735 |
| TTCN_2347 | 14549 | TTCN_4840 | 24736 |
| TTCN_2348 | 14550 | CTCN_4502 | 24737 |
| GTCN_1256 | 14551 | GTCN_2572 | 24738 |
| CTCN_2006 | 14552 | GTCN_2573 | 24739 |
| GTCN_1257 | 14553 | TTCN_4841 | 24740 |
| TTCN_2349 | 14554 | TTCN_4842 | 24741 |
| ATCN_1434 | 14555 | TTCN_4843 | 24742 |
| CTCN_2007 | 14556 | TTCN_4844 | 24743 |
| CTCN_2008 | 14557 | CTCN_4503 | 24744 |
| CTCN_2009 | 14558 | TTCN_4845 | 24745 |
| CTCN_2010 | 14559 | ATCN_3013 | 24746 |
| TTCN_2350 | 14560 | TTCN_4846 | 24747 |
| ATCN_1435 | 14561 | ATCN_3014 | 24748 |

FIG. 36 (continued)

| | | | | | | | |
|---|---|---|---|---|---|---|---|
| TTCN_2351 | 14562 | TTCN_4847 | 24749 | ATCN_1450 | 14617 | TTCN_4866 | 24804 |
| ATCN_1436 | 14563 | ATCN_3015 | 24750 | TTCN_2369 | 14618 | TTCN_4867 | 24805 |
| TTCN_2352 | 14564 | ATCN_3016 | 24751 | TTCN_2370 | 14619 | GTCN_2584 | 24806 |
| CTCN_2011 | 14565 | GTCN_2574 | 24752 | TTCN_2371 | 14620 | ATCN_3028 | 24807 |
| CTCN_2012 | 14566 | TTCN_4848 | 24753 | ATCN_1451 | 14621 | TTCN_4868 | 24808 |
| GTCN_1258 | 14567 | ATCN_3017 | 24754 | GTCN_1263 | 14622 | CTCN_4517 | 24809 |
| ATCN_1437 | 14568 | TTCN_4849 | 24755 | ATCN_1452 | 14623 | TTCN_4869 | 24810 |
| ATCN_1438 | 14569 | ATCN_3018 | 24756 | TTCN_2372 | 14624 | TTCN_4870 | 24811 |
| TTCN_2353 | 14570 | TTCN_4850 | 24757 | GTCN_1264 | 14625 | CTCN_4518 | 24812 |
| CTCN_2013 | 14571 | TTCN_4851 | 24758 | CTCN_2029 | 14626 | TTCN_4871 | 24813 |
| TTCN_2354 | 14572 | GTCN_2575 | 24759 | TTCN_2373 | 14627 | ATCN_3029 | 24814 |
| TTCN_2355 | 14573 | CTCN_4504 | 24760 | GTCN_1265 | 14628 | GTCN_2585 | 24815 |
| CTCN_2014 | 14574 | ATCN_3019 | 24761 | CTCN_2030 | 14629 | ATCN_3030 | 24816 |
| CTCN_2015 | 14575 | CTCN_4505 | 24762 | CTCN_2031 | 14630 | TTCN_4872 | 24817 |
| ATCN_1439 | 14576 | GTCN_2576 | 24763 | GTCN_1266 | 14631 | ATCN_3031 | 24818 |
| ATCN_1440 | 14577 | ATCN_3020 | 24764 | CTCN_2032 | 14632 | ATCN_3032 | 24819 |
| ATCN_1441 | 14578 | TTCN_4852 | 24765 | TTCN_2374 | 14633 | GTCN_2586 | 24820 |
| CTCN_2016 | 14579 | CTCN_4506 | 24766 | ATCN_1453 | 14634 | TTCN_4873 | 24821 |
| CTCN_2017 | 14580 | GTCN_2577 | 24767 | TTCN_2375 | 14635 | ATCN_3033 | 24822 |
| CTCN_2018 | 14581 | GTCN_2578 | 24768 | TTCN_2376 | 14636 | ATCN_3034 | 24823 |
| TTCN_2356 | 14582 | GTCN_2579 | 24769 | ATCN_1454 | 14637 | CTCN_4519 | 24824 |
| GTCN_1259 | 14583 | CTCN_4507 | 24770 | ATCN_1455 | 14638 | TTCN_4874 | 24825 |
| TTCN_2357 | 14584 | TTCN_4853 | 24771 | ATCN_1456 | 14639 | TTCN_4875 | 24826 |
| ATCN_1442 | 14585 | TTCN_4854 | 24772 | GTCN_1267 | 14640 | ATCN_3035 | 24827 |
| CTCN_2019 | 14586 | TTCN_4855 | 24773 | TTCN_2377 | 14641 | GTCN_2587 | 24828 |
| TTCN_2358 | 14587 | CTCN_4508 | 24774 | CTCN_2033 | 14642 | CTCN_4520 | 24829 |
| CTCN_2020 | 14588 | TTCN_4856 | 24775 | CTCN_2034 | 14643 | CTCN_4521 | 24830 |
| CTCN_2021 | 14589 | CTCN_4509 | 24776 | TTCN_2378 | 14644 | GTCN_2588 | 24831 |
| TTCN_2359 | 14590 | ATCN_3021 | 24777 | TTCN_2379 | 14645 | CTCN_4522 | 24832 |
| GTCN_1260 | 14591 | CTCN_4510 | 24778 | CTCN_2035 | 14646 | CTCN_4523 | 24833 |
| TTCN_2360 | 14592 | ATCN_3022 | 24779 | CTCN_2036 | 14647 | ATCN_3036 | 24834 |
| TTCN_2361 | 14593 | ATCN_3023 | 24780 | TTCN_2380 | 14648 | ATCN_3037 | 24835 |
| TTCN_2362 | 14594 | GTCN_2580 | 24781 | CTCN_2037 | 14649 | TTCN_4876 | 24836 |
| TTCN_2363 | 14595 | TTCN_4857 | 24782 | TTCN_2381 | 14650 | ATCN_3038 | 24837 |
| ATCN_1443 | 14596 | CTCN_4511 | 24783 | TTCN_2382 | 14651 | TTCN_4877 | 24838 |
| TTCN_2364 | 14597 | TTCN_4858 | 24784 | CTCN_2038 | 14652 | CTCN_4524 | 24839 |
| TTCN_2365 | 14598 | CTCN_4512 | 24785 | CTCN_2039 | 14653 | TTCN_4878 | 24840 |
| TTCN_2366 | 14599 | TTCN_4859 | 24786 | CTCN_2040 | 14654 | TTCN_4879 | 24841 |
| ATCN_1444 | 14600 | ATCN_3024 | 24787 | CTCN_2041 | 14655 | TTCN_4880 | 24842 |
| GTCN_1261 | 14601 | ATCN_3025 | 24788 | ATCN_1457 | 14656 | TTCN_4881 | 24843 |
| ATCN_1445 | 14602 | CTCN_4513 | 24789 | ATCN_1458 | 14657 | GTCN_2589 | 24844 |
| ATCN_1446 | 14603 | GTCN_2581 | 24790 | GTCN_1268 | 14658 | CTCN_4525 | 24845 |
| GTCN_1262 | 14604 | CTCN_4514 | 24791 | CTCN_2042 | 14659 | ATCN_3039 | 24846 |
| CTCN_2022 | 14605 | CTCN_4515 | 24792 | CTCN_2043 | 14660 | TTCN_4882 | 24847 |
| CTCN_2023 | 14606 | ATCN_3026 | 24793 | TTCN_2383 | 14661 | TTCN_4883 | 24848 |
| CTCN_2024 | 14607 | ATCN_3027 | 24794 | TTCN_2384 | 14662 | ATCN_3040 | 24849 |
| TTCN_2367 | 14608 | TTCN_4860 | 24795 | CTCN_2044 | 14663 | TTCN_4884 | 24850 |
| CTCN_2025 | 14609 | TTCN_4861 | 24796 | CTCN_2045 | 14664 | TTCN_4885 | 24851 |
| CTCN_2026 | 14610 | GTCN_2582 | 24797 | CTCN_2046 | 14665 | ATCN_3041 | 24852 |
| ATCN_1447 | 14611 | CTCN_4516 | 24798 | GTCN_1269 | 14666 | CTCN_4526 | 24853 |
| ATCN_1448 | 14612 | TTCN_4862 | 24799 | ATCN_1459 | 14667 | ATCN_3042 | 24854 |
| CTCN_2027 | 14613 | TTCN_4863 | 24800 | ATCN_1460 | 14668 | ATCN_3043 | 24855 |
| CTCN_2028 | 14614 | TTCN_4864 | 24801 | TTCN_2385 | 14669 | CTCN_4527 | 24856 |
| ATCN_1449 | 14615 | GTCN_2583 | 24802 | TTCN_2386 | 14670 | TTCN_4886 | 24857 |
| TTCN_2368 | 14616 | TTCN_4865 | 24803 | TTCN_2387 | 14671 | CTCN_4528 | 24858 |

FIG. 36 (continued)

| | | | |
|---|---|---|---|
| GTCN_1270 | 14672 | ATCN_3044 | 24859 |
| CTCN_2047 | 14673 | GTCN_2590 | 24860 |
| CTCN_2048 | 14674 | GTCN_2591 | 24861 |
| CTCN_2049 | 14675 | TTCN_4887 | 24862 |
| CTCN_2050 | 14676 | CTCN_4529 | 24863 |
| CTCN_2051 | 14677 | CTCN_4530 | 24864 |
| ATCN_1461 | 14678 | CTCN_4531 | 24865 |
| TTCN_2388 | 14679 | TTCN_4888 | 24866 |
| GTCN_1271 | 14680 | TTCN_4889 | 24867 |
| GTCN_1272 | 14681 | ATCN_3045 | 24868 |
| TTCN_2389 | 14682 | GTCN_2592 | 24869 |
| CTCN_2052 | 14683 | TTCN_4890 | 24870 |
| TTCN_2390 | 14684 | CTCN_4532 | 24871 |
| TTCN_2391 | 14685 | TTCN_4891 | 24872 |
| TTCN_2392 | 14686 | TTCN_4892 | 24873 |
| CTCN_2053 | 14687 | TTCN_4893 | 24874 |
| GTCN_1273 | 14688 | GTCN_2593 | 24875 |
| CTCN_2054 | 14689 | TTCN_4894 | 24876 |
| TTCN_2393 | 14690 | CTCN_4533 | 24877 |
| CTCN_2055 | 14691 | ATCN_3046 | 24878 |
| CTCN_2056 | 14692 | CTCN_4534 | 24879 |
| CTCN_2057 | 14693 | GTCN_2594 | 24880 |
| TTCN_2394 | 14694 | ATCN_3047 | 24881 |
| CTCN_2058 | 14695 | ATCN_3048 | 24882 |
| ATCN_1462 | 14696 | CTCN_4535 | 24883 |
| GTCN_1274 | 14697 | TTCN_4895 | 24884 |
| ATCN_1463 | 14698 | GTCN_2595 | 24885 |
| CTCN_2059 | 14699 | CTCN_4536 | 24886 |
| ATCN_1464 | 14700 | GTCN_2596 | 24887 |
| CTCN_2060 | 14701 | ATCN_3049 | 24888 |
| CTCN_2061 | 14702 | TTCN_4896 | 24889 |
| CTCN_2062 | 14703 | ATCN_3050 | 24890 |
| CTCN_2063 | 14704 | GTCN_2597 | 24891 |
| CTCN_2064 | 14705 | TTCN_4897 | 24892 |
| TTCN_2395 | 14706 | ATCN_3051 | 24893 |
| CTCN_2065 | 14707 | CTCN_4537 | 24894 |
| CTCN_2066 | 14708 | GTCN_2598 | 24895 |
| TTCN_2396 | 14709 | CTCN_4538 | 24896 |
| CTCN_2067 | 14710 | CTCN_4539 | 24897 |
| CTCN_2068 | 14711 | ATCN_3052 | 24898 |
| TTCN_2397 | 14712 | ATCN_3053 | 24899 |
| CTCN_2069 | 14713 | CTCN_4540 | 24900 |
| GTCN_1275 | 14714 | TTCN_4898 | 24901 |
| CTCN_2070 | 14715 | TTCN_4899 | 24902 |
| TTCN_2398 | 14716 | CTCN_4541 | 24903 |
| CTCN_2071 | 14717 | CTCN_4542 | 24904 |
| CTCN_2072 | 14718 | CTCN_4543 | 24905 |
| ATCN_1465 | 14719 | CTCN_4544 | 24906 |
| CTCN_2073 | 14720 | CTCN_4545 | 24907 |
| GTCN_1276 | 14721 | CTCN_4546 | 24908 |
| TTCN_2399 | 14722 | GTCN_2599 | 24909 |
| CTCN_2074 | 14723 | TTCN_4900 | 24910 |
| TTCN_2400 | 14724 | TTCN_4901 | 24911 |
| CTCN_2075 | 14725 | TTCN_4902 | 24912 |
| GTCN_1277 | 14726 | TTCN_4903 | 24913 |

| | | | |
|---|---|---|---|
| GTCN_1278 | 14727 | CTCN_4547 | 24914 |
| ATCN_1466 | 14728 | ATCN_3054 | 24915 |
| ATCN_1467 | 14729 | TTCN_4904 | 24916 |
| TTCN_2401 | 14730 | TTCN_4905 | 24917 |
| CTCN_2076 | 14731 | TTCN_4906 | 24918 |
| CTCN_2077 | 14732 | GTCN_2600 | 24919 |
| ATCN_1468 | 14733 | GTCN_2601 | 24920 |
| CTCN_2078 | 14734 | CTCN_4548 | 24921 |
| CTCN_2079 | 14735 | ATCN_3055 | 24922 |
| TTCN_2402 | 14736 | TTCN_4907 | 24923 |
| CTCN_2080 | 14737 | TTCN_4908 | 24924 |
| CTCN_2081 | 14738 | TTCN_4909 | 24925 |
| TTCN_2403 | 14739 | CTCN_4549 | 24926 |
| ATCN_1469 | 14740 | GTCN_2602 | 24927 |
| GTCN_1279 | 14741 | TTCN_4910 | 24928 |
| TTCN_2404 | 14742 | TTCN_4911 | 24929 |
| GTCN_1280 | 14743 | CTCN_4550 | 24930 |
| GTCN_1281 | 14744 | TTCN_4912 | 24931 |
| TTCN_2405 | 14745 | GTCN_2603 | 24932 |
| ATCN_1470 | 14746 | CTCN_4551 | 24933 |
| GTCN_1282 | 14747 | CTCN_4552 | 24934 |
| CTCN_2082 | 14748 | TTCN_4913 | 24935 |
| ATCN_1471 | 14749 | CTCN_4553 | 24936 |
| TTCN_2406 | 14750 | ATCN_3056 | 24937 |
| CTCN_2083 | 14751 | GTCN_2604 | 24938 |
| GTCN_1283 | 14752 | CTCN_4554 | 24939 |
| ATCN_1472 | 14753 | CTCN_4555 | 24940 |
| CTCN_2084 | 14754 | GTCN_2605 | 24941 |
| TTCN_2407 | 14755 | TTCN_4914 | 24942 |
| GTCN_1284 | 14756 | ATCN_3057 | 24943 |
| CTCN_2085 | 14757 | TTCN_4915 | 24944 |
| CTCN_2086 | 14758 | ATCN_3058 | 24945 |
| GTCN_1285 | 14759 | TTCN_4916 | 24946 |
| GTCN_1286 | 14760 | TTCN_4917 | 24947 |
| CTCN_2087 | 14761 | GTCN_2606 | 24948 |
| CTCN_2088 | 14762 | CTCN_4556 | 24949 |
| ATCN_1473 | 14763 | ATCN_3059 | 24950 |
| CTCN_2089 | 14764 | ATCN_3060 | 24951 |
| TTCN_2408 | 14765 | CTCN_4557 | 24952 |
| TTCN_2409 | 14766 | TTCN_4918 | 24953 |
| TTCN_2410 | 14767 | CTCN_4558 | 24954 |
| CTCN_2090 | 14768 | CTCN_4559 | 24955 |
| TTCN_2411 | 14769 | CTCN_4560 | 24956 |
| TTCN_2412 | 14770 | TTCN_4919 | 24957 |
| GTCN_1287 | 14771 | ATCN_3061 | 24958 |
| CTCN_2091 | 14772 | CTCN_4561 | 24959 |
| TTCN_2413 | 14773 | TTCN_4920 | 24960 |
| TTCN_2414 | 14774 | ATCN_3062 | 24961 |
| TTCN_2415 | 14775 | CTCN_4562 | 24962 |
| TTCN_2416 | 14776 | ATCN_3063 | 24963 |
| TTCN_2417 | 14777 | CTCN_4563 | 24964 |
| ATCN_1474 | 14778 | GTCN_2607 | 24965 |
| ATCN_1475 | 14779 | ATCN_3064 | 24966 |
| CTCN_2092 | 14780 | ATCN_3065 | 24967 |
| TTCN_2418 | 14781 | CTCN_4564 | 24968 |

FIG. 36 (continued)

| | | | |
|---|---|---|---|
| CTCN_2093 | 14782 | TTCN_4921 | 24969 |
| CTCN_2094 | 14783 | TTCN_4922 | 24970 |
| GTCN_1288 | 14784 | TTCN_4923 | 24971 |
| TTCN_2419 | 14785 | ATCN_3066 | 24972 |
| CTCN_2095 | 14786 | TTCN_4924 | 24973 |
| CTCN_2096 | 14787 | ATCN_3067 | 24974 |
| GTCN_1289 | 14788 | TTCN_4925 | 24975 |
| TTCN_2420 | 14789 | CTCN_4565 | 24976 |
| CTCN_2097 | 14790 | ATCN_3068 | 24977 |
| ATCN_1476 | 14791 | CTCN_4566 | 24978 |
| CTCN_2098 | 14792 | TTCN_4926 | 24979 |
| ATCN_1477 | 14793 | TTCN_4927 | 24980 |
| ATCN_1478 | 14794 | CTCN_4567 | 24981 |
| TTCN_2421 | 14795 | ATCN_3069 | 24982 |
| GTCN_1290 | 14796 | ATCN_3070 | 24983 |
| TTCN_2422 | 14797 | ATCN_3071 | 24984 |
| CTCN_2099 | 14798 | TTCN_4928 | 24985 |
| ATCN_1479 | 14799 | TTCN_4929 | 24986 |
| TTCN_2423 | 14800 | ATCN_3072 | 24987 |
| GTCN_1291 | 14801 | TTCN_4930 | 24988 |
| GTCN_1292 | 14802 | ATCN_3073 | 24989 |
| GTCN_1293 | 14803 | TTCN_4931 | 24990 |
| TTCN_2424 | 14804 | ATCN_3074 | 24991 |
| ATCN_1480 | 14805 | CTCN_4568 | 24992 |
| ATCN_1481 | 14806 | CTCN_4569 | 24993 |
| CTCN_2100 | 14807 | TTCN_4932 | 24994 |
| CTCN_2101 | 14808 | CTCN_4570 | 24995 |
| TTCN_2425 | 14809 | TTCN_4933 | 24996 |
| CTCN_2102 | 14810 | CTCN_4571 | 24997 |
| TTCN_2426 | 14811 | GTCN_2608 | 24998 |
| CTCN_2103 | 14812 | ATCN_3075 | 24999 |
| GTCN_1294 | 14813 | ATCN_3076 | 25000 |
| CTCN_2104 | 14814 | TTCN_4934 | 25001 |
| GTCN_1295 | 14815 | TTCN_4935 | 25002 |
| CTCN_2105 | 14816 | ATCN_3077 | 25003 |
| GTCN_1296 | 14817 | CTCN_4572 | 25004 |
| CTCN_2106 | 14818 | TTCN_4936 | 25005 |
| GTCN_1297 | 14819 | ATCN_3078 | 25006 |
| TTCN_2427 | 14820 | ATCN_3079 | 25007 |
| TTCN_2428 | 14821 | GTCN_2609 | 25008 |
| ATCN_1482 | 14822 | TTCN_4937 | 25009 |
| TTCN_2429 | 14823 | TTCN_4938 | 25010 |
| CTCN_2107 | 14824 | CTCN_4573 | 25011 |
| CTCN_2108 | 14825 | GTCN_2610 | 25012 |
| CTCN_2109 | 14826 | ATCN_3080 | 25013 |
| TTCN_2430 | 14827 | ATCN_3081 | 25014 |
| TTCN_2431 | 14828 | ATCN_3082 | 25015 |
| GTCN_1298 | 14829 | TTCN_4939 | 25016 |
| CTCN_2110 | 14830 | ATCN_3083 | 25017 |
| GTCN_1299 | 14831 | GTCN_2611 | 25018 |
| CTCN_2111 | 14832 | TTCN_4940 | 25019 |
| CTCN_2112 | 14833 | CTCN_4574 | 25020 |
| GTCN_1300 | 14834 | GTCN_2612 | 25021 |
| GTCN_1301 | 14835 | GTCN_2613 | 25022 |
| TTCN_2432 | 14836 | CTCN_4575 | 25023 |

| | | | |
|---|---|---|---|
| TTCN_2433 | 14837 | CTCN_4576 | 25024 |
| ATCN_1483 | 14838 | CTCN_4577 | 25025 |
| CTCN_2113 | 14839 | GTCN_2614 | 25026 |
| TTCN_2434 | 14840 | GTCN_2615 | 25027 |
| GTCN_1302 | 14841 | CTCN_4578 | 25028 |
| TTCN_2435 | 14842 | GTCN_2616 | 25029 |
| CTCN_2114 | 14843 | ATCN_3084 | 25030 |
| TTCN_2436 | 14844 | ATCN_3085 | 25031 |
| GTCN_1303 | 14845 | ATCN_3086 | 25032 |
| CTCN_2115 | 14846 | CTCN_4579 | 25033 |
| GTCN_1304 | 14847 | CTCN_4580 | 25034 |
| ATCN_1484 | 14848 | ATCN_3087 | 25035 |
| ATCN_1485 | 14849 | GTCN_2617 | 25036 |
| ATCN_1486 | 14850 | TTCN_4941 | 25037 |
| TTCN_2437 | 14851 | CTCN_4581 | 25038 |
| CTCN_2116 | 14852 | CTCN_4582 | 25039 |
| CTCN_2117 | 14853 | TTCN_4942 | 25040 |
| CTCN_2118 | 14854 | CTCN_4583 | 25041 |
| ATCN_1487 | 14855 | CTCN_4584 | 25042 |
| TTCN_2438 | 14856 | CTCN_4585 | 25043 |
| CTCN_2119 | 14857 | CTCN_4586 | 25044 |
| ATCN_1488 | 14858 | CTCN_4587 | 25045 |
| ATCN_1489 | 14859 | CTCN_4588 | 25046 |
| TTCN_2439 | 14860 | ATCN_3088 | 25047 |
| GTCN_1305 | 14861 | ATCN_3089 | 25048 |
| CTCN_2120 | 14862 | GTCN_2618 | 25049 |
| TTCN_2440 | 14863 | GTCN_2619 | 25050 |
| CTCN_2121 | 14864 | CTCN_4589 | 25051 |
| GTCN_1306 | 14865 | TTCN_4943 | 25052 |
| TTCN_2441 | 14866 | GTCN_2620 | 25053 |
| GTCN_1307 | 14867 | TTCN_4944 | 25054 |
| CTCN_2122 | 14868 | CTCN_4590 | 25055 |
| ATCN_1490 | 14869 | TTCN_4945 | 25056 |
| CTCN_2123 | 14870 | TTCN_4946 | 25057 |
| TTCN_2442 | 14871 | GTCN_2621 | 25058 |
| CTCN_2124 | 14872 | CTCN_4591 | 25059 |
| CTCN_2125 | 14873 | CTCN_4592 | 25060 |
| TTCN_2443 | 14874 | TTCN_4947 | 25061 |
| ATCN_1491 | 14875 | CTCN_4593 | 25062 |
| TTCN_2444 | 14876 | CTCN_4594 | 25063 |
| CTCN_2126 | 14877 | CTCN_4595 | 25064 |
| CTCN_2127 | 14878 | CTCN_4596 | 25065 |
| CTCN_2128 | 14879 | GTCN_2622 | 25066 |
| ATCN_1492 | 14880 | CTCN_4597 | 25067 |
| ATCN_1493 | 14881 | ATCN_3090 | 25068 |
| CTCN_2129 | 14882 | CTCN_4598 | 25069 |
| TTCN_2445 | 14883 | ATCN_3091 | 25070 |
| TTCN_2446 | 14884 | CTCN_4599 | 25071 |
| ATCN_1494 | 14885 | TTCN_4948 | 25072 |
| CTCN_2130 | 14886 | ATCN_3092 | 25073 |
| CTCN_2131 | 14887 | ATCN_3093 | 25074 |
| CTCN_2132 | 14888 | GTCN_2623 | 25075 |
| ATCN_1495 | 14889 | TTCN_4949 | 25076 |
| CTCN_2133 | 14890 | ATCN_3094 | 25077 |
| TTCN_2447 | 14891 | ATCN_3095 | 25078 |

FIG. 36 (continued)

| | | | |
|---|---|---|---|
| TTCN_2448 | 14892 | CTCN_4600 | 25079 |
| ATCN_1496 | 14893 | TTCN_4950 | 25080 |
| ATCN_1497 | 14894 | CTCN_4601 | 25081 |
| TTCN_2449 | 14895 | TTCN_4951 | 25082 |
| CTCN_2134 | 14896 | TTCN_4952 | 25083 |
| TTCN_2450 | 14897 | GTCN_2624 | 25084 |
| CTCN_2135 | 14898 | CTCN_4602 | 25085 |
| GTCN_1308 | 14899 | CTCN_4603 | 25086 |
| ATCN_1498 | 14900 | CTCN_4604 | 25087 |
| ATCN_1499 | 14901 | TTCN_4953 | 25088 |
| GTCN_1309 | 14902 | TTCN_4954 | 25089 |
| CTCN_2136 | 14903 | TTCN_4955 | 25090 |
| CTCN_2137 | 14904 | GTCN_2625 | 25091 |
| GTCN_1310 | 14905 | ATCN_3096 | 25092 |
| GTCN_1311 | 14906 | TTCN_4956 | 25093 |
| GTCN_1312 | 14907 | GTCN_2626 | 25094 |
| CTCN_2138 | 14908 | TTCN_4957 | 25095 |
| TTCN_2451 | 14909 | GTCN_2627 | 25096 |
| ATCN_1500 | 14910 | TTCN_4958 | 25097 |
| ATCN_1501 | 14911 | TTCN_4959 | 25098 |
| GTCN_1313 | 14912 | ATCN_3097 | 25099 |
| TTCN_2452 | 14913 | GTCN_2628 | 25100 |
| GTCN_1314 | 14914 | TTCN_4960 | 25101 |
| GTCN_1315 | 14915 | CTCN_4605 | 25102 |
| TTCN_2453 | 14916 | TTCN_4961 | 25103 |
| CTCN_2139 | 14917 | GTCN_2629 | 25104 |
| CTCN_2140 | 14918 | CTCN_4606 | 25105 |
| ATCN_1502 | 14919 | TTCN_4962 | 25106 |
| GTCN_1316 | 14920 | CTCN_4607 | 25107 |
| TTCN_2454 | 14921 | GTCN_2630 | 25108 |
| TTCN_2455 | 14922 | TTCN_4963 | 25109 |
| CTCN_2141 | 14923 | CTCN_4608 | 25110 |
| TTCN_2456 | 14924 | TTCN_4964 | 25111 |
| CTCN_2142 | 14925 | TTCN_4965 | 25112 |
| TTCN_2457 | 14926 | GTCN_2631 | 25113 |
| TTCN_2458 | 14927 | TTCN_4966 | 25114 |
| ATCN_1503 | 14928 | CTCN_4609 | 25115 |
| CTCN_2143 | 14929 | GTCN_2632 | 25116 |
| ATCN_1504 | 14930 | TTCN_4967 | 25117 |
| CTCN_2144 | 14931 | TTCN_4968 | 25118 |
| ATCN_1505 | 14932 | TTCN_4969 | 25119 |
| TTCN_2459 | 14933 | TTCN_4970 | 25120 |
| CTCN_2145 | 14934 | TTCN_4971 | 25121 |
| GTCN_1317 | 14935 | CTCN_4610 | 25122 |
| TTCN_2460 | 14936 | GTCN_2633 | 25123 |
| TTCN_2461 | 14937 | CTCN_4611 | 25124 |
| GTCN_1318 | 14938 | CTCN_4612 | 25125 |
| TTCN_2462 | 14939 | CTCN_4613 | 25126 |
| CTCN_2146 | 14940 | TTCN_4972 | 25127 |
| TTCN_2463 | 14941 | CTCN_4614 | 25128 |
| CTCN_2147 | 14942 | GTCN_2634 | 25129 |
| GTCN_1319 | 14943 | ATCN_3098 | 25130 |
| GTCN_1320 | 14944 | ATCN_3099 | 25131 |
| GTCN_1321 | 14945 | ATCN_3100 | 25132 |
| TTCN_2464 | 14946 | ATCN_3101 | 25133 |

| | | | |
|---|---|---|---|
| TTCN_2465 | 14947 | GTCN_2635 | 25134 |
| CTCN_2148 | 14948 | GTCN_2636 | 25135 |
| GTCN_1322 | 14949 | GTCN_2637 | 25136 |
| GTCN_1323 | 14950 | GTCN_2638 | 25137 |
| TTCN_2466 | 14951 | GTCN_2639 | 25138 |
| CTCN_2149 | 14952 | TTCN_4973 | 25139 |
| CTCN_2150 | 14953 | TTCN_4974 | 25140 |
| TTCN_2467 | 14954 | TTCN_4975 | 25141 |
| CTCN_2151 | 14955 | TTCN_4976 | 25142 |
| GTCN_1324 | 14956 | ATCN_3102 | 25143 |
| CTCN_2152 | 14957 | TTCN_4977 | 25144 |
| TTCN_2468 | 14958 | CTCN_4615 | 25145 |
| ATCN_1506 | 14959 | GTCN_2640 | 25146 |
| TTCN_2469 | 14960 | CTCN_4616 | 25147 |
| TTCN_2470 | 14961 | ATCN_3103 | 25148 |
| TTCN_2471 | 14962 | ATCN_3104 | 25149 |
| TTCN_2472 | 14963 | CTCN_4617 | 25150 |
| CTCN_2153 | 14964 | TTCN_4978 | 25151 |
| CTCN_2154 | 14965 | TTCN_4979 | 25152 |
| ATCN_1507 | 14966 | TTCN_4980 | 25153 |
| ATCN_1508 | 14967 | ATCN_3105 | 25154 |
| GTCN_1325 | 14968 | CTCN_4618 | 25155 |
| TTCN_2473 | 14969 | CTCN_4619 | 25156 |
| ATCN_1509 | 14970 | TTCN_4981 | 25157 |
| TTCN_2474 | 14971 | ATCN_3106 | 25158 |
| CTCN_2155 | 14972 | ATCN_3107 | 25159 |
| TTCN_2475 | 14973 | CTCN_4620 | 25160 |
| CTCN_2156 | 14974 | ATCN_3108 | 25161 |
| ATCN_1510 | 14975 | CTCN_4621 | 25162 |
| GTCN_1326 | 14976 | TTCN_4982 | 25163 |
| CTCN_2157 | 14977 | CTCN_4622 | 25164 |
| TTCN_2476 | 14978 | ATCN_3109 | 25165 |
| TTCN_2477 | 14979 | ATCN_3110 | 25166 |
| TTCN_2478 | 14980 | CTCN_4623 | 25167 |
| ATCN_1511 | 14981 | CTCN_4624 | 25168 |
| ATCN_1512 | 14982 | TTCN_4983 | 25169 |
| TTCN_2479 | 14983 | GTCN_2641 | 25170 |
| CTCN_2158 | 14984 | TTCN_4984 | 25171 |
| ATCN_1513 | 14985 | TTCN_4985 | 25172 |
| ATCN_1514 | 14986 | TTCN_4986 | 25173 |
| CTCN_2159 | 14987 | CTCN_4625 | 25174 |
| ATCN_1515 | 14988 | CTCN_4626 | 25175 |
| TTCN_2480 | 14989 | TTCN_4987 | 25176 |
| TTCN_2481 | 14990 | ATCN_3111 | 25177 |
| GTCN_1327 | 14991 | CTCN_4627 | 25178 |
| ATCN_1516 | 14992 | ATCN_3112 | 25179 |
| GTCN_1328 | 14993 | CTCN_4628 | 25180 |
| ATCN_1517 | 14994 | TTCN_4988 | 25181 |
| ATCN_1518 | 14995 | TTCN_4989 | 25182 |
| CTCN_2160 | 14996 | TTCN_4990 | 25183 |
| TTCN_2482 | 14997 | GTCN_2642 | 25184 |
| ATCN_1519 | 14998 | CTCN_4629 | 25185 |
| TTCN_2483 | 14999 | ATCN_3113 | 25186 |
| GTCN_1329 | 15000 | CTCN_4630 | 25187 |
| TTCN_2484 | 15001 | TTCN_4991 | 25188 |

FIG. 36 (continued)

| | | | |
|---|---|---|---|
| CTCN_2161 | 15002 | ATCN_3114 | 25189 |
| ATCN_1520 | 15003 | ATCN_3115 | 25190 |
| TTCN_2485 | 15004 | GTCN_2643 | 25191 |
| ATCN_1521 | 15005 | CTCN_4631 | 25192 |
| ATCN_1522 | 15006 | CTCN_4632 | 25193 |
| GTCN_1330 | 15007 | TTCN_4992 | 25194 |
| ATCN_1523 | 15008 | TTCN_4993 | 25195 |
| ATCN_1524 | 15009 | CTCN_4633 | 25196 |
| GTCN_1331 | 15010 | TTCN_4994 | 25197 |
| TTCN_2486 | 15011 | ATCN_3116 | 25198 |
| TTCN_2487 | 15012 | TTCN_4995 | 25199 |
| CTCN_2162 | 15013 | GTCN_2644 | 25200 |
| CTCN_2163 | 15014 | TTCN_4996 | 25201 |
| ATCN_1525 | 15015 | CTCN_4634 | 25202 |
| CTCN_2164 | 15016 | ATCN_3117 | 25203 |
| ATCN_1526 | 15017 | CTCN_4635 | 25204 |
| TTCN_2488 | 15018 | ATCN_3118 | 25205 |
| ATCN_1527 | 15019 | GTCN_2645 | 25206 |
| GTCN_1332 | 15020 | TTCN_4997 | 25207 |
| GTCN_1333 | 15021 | CTCN_4636 | 25208 |
| ATCN_1528 | 15022 | TTCN_4998 | 25209 |
| ATCN_1529 | 15023 | ATCN_3119 | 25210 |
| ATCN_1530 | 15024 | CTCN_4637 | 25211 |
| CTCN_2165 | 15025 | ATCN_3120 | 25212 |
| CTCN_2166 | 15026 | GTCN_2646 | 25213 |
| TTCN_2489 | 15027 | CTCN_4638 | 25214 |
| CTCN_2167 | 15028 | CTCN_4639 | 25215 |
| TTCN_2490 | 15029 | GTCN_2647 | 25216 |
| GTCN_1334 | 15030 | CTCN_4640 | 25217 |
| GTCN_1335 | 15031 | TTCN_4999 | 25218 |
| ATCN_1531 | 15032 | CTCN_4641 | 25219 |
| ATCN_1532 | 15033 | ATCN_3121 | 25220 |
| ATCN_1533 | 15034 | TTCN_5000 | 25221 |
| ATCN_1534 | 15035 | GTCN_2648 | 25222 |
| GTCN_1336 | 15036 | CTCN_4642 | 25223 |
| ATCN_1535 | 15037 | TTCN_5001 | 25224 |
| TTCN_2491 | 15038 | GTCN_2649 | 25225 |
| TTCN_2492 | 15039 | GTCN_2650 | 25226 |
| TTCN_2493 | 15040 | TTCN_5002 | 25227 |
| TTCN_2494 | 15041 | TTCN_5003 | 25228 |
| ATCN_1536 | 15042 | TTCN_5004 | 25229 |
| GTCN_1337 | 15043 | ATCN_3122 | 25230 |
| TTCN_2495 | 15044 | GTCN_2651 | 25231 |
| TTCN_2496 | 15045 | CTCN_4643 | 25232 |
| TTCN_2497 | 15046 | CTCN_4644 | 25233 |
| ATCN_1537 | 15047 | CTCN_4645 | 25234 |
| ATCN_1538 | 15048 | CTCN_4646 | 25235 |
| ATCN_1539 | 15049 | CTCN_4647 | 25236 |
| GTCN_1338 | 15050 | TTCN_5005 | 25237 |
| CTCN_2168 | 15051 | CTCN_4648 | 25238 |
| CTCN_2169 | 15052 | ATCN_3123 | 25239 |
| CTCN_2170 | 15053 | TTCN_5006 | 25240 |
| GTCN_1339 | 15054 | GTCN_2652 | 25241 |
| TTCN_2498 | 15055 | TTCN_5007 | 25242 |
| CTCN_2171 | 15056 | GTCN_2653 | 25243 |

| | | | |
|---|---|---|---|
| GTCN_1340 | 15057 | ATCN_3124 | 25244 |
| CTCN_2172 | 15058 | TTCN_5008 | 25245 |
| GTCN_1341 | 15059 | ATCN_3125 | 25246 |
| TTCN_2499 | 15060 | CTCN_4649 | 25247 |
| TTCN_2500 | 15061 | CTCN_4650 | 25248 |
| CTCN_2173 | 15062 | ATCN_3126 | 25249 |
| GTCN_1342 | 15063 | CTCN_4651 | 25250 |
| TTCN_2501 | 15064 | TTCN_5009 | 25251 |
| TTCN_2502 | 15065 | ATCN_3127 | 25252 |
| CTCN_2174 | 15066 | ATCN_3128 | 25253 |
| CTCN_2175 | 15067 | CTCN_4652 | 25254 |
| CTCN_2176 | 15068 | TTCN_5010 | 25255 |
| CTCN_2177 | 15069 | TTCN_5011 | 25256 |
| TTCN_2503 | 15070 | CTCN_4653 | 25257 |
| GTCN_1343 | 15071 | ATCN_3129 | 25258 |
| TTCN_2504 | 15072 | GTCN_2654 | 25259 |
| GTCN_1344 | 15073 | CTCN_4654 | 25260 |
| TTCN_2505 | 15074 | CTCN_4655 | 25261 |
| CTCN_2178 | 15075 | ATCN_3130 | 25262 |
| ATCN_1540 | 15076 | TTCN_5012 | 25263 |
| CTCN_2179 | 15077 | TTCN_5013 | 25264 |
| TTCN_2506 | 15078 | ATCN_3131 | 25265 |
| CTCN_2180 | 15079 | TTCN_5014 | 25266 |
| CTCN_2181 | 15080 | TTCN_5015 | 25267 |
| TTCN_2507 | 15081 | ATCN_3132 | 25268 |
| CTCN_2182 | 15082 | ATCN_3133 | 25269 |
| GTCN_1345 | 15083 | TTCN_5016 | 25270 |
| ATCN_1541 | 15084 | GTCN_2655 | 25271 |
| ATCN_1542 | 15085 | CTCN_4656 | 25272 |
| GTCN_1346 | 15086 | CTCN_4657 | 25273 |
| CTCN_2183 | 15087 | TTCN_5017 | 25274 |
| TTCN_2508 | 15088 | TTCN_5018 | 25275 |
| ATCN_1543 | 15089 | CTCN_4658 | 25276 |
| GTCN_1347 | 15090 | TTCN_5019 | 25277 |
| CTCN_2184 | 15091 | CTCN_4659 | 25278 |
| GTCN_1348 | 15092 | CTCN_4660 | 25279 |
| CTCN_2185 | 15093 | CTCN_4661 | 25280 |
| TTCN_2509 | 15094 | CTCN_4662 | 25281 |
| TTCN_2510 | 15095 | ATCN_3134 | 25282 |
| CTCN_2186 | 15096 | TTCN_5020 | 25283 |
| GTCN_1349 | 15097 | TTCN_5021 | 25284 |
| ATCN_1544 | 15098 | CTCN_4663 | 25285 |
| TTCN_2511 | 15099 | GTCN_2656 | 25286 |
| ATCN_1545 | 15100 | CTCN_4664 | 25287 |
| GTCN_1350 | 15101 | GTCN_2657 | 25288 |
| TTCN_2512 | 15102 | CTCN_4665 | 25289 |
| CTCN_2187 | 15103 | CTCN_4666 | 25290 |
| CTCN_2188 | 15104 | CTCN_4667 | 25291 |
| TTCN_2513 | 15105 | GTCN_2658 | 25292 |
| ATCN_1546 | 15106 | CTCN_4668 | 25293 |
| ATCN_1547 | 15107 | CTCN_4669 | 25294 |
| TTCN_2514 | 15108 | TTCN_5022 | 25295 |
| CTCN_2189 | 15109 | GTCN_2659 | 25296 |
| ATCN_1548 | 15110 | CTCN_4670 | 25297 |
| TTCN_2515 | 15111 | TTCN_5023 | 25298 |

FIG. 36 (continued)

| | | | |
|---|---|---|---|
| TTCN_2516 | 15112 | TTCN_5024 | 25299 |
| TTCN_2517 | 15113 | TTCN_5025 | 25300 |
| CTCN_2190 | 15114 | ATCN_3135 | 25301 |
| ATCN_1549 | 15115 | ATCN_3136 | 25302 |
| TTCN_2518 | 15116 | CTCN_4671 | 25303 |
| TTCN_2519 | 15117 | TTCN_5026 | 25304 |
| TTCN_2520 | 15118 | GTCN_2660 | 25305 |
| ATCN_1550 | 15119 | GTCN_2661 | 25306 |
| GTCN_1351 | 15120 | CTCN_4672 | 25307 |
| ATCN_1551 | 15121 | CTCN_4673 | 25308 |
| TTCN_2521 | 15122 | CTCN_4674 | 25309 |
| CTCN_2191 | 15123 | GTCN_2662 | 25310 |
| CTCN_2192 | 15124 | ATCN_3137 | 25311 |
| CTCN_2193 | 15125 | TTCN_5027 | 25312 |
| ATCN_1552 | 15126 | TTCN_5028 | 25313 |
| ATCN_1553 | 15127 | CTCN_4675 | 25314 |
| TTCN_2522 | 15128 | GTCN_2663 | 25315 |
| TTCN_2523 | 15129 | CTCN_4676 | 25316 |
| GTCN_1352 | 15130 | TTCN_5029 | 25317 |
| CTCN_2194 | 15131 | TTCN_5030 | 25318 |
| ATCN_1554 | 15132 | ATCN_3138 | 25319 |
| GTCN_1353 | 15133 | ATCN_3139 | 25320 |
| CTCN_2195 | 15134 | CTCN_4677 | 25321 |
| TTCN_2524 | 15135 | TTCN_5031 | 25322 |
| TTCN_2525 | 15136 | ATCN_3140 | 25323 |
| TTCN_2526 | 15137 | ATCN_3141 | 25324 |
| TTCN_2527 | 15138 | GTCN_2664 | 25325 |
| TTCN_2528 | 15139 | GTCN_2665 | 25326 |
| GTCN_1354 | 15140 | CTCN_4678 | 25327 |
| ATCN_1555 | 15141 | CTCN_4679 | 25328 |
| ATCN_1556 | 15142 | GTCN_2666 | 25329 |
| ATCN_1557 | 15143 | ATCN_3142 | 25330 |
| TTCN_2529 | 15144 | GTCN_2667 | 25331 |
| CTCN_2196 | 15145 | CTCN_4680 | 25332 |
| GTCN_1355 | 15146 | ATCN_3143 | 25333 |
| CTCN_2197 | 15147 | ATCN_3144 | 25334 |
| CTCN_2198 | 15148 | CTCN_4681 | 25335 |
| ATCN_1558 | 15149 | GTCN_2668 | 25336 |
| TTCN_2530 | 15150 | CTCN_4682 | 25337 |
| GTCN_1356 | 15151 | CTCN_4683 | 25338 |
| CTCN_2199 | 15152 | TTCN_5032 | 25339 |
| GTCN_1357 | 15153 | ATCN_3145 | 25340 |
| CTCN_2200 | 15154 | ATCN_3146 | 25341 |
| CTCN_2201 | 15155 | TTCN_5033 | 25342 |
| ATCN_1559 | 15156 | TTCN_5034 | 25343 |
| TTCN_2531 | 15157 | CTCN_4684 | 25344 |
| TTCN_2532 | 15158 | TTCN_5035 | 25345 |
| TTCN_2533 | 15159 | GTCN_2669 | 25346 |
| GTCN_1358 | 15160 | CTCN_4685 | 25347 |
| TTCN_2534 | 15161 | CTCN_4686 | 25348 |
| CTCN_2202 | 15162 | ATCN_3147 | 25349 |
| ATCN_1560 | 15163 | CTCN_4687 | 25350 |
| GTCN_1359 | 15164 | GTCN_2670 | 25351 |
| ATCN_1561 | 15165 | ATCN_3148 | 25352 |
| ATCN_1562 | 15166 | ATCN_3149 | 25353 |
| CTCN_2203 | 15167 | CTCN_4688 | 25354 |
| CTCN_2204 | 15168 | GTCN_2671 | 25355 |
| TTCN_2535 | 15169 | CTCN_4689 | 25356 |
| CTCN_2205 | 15170 | GTCN_2672 | 25357 |
| TTCN_2536 | 15171 | ATCN_3150 | 25358 |
| GTCN_1360 | 15172 | ATCN_3151 | 25359 |
| CTCN_2206 | 15173 | ATCN_3152 | 25360 |
| GTCN_1361 | 15174 | ATCN_3153 | 25361 |
| CTCN_2207 | 15175 | CTCN_4690 | 25362 |
| ATCN_1563 | 15176 | CTCN_4691 | 25363 |
| TTCN_2537 | 15177 | ATCN_3154 | 25364 |
| ATCN_1564 | 15178 | TTCN_5036 | 25365 |
| TTCN_2538 | 15179 | TTCN_5037 | 25366 |
| GTCN_1362 | 15180 | CTCN_4692 | 25367 |
| ATCN_1565 | 15181 | ATCN_3155 | 25368 |
| CTCN_2208 | 15182 | ATCN_3156 | 25369 |
| CTCN_2209 | 15183 | CTCN_4693 | 25370 |
| CTCN_2210 | 15184 | ATCN_3157 | 25371 |
| ATCN_1566 | 15185 | CTCN_4694 | 25372 |
| TTCN_2539 | 15186 | ATCN_3158 | 25373 |
| TTCN_2540 | 15187 | CTCN_4695 | 25374 |
| TTCN_2541 | 15188 | GTCN_2673 | 25375 |
| TTCN_2542 | 15189 | TTCN_5038 | 25376 |
| GTCN_1363 | 15190 | TTCN_5039 | 25377 |
| TTCN_2543 | 15191 | TTCN_5040 | 25378 |
| ATCN_1567 | 15192 | TTCN_5041 | 25379 |
| GTCN_1364 | 15193 | TTCN_5042 | 25380 |
| TTCN_2544 | 15194 | TTCN_5043 | 25381 |
| CTCN_2211 | 15195 | CTCN_4696 | 25382 |
| ATCN_1568 | 15196 | CTCN_4697 | 25383 |
| TTCN_2545 | 15197 | TTCN_5044 | 25384 |
| GTCN_1365 | 15198 | ATCN_3159 | 25385 |
| CTCN_2212 | 15199 | GTCN_2674 | 25386 |
| GTCN_1366 | 15200 | TTCN_5045 | 25387 |
| ATCN_1569 | 15201 | CTCN_4698 | 25388 |
| ATCN_1570 | 15202 | CTCN_4699 | 25389 |
| TTCN_2546 | 15203 | TTCN_5046 | 25390 |
| TTCN_2547 | 15204 | CTCN_4700 | 25391 |
| CTCN_2213 | 15205 | CTCN_4701 | 25392 |
| TTCN_2548 | 15206 | ATCN_3160 | 25393 |
| ATCN_1571 | 15207 | GTCN_2675 | 25394 |
| ATCN_1572 | 15208 | TTCN_5047 | 25395 |
| CTCN_2214 | 15209 | CTCN_4702 | 25396 |
| ATCN_1573 | 15210 | GTCN_2676 | 25397 |
| TTCN_2549 | 15211 | CTCN_4703 | 25398 |
| TTCN_2550 | 15212 | ATCN_3161 | 25399 |
| TTCN_2551 | 15213 | ATCN_3162 | 25400 |
| GTCN_1367 | 15214 | GTCN_2677 | 25401 |
| ATCN_1574 | 15215 | ATCN_3163 | 25402 |
| ATCN_1575 | 15216 | GTCN_2678 | 25403 |
| GTCN_1368 | 15217 | GTCN_2679 | 25404 |
| GTCN_1369 | 15218 | TTCN_5048 | 25405 |
| CTCN_2215 | 15219 | ATCN_3164 | 25406 |
| ATCN_1576 | 15220 | TTCN_5049 | 25407 |
| ATCN_1577 | 15221 | TTCN_5050 | 25408 |

FIG. 36 (continued)

| | | | |
|---|---|---|---|
| TTCN_2552 | 15222 | CTCN_4704 | 25409 |
| CTCN_2216 | 15223 | CTCN_4705 | 25410 |
| TTCN_2553 | 15224 | ATCN_3165 | 25411 |
| ATCN_1578 | 15225 | CTCN_4706 | 25412 |
| CTCN_2217 | 15226 | TTCN_5051 | 25413 |
| CTCN_2218 | 15227 | TTCN_5052 | 25414 |
| GTCN_1370 | 15228 | TTCN_5053 | 25415 |
| TTCN_2554 | 15229 | GTCN_2680 | 25416 |
| CTCN_2219 | 15230 | TTCN_5054 | 25417 |
| CTCN_2220 | 15231 | TTCN_5055 | 25418 |
| TTCN_2555 | 15232 | ATCN_3166 | 25419 |
| ATCN_1579 | 15233 | TTCN_5056 | 25420 |
| CTCN_2221 | 15234 | ATCN_3167 | 25421 |
| GTCN_1371 | 15235 | ATCN_3168 | 25422 |
| TTCN_2556 | 15236 | TTCN_5057 | 25423 |
| CTCN_2222 | 15237 | CTCN_4707 | 25424 |
| TTCN_2557 | 15238 | TTCN_5058 | 25425 |
| CTCN_2223 | 15239 | CTCN_4708 | 25426 |
| TTCN_2558 | 15240 | TTCN_5059 | 25427 |
| CTCN_2224 | 15241 | ATCN_3169 | 25428 |
| TTCN_2559 | 15242 | TTCN_5060 | 25429 |
| TTCN_2560 | 15243 | TTCN_5061 | 25430 |
| TTCN_2561 | 15244 | TTCN_5062 | 25431 |
| TTCN_2562 | 15245 | CTCN_4709 | 25432 |
| TTCN_2563 | 15246 | TTCN_5063 | 25433 |
| TTCN_2564 | 15247 | CTCN_4710 | 25434 |
| TTCN_2565 | 15248 | GTCN_2681 | 25435 |
| TTCN_2566 | 15249 | CTCN_4711 | 25436 |
| ATCN_1580 | 15250 | CTCN_4712 | 25437 |
| TTCN_2567 | 15251 | ATCN_3170 | 25438 |
| TTCN_2568 | 15252 | CTCN_4713 | 25439 |
| CTCN_2225 | 15253 | ATCN_3171 | 25440 |
| TTCN_2569 | 15254 | ATCN_3172 | 25441 |
| TTCN_2570 | 15255 | ATCN_3173 | 25442 |
| GTCN_1372 | 15256 | CTCN_4714 | 25443 |
| GTCN_1373 | 15257 | CTCN_4715 | 25444 |
| CTCN_2226 | 15258 | ATCN_3174 | 25445 |
| GTCN_1374 | 15259 | ATCN_3175 | 25446 |
| GTCN_1375 | 15260 | ATCN_3176 | 25447 |
| TTCN_2571 | 15261 | TTCN_5064 | 25448 |
| TTCN_2572 | 15262 | CTCN_4716 | 25449 |
| GTCN_1376 | 15263 | CTCN_4717 | 25450 |
| CTCN_2227 | 15264 | GTCN_2682 | 25451 |
| ATCN_1581 | 15265 | TTCN_5065 | 25452 |
| CTCN_2228 | 15266 | CTCN_4718 | 25453 |
| CTCN_2229 | 15267 | CTCN_4719 | 25454 |
| TTCN_2573 | 15268 | ATCN_3177 | 25455 |
| CTCN_2230 | 15269 | CTCN_4720 | 25456 |
| CTCN_2231 | 15270 | ATCN_3178 | 25457 |
| TTCN_2574 | 15271 | CTCN_4721 | 25458 |
| ATCN_1582 | 15272 | CTCN_4722 | 25459 |
| TTCN_2575 | 15273 | GTCN_2683 | 25460 |
| CTCN_2232 | 15274 | TTCN_5066 | 25461 |
| TTCN_2576 | 15275 | TTCN_5067 | 25462 |
| CTCN_2233 | 15276 | TTCN_5068 | 25463 |

| | | | |
|---|---|---|---|
| CTCN_2234 | 15277 | ATCN_3179 | 25464 |
| ATCN_1583 | 15278 | TTCN_5069 | 25465 |
| TTCN_2577 | 15279 | ATCN_3180 | 25466 |
| GTCN_1377 | 15280 | TTCN_5070 | 25467 |
| TTCN_2578 | 15281 | ATCN_3181 | 25468 |
| TTCN_2579 | 15282 | TTCN_5071 | 25469 |
| CTCN_2235 | 15283 | ATCN_3182 | 25470 |
| TTCN_2580 | 15284 | CTCN_4723 | 25471 |
| CTCN_2236 | 15285 | GTCN_2684 | 25472 |
| ATCN_1584 | 15286 | CTCN_4724 | 25473 |
| ATCN_1585 | 15287 | CTCN_4725 | 25474 |
| CTCN_2237 | 15288 | CTCN_4726 | 25475 |
| GTCN_1378 | 15289 | CTCN_4727 | 25476 |
| TTCN_2581 | 15290 | TTCN_5072 | 25477 |
| TTCN_2582 | 15291 | CTCN_4728 | 25478 |
| CTCN_2238 | 15292 | CTCN_4729 | 25479 |
| TTCN_2583 | 15293 | CTCN_4730 | 25480 |
| TTCN_2584 | 15294 | CTCN_4731 | 25481 |
| ATCN_1586 | 15295 | ATCN_3183 | 25482 |
| GTCN_1379 | 15296 | CTCN_4732 | 25483 |
| GTCN_1380 | 15297 | ATCN_3184 | 25484 |
| CTCN_2239 | 15298 | TTCN_5073 | 25485 |
| TTCN_2585 | 15299 | CTCN_4733 | 25486 |
| TTCN_2586 | 15300 | GTCN_2685 | 25487 |
| TTCN_2587 | 15301 | CTCN_4734 | 25488 |
| TTCN_2588 | 15302 | CTCN_4735 | 25489 |
| TTCN_2589 | 15303 | TTCN_5074 | 25490 |
| TTCN_2590 | 15304 | CTCN_4736 | 25491 |
| GTCN_1381 | 15305 | CTCN_4737 | 25492 |
| GTCN_1382 | 15306 | TTCN_5075 | 25493 |
| CTCN_2240 | 15307 | CTCN_4738 | 25494 |
| CTCN_2241 | 15308 | CTCN_4739 | 25495 |
| CTCN_2242 | 15309 | CTCN_4740 | 25496 |
| GTCN_1383 | 15310 | TTCN_5076 | 25497 |
| ATCN_1587 | 15311 | GTCN_2686 | 25498 |
| GTCN_1384 | 15312 | CTCN_4741 | 25499 |
| CTCN_2243 | 15313 | CTCN_4742 | 25500 |
| CTCN_2244 | 15314 | TTCN_5077 | 25501 |
| ATCN_1588 | 15315 | CTCN_4743 | 25502 |
| ATCN_1589 | 15316 | CTCN_4744 | 25503 |
| ATCN_1590 | 15317 | CTCN_4745 | 25504 |
| ATCN_1591 | 15318 | ATCN_3185 | 25505 |
| CTCN_2245 | 15319 | ATCN_3186 | 25506 |
| GTCN_1385 | 15320 | ATCN_3187 | 25507 |
| CTCN_2246 | 15321 | ATCN_3188 | 25508 |
| GTCN_1386 | 15322 | TTCN_5078 | 25509 |
| TTCN_2591 | 15323 | GTCN_2687 | 25510 |
| CTCN_2247 | 15324 | GTCN_2688 | 25511 |
| GTCN_1387 | 15325 | CTCN_4746 | 25512 |
| GTCN_1388 | 15326 | TTCN_5079 | 25513 |
| ATCN_1592 | 15327 | CTCN_4747 | 25514 |
| TTCN_2592 | 15328 | CTCN_4748 | 25515 |
| ATCN_1593 | 15329 | TTCN_5080 | 25516 |
| CTCN_2248 | 15330 | TTCN_5081 | 25517 |
| GTCN_1389 | 15331 | CTCN_4749 | 25518 |

FIG. 36 (continued)

| | | | |
|---|---|---|---|
| CTCN_2249 | 15332 | CTCN_4750 | 25519 |
| CTCN_2250 | 15333 | GTCN_2689 | 25520 |
| CTCN_2251 | 15334 | CTCN_4751 | 25521 |
| TTCN_2593 | 15335 | GTCN_2690 | 25522 |
| TTCN_2594 | 15336 | TTCN_5082 | 25523 |
| ATCN_1594 | 15337 | ATCN_3189 | 25524 |
| ATCN_1595 | 15338 | ATCN_3190 | 25525 |
| CTCN_2252 | 15339 | TTCN_5083 | 25526 |
| TTCN_2595 | 15340 | ATCN_3191 | 25527 |
| TTCN_2596 | 15341 | GTCN_2691 | 25528 |
| TTCN_2597 | 15342 | CTCN_4752 | 25529 |
| GTCN_1390 | 15343 | TTCN_5084 | 25530 |
| CTCN_2253 | 15344 | CTCN_4753 | 25531 |
| TTCN_2598 | 15345 | ATCN_3192 | 25532 |
| TTCN_2599 | 15346 | CTCN_4754 | 25533 |
| TTCN_2600 | 15347 | ATCN_3193 | 25534 |
| CTCN_2254 | 15348 | TTCN_5085 | 25535 |
| TTCN_2601 | 15349 | ATCN_3194 | 25536 |
| TTCN_2602 | 15350 | CTCN_4755 | 25537 |
| GTCN_1391 | 15351 | ATCN_3195 | 25538 |
| TTCN_2603 | 15352 | TTCN_5086 | 25539 |
| CTCN_2255 | 15353 | TTCN_5087 | 25540 |
| CTCN_2256 | 15354 | ATCN_3196 | 25541 |
| GTCN_1392 | 15355 | ATCN_3197 | 25542 |
| TTCN_2604 | 15356 | CTCN_4756 | 25543 |
| TTCN_2605 | 15357 | TTCN_5088 | 25544 |
| TTCN_2606 | 15358 | CTCN_4757 | 25545 |
| TTCN_2607 | 15359 | TTCN_5089 | 25546 |
| TTCN_2608 | 15360 | CTCN_4758 | 25547 |
| ATCN_1596 | 15361 | TTCN_5090 | 25548 |
| TTCN_2609 | 15362 | TTCN_5091 | 25549 |
| TTCN_2610 | 15363 | CTCN_4759 | 25550 |
| ATCN_1597 | 15364 | GTCN_2692 | 25551 |
| GTCN_1393 | 15365 | TTCN_5092 | 25552 |
| CTCN_2257 | 15366 | ATCN_3198 | 25553 |
| ATCN_1598 | 15367 | CTCN_4760 | 25554 |
| TTCN_2611 | 15368 | GTCN_2693 | 25555 |
| TTCN_2612 | 15369 | ATCN_3199 | 25556 |
| CTCN_2258 | 15370 | TTCN_5093 | 25557 |
| TTCN_2613 | 15371 | GTCN_2694 | 25558 |
| CTCN_2259 | 15372 | TTCN_5094 | 25559 |
| TTCN_2614 | 15373 | GTCN_2695 | 25560 |
| CTCN_2260 | 15374 | TTCN_5095 | 25561 |
| TTCN_2615 | 15375 | TTCN_5096 | 25562 |
| TTCN_2616 | 15376 | ATCN_3200 | 25563 |
| TTCN_2617 | 15377 | ATCN_3201 | 25564 |
| GTCN_1394 | 15378 | ATCN_3202 | 25565 |
| GTCN_1395 | 15379 | CTCN_4761 | 25566 |
| GTCN_1396 | 15380 | TTCN_5097 | 25567 |
| ATCN_1599 | 15381 | ATCN_3203 | 25568 |
| CTCN_2261 | 15382 | CTCN_4762 | 25569 |
| ATCN_1600 | 15383 | CTCN_4763 | 25570 |
| GTCN_1397 | 15384 | GTCN_2696 | 25571 |
| CTCN_2262 | 15385 | CTCN_4764 | 25572 |
| TTCN_2618 | 15386 | ATCN_3204 | 25573 |

| | | | |
|---|---|---|---|
| ATCN_1601 | 15387 | CTCN_4765 | 25574 |
| TTCN_2619 | 15388 | CTCN_4766 | 25575 |
| ATCN_1602 | 15389 | TTCN_5098 | 25576 |
| ATCN_1603 | 15390 | ATCN_3205 | 25577 |
| GTCN_1398 | 15391 | ATCN_3206 | 25578 |
| CTCN_2263 | 15392 | TTCN_5099 | 25579 |
| TTCN_2620 | 15393 | CTCN_4767 | 25580 |
| TTCN_2621 | 15394 | CTCN_4768 | 25581 |
| TTCN_2622 | 15395 | TTCN_5100 | 25582 |
| TTCN_2623 | 15396 | GTCN_2697 | 25583 |
| TTCN_2624 | 15397 | GTCN_2698 | 25584 |
| GTCN_1399 | 15398 | TTCN_5101 | 25585 |
| TTCN_2625 | 15399 | TTCN_5102 | 25586 |
| TTCN_2626 | 15400 | ATCN_3207 | 25587 |
| GTCN_1400 | 15401 | ATCN_3208 | 25588 |
| ATCN_1604 | 15402 | ATCN_3209 | 25589 |
| GTCN_1401 | 15403 | CTCN_4769 | 25590 |
| TTCN_2627 | 15404 | CTCN_4770 | 25591 |
| GTCN_1402 | 15405 | TTCN_5103 | 25592 |
| TTCN_2628 | 15406 | CTCN_4771 | 25593 |
| ATCN_1605 | 15407 | TTCN_5104 | 25594 |
| ATCN_1606 | 15408 | ATCN_3210 | 25595 |
| CTCN_2264 | 15409 | TTCN_5105 | 25596 |
| ATCN_1607 | 15410 | CTCN_4772 | 25597 |
| ATCN_1608 | 15411 | GTCN_2699 | 25598 |
| CTCN_2265 | 15412 | TTCN_5106 | 25599 |
| GTCN_1403 | 15413 | ATCN_3211 | 25600 |
| TTCN_2629 | 15414 | TTCN_5107 | 25601 |
| TTCN_2630 | 15415 | ATCN_3212 | 25602 |
| CTCN_2266 | 15416 | TTCN_5108 | 25603 |
| TTCN_2631 | 15417 | ATCN_3213 | 25604 |
| TTCN_2632 | 15418 | CTCN_4773 | 25605 |
| TTCN_2633 | 15419 | TTCN_5109 | 25606 |
| CTCN_2267 | 15420 | GTCN_2700 | 25607 |
| ATCN_1609 | 15421 | ATCN_3214 | 25608 |
| TTCN_2634 | 15422 | CTCN_4774 | 25609 |
| GTCN_1404 | 15423 | GTCN_2701 | 25610 |
| ATCN_1610 | 15424 | CTCN_4775 | 25611 |
| TTCN_2635 | 15425 | CTCN_4776 | 25612 |
| CTCN_2268 | 15426 | CTCN_4777 | 25613 |
| CTCN_2269 | 15427 | TTCN_5110 | 25614 |
| CTCN_2270 | 15428 | CTCN_4778 | 25615 |
| GTCN_1405 | 15429 | ATCN_3215 | 25616 |
| GTCN_1406 | 15430 | TTCN_5111 | 25617 |
| ATCN_1611 | 15431 | GTCN_2702 | 25618 |
| TTCN_2636 | 15432 | TTCN_5112 | 25619 |
| TTCN_2637 | 15433 | CTCN_4779 | 25620 |
| ATCN_1612 | 15434 | CTCN_4780 | 25621 |
| ATCN_1613 | 15435 | GTCN_2703 | 25622 |
| CTCN_2271 | 15436 | GTCN_2704 | 25623 |
| TTCN_2638 | 15437 | TTCN_5113 | 25624 |
| CTCN_2272 | 15438 | CTCN_4781 | 25625 |
| TTCN_2639 | 15439 | CTCN_4782 | 25626 |
| TTCN_2640 | 15440 | TTCN_5114 | 25627 |
| TTCN_2641 | 15441 | TTCN_5115 | 25628 |

FIG. 36 (continued)

| | | | |
|---|---|---|---|
| TTCN_2642 | 15442 | ATCN_3216 | 25629 |
| GTCN_1407 | 15443 | ATCN_3217 | 25630 |
| CTCN_2273 | 15444 | TTCN_5116 | 25631 |
| ATCN_1614 | 15445 | CTCN_4783 | 25632 |
| GTCN_1408 | 15446 | CTCN_4784 | 25633 |
| CTCN_2274 | 15447 | GTCN_2705 | 25634 |
| CTCN_2275 | 15448 | ATCN_3218 | 25635 |
| ATCN_1615 | 15449 | TTCN_5117 | 25636 |
| ATCN_1616 | 15450 | GTCN_2706 | 25637 |
| ATCN_1617 | 15451 | TTCN_5118 | 25638 |
| CTCN_2276 | 15452 | TTCN_5119 | 25639 |
| TTCN_2643 | 15453 | CTCN_4785 | 25640 |
| ATCN_1618 | 15454 | CTCN_4786 | 25641 |
| CTCN_2277 | 15455 | CTCN_4787 | 25642 |
| TTCN_2644 | 15456 | GTCN_2707 | 25643 |
| TTCN_2645 | 15457 | CTCN_4788 | 25644 |
| CTCN_2278 | 15458 | GTCN_2708 | 25645 |
| TTCN_2646 | 15459 | CTCN_4789 | 25646 |
| CTCN_2279 | 15460 | CTCN_4790 | 25647 |
| ATCN_1619 | 15461 | ATCN_3219 | 25648 |
| CTCN_2280 | 15462 | TTCN_5120 | 25649 |
| CTCN_2281 | 15463 | TTCN_5121 | 25650 |
| ATCN_1620 | 15464 | TTCN_5122 | 25651 |
| CTCN_2282 | 15465 | GTCN_2709 | 25652 |
| GTCN_1409 | 15466 | CTCN_4791 | 25653 |
| CTCN_2283 | 15467 | ATCN_3220 | 25654 |
| CTCN_2284 | 15468 | TTCN_5123 | 25655 |
| GTCN_1410 | 15469 | TTCN_5124 | 25656 |
| CTCN_2285 | 15470 | GTCN_2710 | 25657 |
| GTCN_1411 | 15471 | CTCN_4792 | 25658 |
| CTCN_2286 | 15472 | GTCN_2711 | 25659 |
| TTCN_2647 | 15473 | TTCN_5125 | 25660 |
| GTCN_1412 | 15474 | ATCN_3221 | 25661 |
| CTCN_2287 | 15475 | CTCN_4793 | 25662 |
| CTCN_2288 | 15476 | GTCN_2712 | 25663 |
| TTCN_2648 | 15477 | CTCN_4794 | 25664 |
| CTCN_2289 | 15478 | TTCN_5126 | 25665 |
| TTCN_2649 | 15479 | TTCN_5127 | 25666 |
| TTCN_2650 | 15480 | ATCN_3222 | 25667 |
| GTCN_1413 | 15481 | TTCN_5128 | 25668 |
| TTCN_2651 | 15482 | TTCN_5129 | 25669 |
| TTCN_2652 | 15483 | ATCN_3223 | 25670 |
| TTCN_2653 | 15484 | ATCN_3224 | 25671 |
| TTCN_2654 | 15485 | ATCN_3225 | 25672 |
| GTCN_1414 | 15486 | ATCN_3226 | 25673 |
| TTCN_2655 | 15487 | GTCN_2713 | 25674 |
| TTCN_2656 | 15488 | GTCN_2714 | 25675 |
| CTCN_2290 | 15489 | ATCN_3227 | 25676 |
| TTCN_2657 | 15490 | ATCN_3228 | 25677 |
| TTCN_2658 | 15491 | TTCN_5130 | 25678 |
| TTCN_2659 | 15492 | TTCN_5131 | 25679 |
| CTCN_2291 | 15493 | ATCN_3229 | 25680 |
| GTCN_1415 | 15494 | ATCN_3230 | 25681 |
| CTCN_2292 | 15495 | TTCN_5132 | 25682 |
| CTCN_2293 | 15496 | GTCN_2715 | 25683 |

| | | | |
|---|---|---|---|
| TTCN_2660 | 15497 | CTCN_4795 | 25684 |
| CTCN_2294 | 15498 | GTCN_2716 | 25685 |
| GTCN_1416 | 15499 | CTCN_4796 | 25686 |
| CTCN_2295 | 15500 | TTCN_5133 | 25687 |
| TTCN_2661 | 15501 | ATCN_3231 | 25688 |
| CTCN_2296 | 15502 | GTCN_2717 | 25689 |
| CTCN_2297 | 15503 | CTCN_4797 | 25690 |
| GTCN_1417 | 15504 | CTCN_4798 | 25691 |
| TTCN_2662 | 15505 | CTCN_4799 | 25692 |
| GTCN_1418 | 15506 | TTCN_5134 | 25693 |
| GTCN_1419 | 15507 | GTCN_2718 | 25694 |
| ATCN_1621 | 15508 | GTCN_2719 | 25695 |
| CTCN_2298 | 15509 | CTCN_4800 | 25696 |
| ATCN_1622 | 15510 | ATCN_3232 | 25697 |
| TTCN_2663 | 15511 | CTCN_4801 | 25698 |
| ATCN_1623 | 15512 | ATCN_3233 | 25699 |
| CTCN_2299 | 15513 | CTCN_4802 | 25700 |
| GTCN_1420 | 15514 | TTCN_5135 | 25701 |
| CTCN_2300 | 15515 | TTCN_5136 | 25702 |
| CTCN_2301 | 15516 | CTCN_4803 | 25703 |
| CTCN_2302 | 15517 | CTCN_4804 | 25704 |
| CTCN_2303 | 15518 | TTCN_5137 | 25705 |
| CTCN_2304 | 15519 | ATCN_3234 | 25706 |
| TTCN_2664 | 15520 | CTCN_4805 | 25707 |
| TTCN_2665 | 15521 | CTCN_4806 | 25708 |
| TTCN_2666 | 15522 | TTCN_5025 | 25709 |
| ATCN_1624 | 15523 | ATCN_3135 | 25710 |
| GTCN_1421 | 15524 | ATCN_3136 | 25711 |
| CTCN_2305 | 15525 | CTCN_4671 | 25712 |
| CTCN_2306 | 15526 | TTCN_5026 | 25713 |
| ATCN_1625 | 15527 | GTCN_2660 | 25714 |
| CTCN_2307 | 15528 | GTCN_2661 | 25715 |
| ATCN_1626 | 15529 | CTCN_4672 | 25716 |
| CTCN_2308 | 15530 | CTCN_4673 | 25717 |
| CTCN_2309 | 15531 | CTCN_4674 | 25718 |
| TTCN_2667 | 15532 | GTCN_2662 | 25719 |
| TTCN_2668 | 15533 | ATCN_3137 | 25720 |
| TTCN_2669 | 15534 | TTCN_5027 | 25721 |
| TTCN_2670 | 15535 | TTCN_5028 | 25722 |
| TTCN_2671 | 15536 | CTCN_4675 | 25723 |
| TTCN_2672 | 15537 | GTCN_2663 | 25724 |
| TTCN_2673 | 15538 | CTCN_4676 | 25725 |
| ATCN_1627 | 15539 | TTCN_5029 | 25726 |
| ATCN_1628 | 15540 | TTCN_5030 | 25727 |
| TTCN_2674 | 15541 | ATCN_3138 | 25728 |
| GTCN_1422 | 15542 | ATCN_3139 | 25729 |
| CTCN_2310 | 15543 | CTCN_4677 | 25730 |
| ATCN_1629 | 15544 | TTCN_5031 | 25731 |
| TTCN_2675 | 15545 | ATCN_3140 | 25732 |
| TTCN_2676 | 15546 | ATCN_3141 | 25733 |
| ATCN_1630 | 15547 | GTCN_2664 | 25734 |
| TTCN_2677 | 15548 | GTCN_2665 | 25735 |
| ATCN_1631 | 15549 | CTCN_4678 | 25736 |
| CTCN_2311 | 15550 | CTCN_4679 | 25737 |
| CTCN_2312 | 15551 | GTCN_2666 | 25738 |

FIG. 36 (continued)

| | | | |
|---|---|---|---|
| TTCN_2678 | 15552 | ATCN_3142 | 25739 |
| ATCN_1632 | 15553 | GTCN_2667 | 25740 |
| ATCN_1633 | 15554 | CTCN_4680 | 25741 |
| ATCN_1634 | 15555 | ATCN_3143 | 25742 |
| GTCN_1423 | 15556 | ATCN_3144 | 25743 |
| CTCN_2313 | 15557 | CTCN_4681 | 25744 |
| CTCN_2314 | 15558 | GTCN_2668 | 25745 |
| ATCN_1635 | 15559 | CTCN_4682 | 25746 |
| CTCN_2315 | 15560 | CTCN_4683 | 25747 |
| CTCN_2316 | 15561 | TTCN_5032 | 25748 |
| GTCN_1424 | 15562 | ATCN_3145 | 25749 |
| TTCN_2679 | 15563 | ATCN_3146 | 25750 |
| TTCN_2680 | 15564 | TTCN_5033 | 25751 |
| ATCN_1636 | 15565 | TTCN_5034 | 25752 |
| TTCN_2681 | 15566 | CTCN_4684 | 25753 |
| TTCN_2682 | 15567 | TTCN_5035 | 25754 |
| ATCN_1637 | 15568 | GTCN_2669 | 25755 |
| TTCN_2683 | 15569 | CTCN_4685 | 25756 |
| ATCN_1638 | 15570 | CTCN_4686 | 25757 |
| TTCN_2684 | 15571 | ATCN_3147 | 25758 |
| ATCN_1639 | 15572 | CTCN_4687 | 25759 |
| ATCN_1640 | 15573 | GTCN_2670 | 25760 |
| TTCN_2685 | 15574 | ATCN_3148 | 25761 |
| CTCN_2317 | 15575 | ATCN_3149 | 25762 |
| TTCN_2686 | 15576 | CTCN_4688 | 25763 |
| CTCN_2318 | 15577 | GTCN_2671 | 25764 |
| GTCN_1425 | 15578 | CTCN_4689 | 25765 |
| ATCN_1641 | 15579 | GTCN_2672 | 25766 |
| CTCN_2319 | 15580 | ATCN_3150 | 25767 |
| TTCN_2687 | 15581 | ATCN_3151 | 25768 |
| TTCN_2688 | 15582 | ATCN_3152 | 25769 |
| TTCN_2689 | 15583 | ATCN_3153 | 25770 |
| CTCN_2320 | 15584 | CTCN_4690 | 25771 |
| ATCN_1642 | 15585 | CTCN_4691 | 25772 |
| TTCN_2690 | 15586 | ATCN_3154 | 25773 |
| GTCN_1426 | 15587 | TTCN_5036 | 25774 |
| CTCN_2321 | 15588 | TTCN_5037 | 25775 |
| CTCN_2322 | 15589 | CTCN_4692 | 25776 |
| CTCN_2323 | 15590 | ATCN_3155 | 25777 |
| TTCN_2691 | 15591 | ATCN_3156 | 25778 |
| TTCN_2692 | 15592 | CTCN_4693 | 25779 |
| TTCN_2693 | 15593 | ATCN_3157 | 25780 |
| CTCN_2324 | 15594 | CTCN_4694 | 25781 |
| ATCN_1643 | 15595 | ATCN_3158 | 25782 |
| CTCN_2325 | 15596 | CTCN_4695 | 25783 |
| GTCN_1427 | 15597 | GTCN_2673 | 25784 |
| ATCN_1644 | 15598 | TTCN_5038 | 25785 |
| ATCN_1645 | 15599 | TTCN_5039 | 25786 |
| ATCN_1646 | 15600 | TTCN_5040 | 25787 |
| TTCN_2694 | 15601 | TTCN_5041 | 25788 |
| TTCN_2695 | 15602 | TTCN_5042 | 25789 |
| ATCN_1647 | 15603 | TTCN_5043 | 25790 |
| ATCN_1648 | 15604 | CTCN_4696 | 25791 |
| GTCN_1428 | 15605 | CTCN_4697 | 25792 |
| CTCN_2326 | 15606 | TTCN_5044 | 25793 |

| | | | |
|---|---|---|---|
| CTCN_2327 | 15607 | ATCN_3159 | 25794 |
| CTCN_2328 | 15608 | GTCN_2674 | 25795 |
| TTCN_2696 | 15609 | TTCN_5045 | 25796 |
| CTCN_2329 | 15610 | CTCN_4698 | 25797 |
| TTCN_2697 | 15611 | CTCN_4699 | 25798 |
| TTCN_2698 | 15612 | TTCN_5046 | 25799 |
| CTCN_2330 | 15613 | CTCN_4700 | 25800 |
| ATCN_1649 | 15614 | CTCN_4701 | 25801 |
| TTCN_2699 | 15615 | ATCN_3160 | 25802 |
| ATCN_1650 | 15616 | GTCN_2675 | 25803 |
| CTCN_2331 | 15617 | TTCN_5047 | 25804 |
| TTCN_2700 | 15618 | CTCN_4702 | 25805 |
| CTCN_2332 | 15619 | GTCN_2676 | 25806 |
| TTCN_2701 | 15620 | CTCN_4703 | 25807 |
| TTCN_2702 | 15621 | ATCN_3161 | 25808 |
| GTCN_1429 | 15622 | ATCN_3162 | 25809 |
| ATCN_1651 | 15623 | GTCN_2677 | 25810 |
| ATCN_1652 | 15624 | ATCN_3163 | 25811 |
| GTCN_1430 | 15625 | GTCN_2678 | 25812 |
| CTCN_2333 | 15626 | GTCN_2679 | 25813 |
| ATCN_1653 | 15627 | TTCN_5048 | 25814 |
| ATCN_1654 | 15628 | ATCN_3164 | 25815 |
| CTCN_2334 | 15629 | TTCN_5049 | 25816 |
| GTCN_1431 | 15630 | TTCN_5050 | 25817 |
| GTCN_1432 | 15631 | CTCN_4704 | 25818 |
| GTCN_1433 | 15632 | CTCN_4705 | 25819 |
| GTCN_1434 | 15633 | ATCN_3165 | 25820 |
| GTCN_1435 | 15634 | CTCN_4706 | 25821 |
| TTCN_2703 | 15635 | TTCN_5051 | 25822 |
| TTCN_2704 | 15636 | TTCN_5052 | 25823 |
| GTCN_1436 | 15637 | TTCN_5053 | 25824 |
| ATCN_1655 | 15638 | GTCN_2680 | 25825 |
| CTCN_2335 | 15639 | TTCN_5054 | 25826 |
| ATCN_1656 | 15640 | TTCN_5055 | 25827 |
| CTCN_2336 | 15641 | ATCN_3166 | 25828 |
| TTCN_2705 | 15642 | TTCN_5056 | 25829 |
| CTCN_2337 | 15643 | ATCN_3167 | 25830 |
| CTCN_2338 | 15644 | ATCN_3168 | 25831 |
| CTCN_2339 | 15645 | TTCN_5057 | 25832 |
| CTCN_2340 | 15646 | CTCN_4707 | 25833 |
| ATCN_1657 | 15647 | TTCN_5058 | 25834 |
| TTCN_2706 | 15648 | CTCN_4708 | 25835 |
| TTCN_2707 | 15649 | TTCN_5059 | 25836 |
| GTCN_1437 | 15650 | ATCN_3169 | 25837 |
| GTCN_1438 | 15651 | TTCN_5060 | 25838 |
| CTCN_2341 | 15652 | TTCN_5061 | 25839 |
| CTCN_2342 | 15653 | TTCN_5062 | 25840 |
| CTCN_2343 | 15654 | CTCN_4709 | 25841 |
| TTCN_2708 | 15655 | TTCN_5063 | 25842 |
| CTCN_2344 | 15656 | CTCN_4710 | 25843 |
| TTCN_2709 | 15657 | GTCN_2681 | 25844 |
| CTCN_2345 | 15658 | CTCN_4711 | 25845 |
| GTCN_1439 | 15659 | CTCN_4712 | 25846 |
| GTCN_1440 | 15660 | ATCN_3170 | 25847 |
| CTCN_2346 | 15661 | CTCN_4713 | 25848 |

FIG. 36 (continued)

| | | | | | | | |
|---|---|---|---|---|---|---|---|
| CTCN_2347 | 15662 | ATCN_3171 | 25849 | GTCN_1455 | 15717 | CTCN_4739 | 25904 |
| GTCN_1441 | 15663 | ATCN_3172 | 25850 | CTCN_2364 | 15718 | CTCN_4740 | 25905 |
| TTCN_2710 | 15664 | ATCN_3173 | 25851 | GTCN_1456 | 15719 | TTCN_5076 | 25906 |
| TTCN_2711 | 15665 | CTCN_4714 | 25852 | CTCN_2365 | 15720 | GTCN_2686 | 25907 |
| TTCN_2712 | 15666 | CTCN_4715 | 25853 | CTCN_2366 | 15721 | CTCN_4741 | 25908 |
| CTCN_2348 | 15667 | ATCN_3174 | 25854 | ATCN_1665 | 15722 | CTCN_4742 | 25909 |
| TTCN_2713 | 15668 | ATCN_3175 | 25855 | GTCN_1457 | 15723 | TTCN_5077 | 25910 |
| CTCN_2349 | 15669 | ATCN_3176 | 25856 | CTCN_2367 | 15724 | CTCN_4743 | 25911 |
| ATCN_1658 | 15670 | TTCN_5064 | 25857 | TTCN_2727 | 15725 | CTCN_4744 | 25912 |
| TTCN_2714 | 15671 | CTCN_4716 | 25858 | CTCN_2368 | 15726 | CTCN_4745 | 25913 |
| CTCN_2350 | 15672 | CTCN_4717 | 25859 | TTCN_2728 | 15727 | ATCN_3185 | 25914 |
| GTCN_1442 | 15673 | GTCN_2682 | 25860 | CTCN_2369 | 15728 | ATCN_3186 | 25915 |
| TTCN_2715 | 15674 | TTCN_5065 | 25861 | CTCN_2370 | 15729 | ATCN_3187 | 25916 |
| CTCN_2351 | 15675 | CTCN_4718 | 25862 | TTCN_2729 | 15730 | ATCN_3188 | 25917 |
| ATCN_1659 | 15676 | CTCN_4719 | 25863 | CTCN_2371 | 15731 | TTCN_5078 | 25918 |
| TTCN_2716 | 15677 | ATCN_3177 | 25864 | TTCN_2730 | 15732 | GTCN_2687 | 25919 |
| CTCN_2352 | 15678 | CTCN_4720 | 25865 | TTCN_2731 | 15733 | GTCN_2688 | 25920 |
| CTCN_2353 | 15679 | ATCN_3178 | 25866 | TTCN_2732 | 15734 | CTCN_4746 | 25921 |
| GTCN_1443 | 15680 | CTCN_4721 | 25867 | TTCN_2733 | 15735 | TTCN_5079 | 25922 |
| GTCN_1444 | 15681 | CTCN_4722 | 25868 | CTCN_2372 | 15736 | CTCN_4747 | 25923 |
| ATCN_1660 | 15682 | GTCN_2683 | 25869 | CTCN_2373 | 15737 | CTCN_4748 | 25924 |
| GTCN_1445 | 15683 | TTCN_5066 | 25870 | ATCN_1666 | 15738 | TTCN_5080 | 25925 |
| CTCN_2354 | 15684 | TTCN_5067 | 25871 | ATCN_1667 | 15739 | TTCN_5081 | 25926 |
| TTCN_2717 | 15685 | TTCN_5068 | 25872 | CTCN_2374 | 15740 | CTCN_4749 | 25927 |
| CTCN_2355 | 15686 | ATCN_3179 | 25873 | CTCN_2375 | 15741 | CTCN_4750 | 25928 |
| CTCN_2356 | 15687 | TTCN_5069 | 25874 | CTCN_2376 | 15742 | GTCN_2689 | 25929 |
| GTCN_1446 | 15688 | ATCN_3180 | 25875 | CTCN_2377 | 15743 | CTCN_4751 | 25930 |
| ATCN_1661 | 15689 | TTCN_5070 | 25876 | GTCN_1458 | 15744 | GTCN_2690 | 25931 |
| TTCN_2718 | 15690 | ATCN_3181 | 25877 | GTCN_1459 | 15745 | TTCN_5082 | 25932 |
| GTCN_1447 | 15691 | TTCN_5071 | 25878 | TTCN_2734 | 15746 | ATCN_3189 | 25933 |
| TTCN_2719 | 15692 | ATCN_3182 | 25879 | TTCN_2735 | 15747 | ATCN_3190 | 25934 |
| TTCN_2720 | 15693 | CTCN_4723 | 25880 | CTCN_2378 | 15748 | TTCN_5083 | 25935 |
| ATCN_1662 | 15694 | GTCN_2684 | 25881 | TTCN_2736 | 15749 | ATCN_3191 | 25936 |
| CTCN_2357 | 15695 | CTCN_4724 | 25882 | ATCN_1668 | 15750 | GTCN_2691 | 25937 |
| CTCN_2358 | 15696 | CTCN_4725 | 25883 | ATCN_1669 | 15751 | CTCN_4752 | 25938 |
| TTCN_2721 | 15697 | CTCN_4726 | 25884 | ATCN_1670 | 15752 | TTCN_5084 | 25939 |
| ATCN_1663 | 15698 | CTCN_4727 | 25885 | ATCN_1671 | 15753 | CTCN_4753 | 25940 |
| GTCN_1448 | 15699 | TTCN_5072 | 25886 | CTCN_2379 | 15754 | ATCN_3192 | 25941 |
| TTCN_2722 | 15700 | CTCN_4728 | 25887 | GTCN_1460 | 15755 | CTCN_4754 | 25942 |
| CTCN_2359 | 15701 | CTCN_4729 | 25888 | GTCN_1461 | 15756 | ATCN_3193 | 25943 |
| GTCN_1449 | 15702 | CTCN_4730 | 25889 | TTCN_2737 | 15757 | TTCN_5085 | 25944 |
| CTCN_2360 | 15703 | CTCN_4731 | 25890 | CTCN_2380 | 15758 | ATCN_3194 | 25945 |
| ATCN_1664 | 15704 | ATCN_3183 | 25891 | GTCN_1462 | 15759 | CTCN_4755 | 25946 |
| CTCN_2361 | 15705 | CTCN_4732 | 25892 | CTCN_2381 | 15760 | ATCN_3195 | 25947 |
| GTCN_1450 | 15706 | ATCN_3184 | 25893 | CTCN_2382 | 15761 | TTCN_5086 | 25948 |
| TTCN_2723 | 15707 | TTCN_5073 | 25894 | TTCN_2738 | 15762 | TTCN_5087 | 25949 |
| GTCN_1451 | 15708 | CTCN_4733 | 25895 | CTCN_2383 | 15763 | ATCN_3196 | 25950 |
| CTCN_2362 | 15709 | GTCN_2685 | 25896 | ATCN_1672 | 15764 | ATCN_3197 | 25951 |
| TTCN_2724 | 15710 | CTCN_4734 | 25897 | TTCN_2739 | 15765 | CTCN_4756 | 25952 |
| GTCN_1452 | 15711 | CTCN_4735 | 25898 | TTCN_2740 | 15766 | TTCN_5088 | 25953 |
| TTCN_2725 | 15712 | TTCN_5074 | 25899 | CTCN_2384 | 15767 | CTCN_4757 | 25954 |
| TTCN_2726 | 15713 | CTCN_4736 | 25900 | TTCN_2741 | 15768 | TTCN_5089 | 25955 |
| GTCN_1453 | 15714 | CTCN_4737 | 25901 | TTCN_2742 | 15769 | CTCN_4758 | 25956 |
| GTCN_1454 | 15715 | TTCN_5075 | 25902 | TTCN_2743 | 15770 | TTCN_5090 | 25957 |
| CTCN_2363 | 15716 | CTCN_4738 | 25903 | TTCN_2744 | 15771 | TTCN_5091 | 25958 |

FIG. 36 (continued)

| | | | |
|---|---|---|---|
| TTCN_2745 | 15772 | CTCN_4759 | 25959 |
| TTCN_2746 | 15773 | GTCN_2692 | 25960 |
| CTCN_2385 | 15774 | TTCN_5092 | 25961 |
| TTCN_2747 | 15775 | ATCN_3198 | 25962 |
| GTCN_1463 | 15776 | CTCN_4760 | 25963 |
| CTCN_2386 | 15777 | GTCN_2693 | 25964 |
| CTCN_2387 | 15778 | ATCN_3199 | 25965 |
| TTCN_2748 | 15779 | TTCN_5093 | 25966 |
| TTCN_2749 | 15780 | GTCN_2694 | 25967 |
| CTCN_2388 | 15781 | TTCN_5094 | 25968 |
| TTCN_2750 | 15782 | GTCN_2695 | 25969 |
| CTCN_2389 | 15783 | TTCN_5095 | 25970 |
| GTCN_1464 | 15784 | TTCN_5096 | 25971 |
| TTCN_2751 | 15785 | ATCN_3200 | 25972 |
| CTCN_2390 | 15786 | ATCN_3201 | 25973 |
| CTCN_2391 | 15787 | ATCN_3202 | 25974 |
| CTCN_2392 | 15788 | CTCN_4761 | 25975 |
| ATCN_1673 | 15789 | TTCN_5097 | 25976 |
| TTCN_2752 | 15790 | ATCN_3203 | 25977 |
| CTCN_2393 | 15791 | CTCN_4762 | 25978 |
| ATCN_1674 | 15792 | CTCN_4763 | 25979 |
| ATCN_1675 | 15793 | GTCN_2696 | 25980 |
| TTCN_2753 | 15794 | CTCN_4764 | 25981 |
| TTCN_2754 | 15795 | ATCN_3204 | 25982 |
| CTCN_2394 | 15796 | CTCN_4765 | 25983 |
| GTCN_1465 | 15797 | CTCN_4766 | 25984 |
| TTCN_2755 | 15798 | TTCN_5098 | 25985 |
| GTCN_1466 | 15799 | ATCN_3205 | 25986 |
| TTCN_2756 | 15800 | ATCN_3206 | 25987 |
| CTCN_2395 | 15801 | TTCN_5099 | 25988 |
| TTCN_2757 | 15802 | CTCN_4767 | 25989 |
| CTCN_2396 | 15803 | CTCN_4768 | 25990 |
| ATCN_1676 | 15804 | TTCN_5100 | 25991 |
| CTCN_2397 | 15805 | GTCN_2697 | 25992 |
| ATCN_1677 | 15806 | GTCN_2698 | 25993 |
| ATCN_1678 | 15807 | TTCN_5101 | 25994 |
| CTCN_2398 | 15808 | TTCN_5102 | 25995 |
| TTCN_2758 | 15809 | ATCN_3207 | 25996 |
| GTCN_1467 | 15810 | ATCN_3208 | 25997 |
| TTCN_2759 | 15811 | ATCN_3209 | 25998 |
| GTCN_1468 | 15812 | CTCN_4769 | 25999 |
| CTCN_2399 | 15813 | CTCN_4770 | 26000 |
| CTCN_2400 | 15814 | TTCN_5103 | 26001 |
| TTCN_2760 | 15815 | CTCN_4771 | 26002 |
| GTCN_1469 | 15816 | TTCN_5104 | 26003 |
| ATCN_1679 | 15817 | ATCN_3210 | 26004 |
| ATCN_1680 | 15818 | TTCN_5105 | 26005 |
| ATCN_1681 | 15819 | CTCN_4772 | 26006 |
| CTCN_2401 | 15820 | GTCN_2699 | 26007 |
| CTCN_2402 | 15821 | TTCN_5106 | 26008 |
| TTCN_2761 | 15822 | ATCN_3211 | 26009 |
| CTCN_2403 | 15823 | TTCN_5107 | 26010 |
| GTCN_1470 | 15824 | ATCN_3212 | 26011 |
| CTCN_2404 | 15825 | TTCN_5108 | 26012 |
| GTCN_1471 | 15826 | ATCN_3213 | 26013 |

| | | | |
|---|---|---|---|
| ATCN_1682 | 15827 | CTCN_4773 | 26014 |
| TTCN_2762 | 15828 | TTCN_5109 | 26015 |
| GTCN_1472 | 15829 | GTCN_2700 | 26016 |
| CTCN_2405 | 15830 | ATCN_3214 | 26017 |
| GTCN_1473 | 15831 | CTCN_4774 | 26018 |
| TTCN_2763 | 15832 | GTCN_2701 | 26019 |
| CTCN_2406 | 15833 | CTCN_4775 | 26020 |
| TTCN_2764 | 15834 | CTCN_4776 | 26021 |
| ATCN_1683 | 15835 | CTCN_4777 | 26022 |
| ATCN_1684 | 15836 | TTCN_5110 | 26023 |
| GTCN_1474 | 15837 | CTCN_4778 | 26024 |
| ATCN_1685 | 15838 | ATCN_3215 | 26025 |
| GTCN_1475 | 15839 | TTCN_5111 | 26026 |
| TTCN_2765 | 15840 | GTCN_2702 | 26027 |
| TTCN_2766 | 15841 | TTCN_5112 | 26028 |
| ATCN_1686 | 15842 | CTCN_4779 | 26029 |
| TTCN_2767 | 15843 | CTCN_4780 | 26030 |
| CTCN_2407 | 15844 | GTCN_2703 | 26031 |
| TTCN_2768 | 15845 | GTCN_2704 | 26032 |
| TTCN_2769 | 15846 | TTCN_5113 | 26033 |
| TTCN_2770 | 15847 | CTCN_4781 | 26034 |
| TTCN_2771 | 15848 | CTCN_4782 | 26035 |
| TTCN_2772 | 15849 | TTCN_5114 | 26036 |
| ATCN_1687 | 15850 | TTCN_5115 | 26037 |
| TTCN_2773 | 15851 | ATCN_3216 | 26038 |
| CTCN_2408 | 15852 | ATCN_3217 | 26039 |
| CTCN_2409 | 15853 | TTCN_5116 | 26040 |
| TTCN_2774 | 15854 | CTCN_4783 | 26041 |
| GTCN_1476 | 15855 | CTCN_4784 | 26042 |
| TTCN_2775 | 15856 | GTCN_2705 | 26043 |
| GTCN_1477 | 15857 | ATCN_3218 | 26044 |
| TTCN_2776 | 15858 | TTCN_5117 | 26045 |
| CTCN_2410 | 15859 | GTCN_2706 | 26046 |
| ATCN_1688 | 15860 | TTCN_5118 | 26047 |
| TTCN_2777 | 15861 | TTCN_5119 | 26048 |
| CTCN_2411 | 15862 | CTCN_4785 | 26049 |
| GTCN_1478 | 15863 | CTCN_4786 | 26050 |
| TTCN_2778 | 15864 | CTCN_4787 | 26051 |
| TTCN_2779 | 15865 | GTCN_2707 | 26052 |
| GTCN_1479 | 15866 | CTCN_4788 | 26053 |
| CTCN_2412 | 15867 | GTCN_2708 | 26054 |
| TTCN_2780 | 15868 | CTCN_4789 | 26055 |
| ATCN_1689 | 15869 | CTCN_4790 | 26056 |
| TTCN_2781 | 15870 | ATCN_3219 | 26057 |
| CTCN_2413 | 15871 | TTCN_5120 | 26058 |
| CTCN_2414 | 15872 | TTCN_5121 | 26059 |
| TTCN_2782 | 15873 | TTCN_5122 | 26060 |
| TTCN_2783 | 15874 | GTCN_2709 | 26061 |
| ATCN_1690 | 15875 | CTCN_4791 | 26062 |
| TTCN_2784 | 15876 | ATCN_3220 | 26063 |
| TTCN_2785 | 15877 | TTCN_5123 | 26064 |
| TTCN_2786 | 15878 | TTCN_5124 | 26065 |
| CTCN_2415 | 15879 | GTCN_2710 | 26066 |
| ATCN_1691 | 15880 | CTCN_4792 | 26067 |
| GTCN_1480 | 15881 | GTCN_2711 | 26068 |

FIG. 36 (continued)

| | | | |
|---|---|---|---|
| CTCN_2416 | 15882 | TTCN_5125 | 26069 |
| TTCN_2787 | 15883 | ATCN_3221 | 26070 |
| TTCN_2788 | 15884 | CTCN_4793 | 26071 |
| CTCN_2417 | 15885 | GTCN_2712 | 26072 |
| CTCN_2418 | 15886 | CTCN_4794 | 26073 |
| TTCN_2789 | 15887 | TTCN_5126 | 26074 |
| ATCN_1692 | 15888 | TTCN_5127 | 26075 |
| ATCN_1693 | 15889 | ATCN_3222 | 26076 |
| GTCN_1481 | 15890 | TTCN_5128 | 26077 |
| CTCN_2419 | 15891 | TTCN_5129 | 26078 |
| TTCN_2790 | 15892 | ATCN_3223 | 26079 |
| CTCN_2420 | 15893 | ATCN_3224 | 26080 |
| CTCN_2421 | 15894 | ATCN_3225 | 26081 |
| CTCN_2422 | 15895 | ATCN_3226 | 26082 |
| TTCN_2791 | 15896 | GTCN_2713 | 26083 |
| TTCN_2792 | 15897 | GTCN_2714 | 26084 |
| CTCN_2423 | 15898 | ATCN_3227 | 26085 |
| TTCN_2793 | 15899 | ATCN_3228 | 26086 |
| ATCN_1694 | 15900 | TTCN_5130 | 26087 |
| ATCN_1695 | 15901 | TTCN_5131 | 26088 |
| TTCN_2794 | 15902 | ATCN_3229 | 26089 |
| ATCN_1696 | 15903 | ATCN_3230 | 26090 |
| TTCN_2795 | 15904 | TTCN_5132 | 26091 |
| TTCN_2796 | 15905 | GTCN_2715 | 26092 |
| GTCN_1482 | 15906 | CTCN_4795 | 26093 |
| CTCN_2424 | 15907 | GTCN_2716 | 26094 |
| CTCN_2425 | 15908 | CTCN_4796 | 26095 |
| CTCN_2426 | 15909 | TTCN_5133 | 26096 |
| CTCN_2427 | 15910 | ATCN_3231 | 26097 |
| TTCN_2797 | 15911 | GTCN_2717 | 26098 |
| ATCN_1697 | 15912 | CTCN_4797 | 26099 |
| ATCN_1698 | 15913 | CTCN_4798 | 26100 |
| CTCN_2428 | 15914 | CTCN_4799 | 26101 |
| CTCN_2429 | 15915 | TTCN_5134 | 26102 |
| CTCN_2430 | 15916 | GTCN_2718 | 26103 |
| CTCN_2431 | 15917 | GTCN_2719 | 26104 |
| ATCN_1699 | 15918 | CTCN_4800 | 26105 |
| TTCN_2798 | 15919 | ATCN_3232 | 26106 |
| GTCN_1483 | 15920 | CTCN_4801 | 26107 |
| TTCN_2799 | 15921 | ATCN_3233 | 26108 |
| ATCN_1700 | 15922 | CTCN_4802 | 26109 |
| TTCN_2800 | 15923 | TTCN_5135 | 26110 |
| TTCN_2801 | 15924 | TTCN_5136 | 26111 |
| ATCN_1701 | 15925 | CTCN_4803 | 26112 |
| CTCN_2432 | 15926 | CTCN_4804 | 26113 |
| ATCN_1702 | 15927 | TTCN_5137 | 26114 |
| TTCN_2802 | 15928 | ATCN_3234 | 26115 |
| ATCN_1703 | 15929 | CTCN_4805 | 26116 |
| CTCN_2433 | 15930 | CTCN_4806 | 26117 |
| TTCN_2803 | 15931 | TTCN_5138 | 26118 |
| ATCN_1704 | 15932 | CTCN_4807 | 26119 |
| GTCN_1484 | 15933 | CTCN_4808 | 26120 |
| ATCN_1705 | 15934 | CTCN_4809 | 26121 |
| TTCN_2804 | 15935 | CTCN_4810 | 26122 |
| ATCN_1706 | 15936 | CTCN_4811 | 26123 |

| | | | |
|---|---|---|---|
| CTCN_2434 | 15937 | ATCN_3235 | 26124 |
| GTCN_1485 | 15938 | ATCN_3236 | 26125 |
| CTCN_2435 | 15939 | TTCN_5139 | 26126 |
| GTCN_1486 | 15940 | TTCN_5140 | 26127 |
| CTCN_2436 | 15941 | GTCN_2720 | 26128 |
| CTCN_2437 | 15942 | TTCN_5141 | 26129 |
| GTCN_1487 | 15943 | ATCN_3237 | 26130 |
| CTCN_2438 | 15944 | TTCN_5142 | 26131 |
| ATCN_1707 | 15945 | TTCN_5143 | 26132 |
| ATCN_1708 | 15946 | GTCN_2721 | 26133 |
| CTCN_2439 | 15947 | TTCN_5144 | 26134 |
| CTCN_2440 | 15948 | ATCN_3238 | 26135 |
| CTCN_2441 | 15949 | ATCN_3239 | 26136 |
| CTCN_2442 | 15950 | TTCN_5145 | 26137 |
| TTCN_2805 | 15951 | TTCN_5146 | 26138 |
| TTCN_2806 | 15952 | TTCN_5147 | 26139 |
| CTCN_2443 | 15953 | TTCN_5148 | 26140 |
| CTCN_2444 | 15954 | ATCN_3240 | 26141 |
| CTCN_2445 | 15955 | TTCN_5149 | 26142 |
| GTCN_1488 | 15956 | CTCN_4812 | 26143 |
| CTCN_2446 | 15957 | CTCN_4813 | 26144 |
| GTCN_1489 | 15958 | CTCN_4814 | 26145 |
| CTCN_2447 | 15959 | CTCN_4815 | 26146 |
| TTCN_2807 | 15960 | ATCN_3241 | 26147 |
| ATCN_1709 | 15961 | CTCN_4816 | 26148 |
| GTCN_1490 | 15962 | GTCN_2722 | 26149 |
| CTCN_2448 | 15963 | GTCN_2723 | 26150 |
| ATCN_1710 | 15964 | ATCN_3242 | 26151 |
| ATCN_1711 | 15965 | TTCN_5150 | 26152 |
| CTCN_2449 | 15966 | CTCN_4817 | 26153 |
| GTCN_1491 | 15967 | CTCN_4818 | 26154 |
| CTCN_2450 | 15968 | ATCN_3243 | 26155 |
| ATCN_1712 | 15969 | ATCN_3244 | 26156 |
| ATCN_1713 | 15970 | GTCN_2724 | 26157 |
| CTCN_2451 | 15971 | CTCN_4819 | 26158 |
| CTCN_2452 | 15972 | ATCN_3245 | 26159 |
| ATCN_1714 | 15973 | CTCN_4820 | 26160 |
| CTCN_2453 | 15974 | CTCN_4821 | 26161 |
| CTCN_2454 | 15975 | CTCN_4822 | 26162 |
| ATCN_1715 | 15976 | TTCN_5151 | 26163 |
| ATCN_1716 | 15977 | CTCN_4823 | 26164 |
| TTCN_2808 | 15978 | TTCN_5152 | 26165 |
| CTCN_2455 | 15979 | CTCN_4824 | 26166 |
| TTCN_2809 | 15980 | CTCN_4825 | 26167 |
| GTCN_1492 | 15981 | TTCN_5153 | 26168 |
| CTCN_2456 | 15982 | CTCN_4826 | 26169 |
| TTCN_2810 | 15983 | CTCN_4827 | 26170 |
| ATCN_1717 | 15984 | GTCN_2725 | 26171 |
| GTCN_1493 | 15985 | CTCN_4828 | 26172 |
| CTCN_2457 | 15986 | CTCN_4829 | 26173 |
| CTCN_2458 | 15987 | GTCN_2726 | 26174 |
| TTCN_2811 | 15988 | CTCN_4830 | 26175 |
| TTCN_2812 | 15989 | CTCN_4831 | 26176 |
| CTCN_2459 | 15990 | GTCN_2727 | 26177 |
| TTCN_2813 | 15991 | TTCN_5154 | 26178 |

FIG. 36 (continued)

| | | | |
|---|---|---|---|
| TTCN_2814 | 15992 | CTCN_4832 | 26179 |
| GTCN_1494 | 15993 | CTCN_4833 | 26180 |
| TTCN_2815 | 15994 | GTCN_2728 | 26181 |
| CTCN_2460 | 15995 | TTCN_5155 | 26182 |
| ATCN_1718 | 15996 | TTCN_5156 | 26183 |
| ATCN_1719 | 15997 | GTCN_2729 | 26184 |
| TTCN_2816 | 15998 | GTCN_2730 | 26185 |
| TTCN_2817 | 15999 | TTCN_5157 | 26186 |
| CTCN_2461 | 16000 | TTCN_5158 | 26187 |
| GTCN_1495 | 16001 | CTCN_4834 | 26188 |
| CTCN_2462 | 16002 | GTCN_2731 | 26189 |
| CTCN_2463 | 16003 | TTCN_5159 | 26190 |
| CTCN_2464 | 16004 | TTCN_5160 | 26191 |
| TTCN_2818 | 16005 | TTCN_5161 | 26192 |
| TTCN_2819 | 16006 | CTCN_4835 | 26193 |
| CTCN_2465 | 16007 | CTCN_4836 | 26194 |
| CTCN_2466 | 16008 | TTCN_5162 | 26195 |
| GTCN_1496 | 16009 | TTCN_5163 | 26196 |
| CTCN_2467 | 16010 | ATCN_3246 | 26197 |
| TTCN_2820 | 16011 | CTCN_4837 | 26198 |
| TTCN_2821 | 16012 | ATCN_3247 | 26199 |
| TTCN_2822 | 16013 | CTCN_4838 | 26200 |
| CTCN_2468 | 16014 | ATCN_3248 | 26201 |
| CTCN_2469 | 16015 | TTCN_5164 | 26202 |
| TTCN_2823 | 16016 | ATCN_3249 | 26203 |
| CTCN_2470 | 16017 | CTCN_4839 | 26204 |
| ATCN_1720 | 16018 | GTCN_2732 | 26205 |
| TTCN_2824 | 16019 | TTCN_5165 | 26206 |
| TTCN_2825 | 16020 | GTCN_2733 | 26207 |
| CTCN_2471 | 16021 | CTCN_4840 | 26208 |
| TTCN_2826 | 16022 | GTCN_2734 | 26209 |
| CTCN_2472 | 16023 | TTCN_5166 | 26210 |
| TTCN_2827 | 16024 | CTCN_4841 | 26211 |
| TTCN_2828 | 16025 | GTCN_2735 | 26212 |
| ATCN_1721 | 16026 | CTCN_4842 | 26213 |
| ATCN_1722 | 16027 | CTCN_4843 | 26214 |
| ATCN_1723 | 16028 | TTCN_5167 | 26215 |
| TTCN_2829 | 16029 | GTCN_2736 | 26216 |
| ATCN_1724 | 16030 | GTCN_2737 | 26217 |
| TTCN_2830 | 16031 | ATCN_3250 | 26218 |
| CTCN_2473 | 16032 | CTCN_4844 | 26219 |
| GTCN_1497 | 16033 | ATCN_3251 | 26220 |
| ATCN_1725 | 16034 | TTCN_5168 | 26221 |
| ATCN_1726 | 16035 | TTCN_5169 | 26222 |
| TTCN_2831 | 16036 | CTCN_4845 | 26223 |
| TTCN_2832 | 16037 | CTCN_4846 | 26224 |
| ATCN_1727 | 16038 | GTCN_2738 | 26225 |
| CTCN_2474 | 16039 | GTCN_2739 | 26226 |
| GTCN_1498 | 16040 | ATCN_3252 | 26227 |
| TTCN_2833 | 16041 | CTCN_4847 | 26228 |
| ATCN_1728 | 16042 | GTCN_2740 | 26229 |
| GTCN_1499 | 16043 | GTCN_2741 | 26230 |
| TTCN_2834 | 16044 | GTCN_2742 | 26231 |
| CTCN_2475 | 16045 | CTCN_4848 | 26232 |
| ATCN_1729 | 16046 | ATCN_3253 | 26233 |

| | | | |
|---|---|---|---|
| ATCN_1730 | 16047 | GTCN_2743 | 26234 |
| CTCN_2476 | 16048 | GTCN_2744 | 26235 |
| CTCN_2477 | 16049 | GTCN_2745 | 26236 |
| TTCN_2835 | 16050 | CTCN_4849 | 26237 |
| TTCN_2836 | 16051 | ATCN_3254 | 26238 |
| TTCN_2837 | 16052 | GTCN_2746 | 26239 |
| CTCN_2478 | 16053 | CTCN_4850 | 26240 |
| ATCN_1731 | 16054 | TTCN_5170 | 26241 |
| CTCN_2479 | 16055 | TTCN_5171 | 26242 |
| TTCN_2838 | 16056 | ATCN_3255 | 26243 |
| TTCN_2839 | 16057 | TTCN_5172 | 26244 |
| TTCN_2840 | 16058 | CTCN_4851 | 26245 |
| TTCN_2841 | 16059 | CTCN_4852 | 26246 |
| CTCN_2480 | 16060 | CTCN_4853 | 26247 |
| TTCN_2842 | 16061 | CTCN_4854 | 26248 |
| TTCN_2843 | 16062 | CTCN_4855 | 26249 |
| GTCN_1500 | 16063 | TTCN_5173 | 26250 |
| GTCN_1501 | 16064 | CTCN_4856 | 26251 |
| CTCN_2481 | 16065 | CTCN_4857 | 26252 |
| GTCN_1502 | 16066 | TTCN_5174 | 26253 |
| ATCN_1732 | 16067 | CTCN_4858 | 26254 |
| CTCN_2482 | 16068 | CTCN_4859 | 26255 |
| TTCN_2844 | 16069 | TTCN_5175 | 26256 |
| GTCN_1503 | 16070 | TTCN_5176 | 26257 |
| CTCN_2483 | 16071 | GTCN_2747 | 26258 |
| TTCN_2845 | 16072 | TTCN_5177 | 26259 |
| TTCN_2846 | 16073 | CTCN_4860 | 26260 |
| TTCN_2847 | 16074 | ATCN_3256 | 26261 |
| CTCN_2484 | 16075 | GTCN_2748 | 26262 |
| CTCN_2485 | 16076 | CTCN_4861 | 26263 |
| CTCN_2486 | 16077 | TTCN_5178 | 26264 |
| TTCN_2848 | 16078 | CTCN_4862 | 26265 |
| ATCN_1733 | 16079 | CTCN_4863 | 26266 |
| ATCN_1734 | 16080 | CTCN_4864 | 26267 |
| GTCN_1504 | 16081 | ATCN_3257 | 26268 |
| CTCN_2487 | 16082 | CTCN_4865 | 26269 |
| CTCN_2488 | 16083 | CTCN_4866 | 26270 |
| CTCN_2489 | 16084 | TTCN_5179 | 26271 |
| TTCN_2849 | 16085 | GTCN_2749 | 26272 |
| CTCN_2490 | 16086 | ATCN_3258 | 26273 |
| CTCN_2491 | 16087 | TTCN_5180 | 26274 |
| TTCN_2850 | 16088 | GTCN_2750 | 26275 |
| ATCN_1735 | 16089 | CTCN_4867 | 26276 |
| GTCN_1505 | 16090 | ATCN_3259 | 26277 |
| TTCN_2851 | 16091 | ATCN_3260 | 26278 |
| TTCN_2852 | 16092 | GTCN_2751 | 26279 |
| ATCN_1736 | 16093 | TTCN_5181 | 26280 |
| TTCN_2853 | 16094 | CTCN_4868 | 26281 |
| CTCN_2492 | 16095 | ATCN_3261 | 26282 |
| TTCN_2854 | 16096 | GTCN_2752 | 26283 |
| GTCN_1506 | 16097 | ATCN_3262 | 26284 |
| ATCN_1737 | 16098 | GTCN_2753 | 26285 |
| ATCN_1738 | 16099 | TTCN_5182 | 26286 |
| GTCN_1507 | 16100 | CTCN_4869 | 26287 |
| GTCN_1508 | 16101 | TTCN_5183 | 26288 |

FIG. 36 (continued)

| | | | | | | | |
|---|---|---|---|---|---|---|---|
| CTCN_2493 | 16102 | TTCN_5184 | 26289 | CTCN_2509 | 16157 | GTCN_2762 | 26344 |
| GTCN_1509 | 16103 | CTCN_4870 | 26290 | TTCN_2867 | 16158 | TTCN_5207 | 26345 |
| CTCN_2494 | 16104 | TTCN_5185 | 26291 | CTCN_2510 | 16159 | ATCN_3270 | 26346 |
| ATCN_1739 | 16105 | CTCN_4871 | 26292 | ATCN_1755 | 16160 | TTCN_5208 | 26347 |
| ATCN_1740 | 16106 | CTCN_4872 | 26293 | TTCN_2868 | 16161 | CTCN_4887 | 26348 |
| ATCN_1741 | 16107 | TTCN_5186 | 26294 | ATCN_1756 | 16162 | ATCN_3271 | 26349 |
| ATCN_1742 | 16108 | ATCN_3263 | 26295 | ATCN_1757 | 16163 | TTCN_5209 | 26350 |
| CTCN_2495 | 16109 | TTCN_5187 | 26296 | ATCN_1758 | 16164 | TTCN_5210 | 26351 |
| TTCN_2855 | 16110 | TTCN_5188 | 26297 | CTCN_2511 | 16165 | CTCN_4888 | 26352 |
| CTCN_2496 | 16111 | CTCN_4873 | 26298 | CTCN_2512 | 16166 | CTCN_4889 | 26353 |
| ATCN_1743 | 16112 | GTCN_2754 | 26299 | CTCN_2513 | 16167 | TTCN_5211 | 26354 |
| ATCN_1744 | 16113 | CTCN_4874 | 26300 | CTCN_2514 | 16168 | TTCN_5212 | 26355 |
| ATCN_1745 | 16114 | TTCN_5189 | 26301 | TTCN_2869 | 16169 | CTCN_4890 | 26356 |
| ATCN_1746 | 16115 | TTCN_5190 | 26302 | TTCN_2870 | 16170 | GTCN_2763 | 26357 |
| TTCN_2856 | 16116 | CTCN_4875 | 26303 | CTCN_2515 | 16171 | TTCN_5213 | 26358 |
| CTCN_2497 | 16117 | ATCN_3264 | 26304 | ATCN_1759 | 16172 | CTCN_4891 | 26359 |
| GTCN_1510 | 16118 | ATCN_3265 | 26305 | ATCN_1760 | 16173 | GTCN_2764 | 26360 |
| TTCN_2857 | 16119 | CTCN_4876 | 26306 | TTCN_2871 | 16174 | CTCN_4892 | 26361 |
| GTCN_1511 | 16120 | GTCN_2755 | 26307 | TTCN_2872 | 16175 | TTCN_5214 | 26362 |
| ATCN_1747 | 16121 | ATCN_3266 | 26308 | ATCN_1761 | 16176 | GTCN_2765 | 26363 |
| CTCN_2498 | 16122 | TTCN_5191 | 26309 | CTCN_2516 | 16177 | CTCN_4893 | 26364 |
| CTCN_2499 | 16123 | TTCN_5192 | 26310 | TTCN_2873 | 16178 | TTCN_5215 | 26365 |
| CTCN_2500 | 16124 | TTCN_5193 | 26311 | ATCN_1762 | 16179 | TTCN_5216 | 26366 |
| GTCN_1512 | 16125 | ATCN_3267 | 26312 | ATCN_1763 | 16180 | TTCN_5217 | 26367 |
| ATCN_1748 | 16126 | TTCN_5194 | 26313 | ATCN_1764 | 16181 | GTCN_2766 | 26368 |
| ATCN_1749 | 16127 | GTCN_2756 | 26314 | ATCN_1765 | 16182 | TTCN_5218 | 26369 |
| CTCN_2501 | 16128 | TTCN_5195 | 26315 | GTCN_1520 | 16183 | TTCN_5219 | 26370 |
| CTCN_2502 | 16129 | TTCN_5196 | 26316 | GTCN_1521 | 16184 | TTCN_5220 | 26371 |
| ATCN_1750 | 16130 | GTCN_2757 | 26317 | CTCN_2517 | 16185 | ATCN_3272 | 26372 |
| TTCN_2858 | 16131 | GTCN_2758 | 26318 | TTCN_2874 | 16186 | ATCN_3273 | 26373 |
| TTCN_2859 | 16132 | CTCN_4877 | 26319 | CTCN_2518 | 16187 | CTCN_4894 | 26374 |
| ATCN_1751 | 16133 | CTCN_4878 | 26320 | TTCN_2875 | 16188 | CTCN_4895 | 26375 |
| ATCN_1752 | 16134 | CTCN_4879 | 26321 | GTCN_1522 | 16189 | CTCN_4896 | 26376 |
| TTCN_2860 | 16135 | GTCN_2759 | 26322 | ATCN_1766 | 16190 | CTCN_4897 | 26377 |
| TTCN_2861 | 16136 | CTCN_4880 | 26323 | CTCN_2519 | 16191 | ATCN_3274 | 26378 |
| GTCN_1513 | 16137 | CTCN_4881 | 26324 | TTCN_2876 | 16192 | TTCN_5221 | 26379 |
| GTCN_1514 | 16138 | CTCN_4882 | 26325 | TTCN_2877 | 16193 | GTCN_2767 | 26380 |
| CTCN_2503 | 16139 | ATCN_3268 | 26326 | ATCN_1767 | 16194 | GTCN_2768 | 26381 |
| GTCN_1515 | 16140 | ATCN_3269 | 26327 | GTCN_1523 | 16195 | GTCN_2769 | 26382 |
| GTCN_1516 | 16141 | CTCN_4883 | 26328 | CTCN_2520 | 16196 | GTCN_2770 | 26383 |
| GTCN_1517 | 16142 | TTCN_5197 | 26329 | CTCN_2521 | 16197 | CTCN_4898 | 26384 |
| CTCN_2504 | 16143 | TTCN_5198 | 26330 | CTCN_2522 | 16198 | GTCN_2771 | 26385 |
| CTCN_2505 | 16144 | TTCN_5199 | 26331 | GTCN_1524 | 16199 | TTCN_5222 | 26386 |
| ATCN_1753 | 16145 | TTCN_5200 | 26332 | TTCN_2878 | 16200 | GTCN_2772 | 26387 |
| GTCN_1518 | 16146 | TTCN_5201 | 26333 | CTCN_2523 | 16201 | TTCN_5223 | 26388 |
| ATCN_1754 | 16147 | TTCN_5202 | 26334 | ATCN_1768 | 16202 | TTCN_5224 | 26389 |
| CTCN_2506 | 16148 | TTCN_5203 | 26335 | TTCN_2879 | 16203 | CTCN_4899 | 26390 |
| TTCN_2862 | 16149 | CTCN_4884 | 26336 | TTCN_2880 | 16204 | CTCN_4900 | 26391 |
| TTCN_2863 | 16150 | TTCN_5204 | 26337 | TTCN_2881 | 16205 | GTCN_2773 | 26392 |
| CTCN_2507 | 16151 | TTCN_5205 | 26338 | ATCN_1769 | 16206 | GTCN_2774 | 26393 |
| TTCN_2864 | 16152 | CTCN_4885 | 26339 | ATCN_1770 | 16207 | TTCN_5225 | 26394 |
| GTCN_1519 | 16153 | GTCN_2760 | 26340 | ATCN_1771 | 16208 | TTCN_5226 | 26395 |
| CTCN_2508 | 16154 | TTCN_5206 | 26341 | CTCN_2524 | 16209 | ATCN_3275 | 26396 |
| TTCN_2865 | 16155 | CTCN_4886 | 26342 | CTCN_2525 | 16210 | ATCN_3276 | 26397 |
| TTCN_2866 | 16156 | GTCN_2761 | 26343 | ATCN_1772 | 16211 | CTCN_4901 | 26398 |

FIG. 36 (continued)

| | | | |
|---|---|---|---|
| ATCN_1773 | 16212 | CTCN_4902 | 26399 |
| TTCN_2882 | 16213 | TTCN_5227 | 26400 |
| GTCN_1525 | 16214 | TTCN_5228 | 26401 |
| CTCN_2526 | 16215 | ATCN_3277 | 26402 |
| ATCN_1774 | 16216 | ATCN_3278 | 26403 |
| ATCN_1775 | 16217 | GTCN_2775 | 26404 |
| TTCN_2883 | 16218 | TTCN_5229 | 26405 |
| ATCN_1776 | 16219 | ATCN_3279 | 26406 |
| CTCN_2527 | 16220 | TTCN_5230 | 26407 |
| CTCN_2528 | 16221 | GTCN_2776 | 26408 |
| TTCN_2884 | 16222 | CTCN_4903 | 26409 |
| TTCN_2885 | 16223 | GTCN_2777 | 26410 |
| TTCN_2886 | 16224 | GTCN_2778 | 26411 |
| CTCN_2529 | 16225 | ATCN_3280 | 26412 |
| GTCN_1526 | 16226 | TTCN_5231 | 26413 |
| CTCN_2530 | 16227 | TTCN_5232 | 26414 |
| TTCN_2887 | 16228 | CTCN_4904 | 26415 |
| ATCN_1777 | 16229 | ATCN_3281 | 26416 |
| GTCN_1527 | 16230 | TTCN_5233 | 26417 |
| TTCN_2888 | 16231 | CTCN_4905 | 26418 |
| CTCN_2531 | 16232 | GTCN_2779 | 26419 |
| TTCN_2889 | 16233 | GTCN_2780 | 26420 |
| ATCN_1778 | 16234 | CTCN_4906 | 26421 |
| TTCN_2890 | 16235 | ATCN_3282 | 26422 |
| CTCN_2532 | 16236 | TTCN_5234 | 26423 |
| TTCN_2891 | 16237 | ATCN_3283 | 26424 |
| CTCN_2533 | 16238 | GTCN_2781 | 26425 |
| TTCN_2892 | 16239 | CTCN_4907 | 26426 |
| GTCN_1528 | 16240 | CTCN_4908 | 26427 |
| TTCN_2893 | 16241 | CTCN_4909 | 26428 |
| ATCN_1779 | 16242 | CTCN_4910 | 26429 |
| TTCN_2894 | 16243 | TTCN_5235 | 26430 |
| ATCN_1780 | 16244 | ATCN_3284 | 26431 |
| CTCN_2534 | 16245 | TTCN_5236 | 26432 |
| CTCN_2535 | 16246 | CTCN_4911 | 26433 |
| CTCN_2536 | 16247 | CTCN_4912 | 26434 |
| CTCN_2537 | 16248 | CTCN_4913 | 26435 |
| ATCN_1781 | 16249 | GTCN_2782 | 26436 |
| ATCN_1782 | 16250 | ATCN_3285 | 26437 |
| ATCN_1783 | 16251 | ATCN_3286 | 26438 |
| CTCN_2538 | 16252 | GTCN_2783 | 26439 |
| GTCN_1529 | 16253 | TTCN_5237 | 26440 |
| GTCN_1530 | 16254 | TTCN_5238 | 26441 |
| ATCN_1784 | 16255 | TTCN_5239 | 26442 |
| TTCN_2895 | 16256 | ATCN_3287 | 26443 |
| ATCN_1785 | 16257 | ATCN_3288 | 26444 |
| CTCN_2539 | 16258 | CTCN_4914 | 26445 |
| GTCN_1531 | 16259 | TTCN_5240 | 26446 |
| ATCN_1786 | 16260 | ATCN_3289 | 26447 |
| ATCN_1787 | 16261 | GTCN_2784 | 26448 |
| GTCN_1532 | 16262 | GTCN_2785 | 26449 |
| CTCN_2540 | 16263 | TTCN_5241 | 26450 |
| CTCN_2541 | 16264 | TTCN_5242 | 26451 |
| GTCN_1533 | 16265 | CTCN_4915 | 26452 |
| TTCN_2896 | 16266 | ATCN_3290 | 26453 |

| | | | |
|---|---|---|---|
| GTCN_1534 | 16267 | CTCN_4916 | 26454 |
| TTCN_2897 | 16268 | CTCN_4917 | 26455 |
| GTCN_1535 | 16269 | TTCN_5243 | 26456 |
| ATCN_1788 | 16270 | GTCN_2786 | 26457 |
| TTCN_2898 | 16271 | ATCN_3291 | 26458 |
| TTCN_2899 | 16272 | ATCN_3292 | 26459 |
| TTCN_2900 | 16273 | TTCN_5244 | 26460 |
| TTCN_2901 | 16274 | CTCN_4918 | 26461 |
| CTCN_2542 | 16275 | ATCN_3293 | 26462 |
| ATCN_1789 | 16276 | ATCN_3294 | 26463 |
| TTCN_2902 | 16277 | CTCN_4919 | 26464 |
| CTCN_2543 | 16278 | ATCN_3295 | 26465 |
| TTCN_2903 | 16279 | TTCN_5245 | 26466 |
| ATCN_1790 | 16280 | CTCN_4920 | 26467 |
| TTCN_2904 | 16281 | ATCN_3296 | 26468 |
| GTCN_1536 | 16282 | ATCN_3297 | 26469 |
| TTCN_2905 | 16283 | ATCN_3298 | 26470 |
| CTCN_2544 | 16284 | CTCN_4921 | 26471 |
| CTCN_2545 | 16285 | TTCN_5246 | 26472 |
| CTCN_2546 | 16286 | GTCN_2787 | 26473 |
| ATCN_1791 | 16287 | TTCN_5247 | 26474 |
| ATCN_1792 | 16288 | CTCN_4922 | 26475 |
| TTCN_2906 | 16289 | ATCN_3299 | 26476 |
| TTCN_2907 | 16290 | TTCN_5248 | 26477 |
| GTCN_1537 | 16291 | GTCN_2788 | 26478 |
| CTCN_2547 | 16292 | TTCN_5249 | 26479 |
| TTCN_2908 | 16293 | ATCN_3300 | 26480 |
| TTCN_2909 | 16294 | ATCN_3301 | 26481 |
| GTCN_1538 | 16295 | ATCN_3302 | 26482 |
| ATCN_1793 | 16296 | CTCN_4923 | 26483 |
| TTCN_2910 | 16297 | GTCN_2789 | 26484 |
| ATCN_1794 | 16298 | TTCN_5250 | 26485 |
| ATCN_1795 | 16299 | ATCN_3303 | 26486 |
| ATCN_1796 | 16300 | CTCN_4924 | 26487 |
| TTCN_2911 | 16301 | ATCN_3304 | 26488 |
| ATCN_1797 | 16302 | CTCN_4925 | 26489 |
| CTCN_2548 | 16303 | GTCN_2790 | 26490 |
| ATCN_1798 | 16304 | ATCN_3305 | 26491 |
| ATCN_1799 | 16305 | TTCN_5251 | 26492 |
| TTCN_2912 | 16306 | ATCN_3306 | 26493 |
| TTCN_2913 | 16307 | ATCN_3307 | 26494 |
| ATCN_1800 | 16308 | ATCN_3308 | 26495 |
| TTCN_2914 | 16309 | GTCN_2791 | 26496 |
| GTCN_1539 | 16310 | CTCN_4926 | 26497 |
| ATCN_1801 | 16311 | ATCN_3309 | 26498 |
| TTCN_2915 | 16312 | ATCN_3310 | 26499 |
| TTCN_2916 | 16313 | ATCN_3311 | 26500 |
| CTCN_2549 | 16314 | CTCN_4927 | 26501 |
| TTCN_2917 | 16315 | CTCN_4928 | 26502 |
| TTCN_2918 | 16316 | CTCN_4929 | 26503 |
| TTCN_2919 | 16317 | ATCN_3312 | 26504 |
| ATCN_1802 | 16318 | TTCN_5252 | 26505 |
| ATCN_1803 | 16319 | CTCN_4930 | 26506 |
| TTCN_2920 | 16320 | TTCN_5253 | 26507 |
| CTCN_2550 | 16321 | ATCN_3313 | 26508 |

FIG. 36 (continued)

| | | | |
|---|---|---|---|
| TTCN_2921 | 16322 | TTCN_5254 | 26509 |
| TTCN_2922 | 16323 | TTCN_5255 | 26510 |
| CTCN_2551 | 16324 | TTCN_5256 | 26511 |
| TTCN_2923 | 16325 | TTCN_5257 | 26512 |
| TTCN_2924 | 16326 | CTCN_4931 | 26513 |
| TTCN_2925 | 16327 | CTCN_4932 | 26514 |
| GTCN_1540 | 16328 | CTCN_4933 | 26515 |
| TTCN_2926 | 16329 | TTCN_5258 | 26516 |
| TTCN_2927 | 16330 | TTCN_5259 | 26517 |
| TTCN_2928 | 16331 | TTCN_5260 | 26518 |
| TTCN_2929 | 16332 | ATCN_3314 | 26519 |
| TTCN_2930 | 16333 | ATCN_3315 | 26520 |
| CTCN_2552 | 16334 | GTCN_2792 | 26521 |
| GTCN_1541 | 16335 | GTCN_2793 | 26522 |
| ATCN_1804 | 16336 | CTCN_4934 | 26523 |
| CTCN_2553 | 16337 | TTCN_5261 | 26524 |
| GTCN_1542 | 16338 | GTCN_2794 | 26525 |
| TTCN_2931 | 16339 | GTCN_2795 | 26526 |
| TTCN_2932 | 16340 | ATCN_3316 | 26527 |
| CTCN_2554 | 16341 | CTCN_4935 | 26528 |
| TTCN_2933 | 16342 | ATCN_3317 | 26529 |
| GTCN_1543 | 16343 | TTCN_5262 | 26530 |
| TTCN_2934 | 16344 | CTCN_4936 | 26531 |
| CTCN_2555 | 16345 | GTCN_2796 | 26532 |
| CTCN_2556 | 16346 | GTCN_2797 | 26533 |
| GTCN_1544 | 16347 | CTCN_4937 | 26534 |
| CTCN_2557 | 16348 | GTCN_2798 | 26535 |
| CTCN_2558 | 16349 | CTCN_4938 | 26536 |
| ATCN_1805 | 16350 | GTCN_2799 | 26537 |
| CTCN_2559 | 16351 | TTCN_5263 | 26538 |
| TTCN_2935 | 16352 | ATCN_3318 | 26539 |
| TTCN_2936 | 16353 | CTCN_4939 | 26540 |
| CTCN_2560 | 16354 | ATCN_3319 | 26541 |
| GTCN_1545 | 16355 | CTCN_4940 | 26542 |
| TTCN_2937 | 16356 | TTCN_5264 | 26543 |
| ATCN_1806 | 16357 | TTCN_5265 | 26544 |
| TTCN_2938 | 16358 | ATCN_3320 | 26545 |
| ATCN_1807 | 16359 | ATCN_3321 | 26546 |
| TTCN_2939 | 16360 | TTCN_5266 | 26547 |
| GTCN_1546 | 16361 | GTCN_2800 | 26548 |
| TTCN_2940 | 16362 | CTCN_4941 | 26549 |
| TTCN_2941 | 16363 | ATCN_3322 | 26550 |
| ATCN_1808 | 16364 | ATCN_3323 | 26551 |
| GTCN_1547 | 16365 | GTCN_2801 | 26552 |
| TTCN_2942 | 16366 | ATCN_3324 | 26553 |
| TTCN_2943 | 16367 | TTCN_5267 | 26554 |
| ATCN_1809 | 16368 | ATCN_3325 | 26555 |
| TTCN_2944 | 16369 | TTCN_5268 | 26556 |
| TTCN_2945 | 16370 | CTCN_4942 | 26557 |
| CTCN_2561 | 16371 | CTCN_4943 | 26558 |
| TTCN_2946 | 16372 | CTCN_4944 | 26559 |
| GTCN_1548 | 16373 | TTCN_5269 | 26560 |
| CTCN_2562 | 16374 | CTCN_4945 | 26561 |
| GTCN_1549 | 16375 | CTCN_4946 | 26562 |
| ATCN_1810 | 16376 | CTCN_4947 | 26563 |

| | | | |
|---|---|---|---|
| CTCN_2563 | 16377 | CTCN_4948 | 26564 |
| ATCN_1811 | 16378 | CTCN_4949 | 26565 |
| TTCN_2947 | 16379 | ATCN_3326 | 26566 |
| ATCN_1812 | 16380 | TTCN_5270 | 26567 |
| GTCN_1550 | 16381 | TTCN_5271 | 26568 |
| CTCN_2564 | 16382 | CTCN_4950 | 26569 |
| CTCN_2565 | 16383 | ATCN_3327 | 26570 |
| GTCN_1551 | 16384 | ATCN_3328 | 26571 |
| CTCN_2566 | 16385 | GTCN_2802 | 26572 |
| TTCN_2948 | 16386 | ATCN_3329 | 26573 |
| CTCN_2567 | 16387 | ATCN_3330 | 26574 |
| GTCN_1552 | 16388 | ATCN_3331 | 26575 |
| CTCN_2568 | 16389 | ATCN_3332 | 26576 |
| CTCN_2569 | 16390 | ATCN_3333 | 26577 |
| TTCN_2949 | 16391 | GTCN_2803 | 26578 |
| CTCN_2570 | 16392 | TTCN_5272 | 26579 |
| ATCN_1813 | 16393 | TTCN_5273 | 26580 |
| ATCN_1814 | 16394 | TTCN_5274 | 26581 |
| ATCN_1815 | 16395 | GTCN_2804 | 26582 |
| TTCN_2950 | 16396 | GTCN_2805 | 26583 |
| TTCN_2951 | 16397 | CTCN_4951 | 26584 |
| TTCN_2952 | 16398 | GTCN_2806 | 26585 |
| TTCN_2953 | 16399 | CTCN_4952 | 26586 |
| ATCN_1816 | 16400 | CTCN_4953 | 26587 |
| ATCN_1817 | 16401 | TTCN_5275 | 26588 |
| TTCN_2954 | 16402 | TTCN_5276 | 26589 |
| GTCN_1553 | 16403 | ATCN_3334 | 26590 |
| GTCN_1554 | 16404 | CTCN_4954 | 26591 |
| TTCN_2955 | 16405 | TTCN_5277 | 26592 |
| ATCN_1818 | 16406 | TTCN_5278 | 26593 |
| ATCN_1819 | 16407 | GTCN_2807 | 26594 |
| TTCN_2956 | 16408 | ATCN_3335 | 26595 |
| TTCN_2957 | 16409 | ATCN_3336 | 26596 |
| TTCN_2958 | 16410 | GTCN_2808 | 26597 |
| ATCN_1820 | 16411 | ATCN_3337 | 26598 |
| ATCN_1821 | 16412 | ATCN_3338 | 26599 |
| CTCN_2571 | 16413 | ATCN_3339 | 26600 |
| TTCN_2959 | 16414 | CTCN_4955 | 26601 |
| ATCN_1822 | 16415 | TTCN_5279 | 26602 |
| TTCN_2960 | 16416 | CTCN_4956 | 26603 |
| ATCN_1823 | 16417 | TTCN_5280 | 26604 |
| GTCN_1555 | 16418 | GTCN_2809 | 26605 |
| GTCN_1556 | 16419 | TTCN_5281 | 26606 |
| CTCN_2572 | 16420 | CTCN_4957 | 26607 |
| CTCN_2573 | 16421 | TTCN_5282 | 26608 |
| TTCN_2961 | 16422 | CTCN_4958 | 26609 |
| TTCN_2962 | 16423 | CTCN_4959 | 26610 |
| TTCN_2963 | 16424 | TTCN_5283 | 26611 |
| ATCN_1824 | 16425 | CTCN_4960 | 26612 |
| CTCN_2574 | 16426 | ATCN_3340 | 26613 |
| GTCN_1557 | 16427 | ATCN_3341 | 26614 |
| TTCN_2964 | 16428 | ATCN_3342 | 26615 |
| TTCN_2965 | 16429 | CTCN_4961 | 26616 |
| ATCN_1825 | 16430 | TTCN_5284 | 26617 |
| CTCN_2575 | 16431 | TTCN_5285 | 26618 |

FIG. 36 (continued)

| | | | |
|---|---|---|---|
| TTCN_2966 | 16432 | TTCN_5286 | 26619 |
| ATCN_1826 | 16433 | TTCN_5287 | 26620 |
| CTCN_2576 | 16434 | CTCN_4962 | 26621 |
| GTCN_1558 | 16435 | CTCN_4963 | 26622 |
| TTCN_2967 | 16436 | CTCN_4964 | 26623 |
| ATCN_1827 | 16437 | ATCN_3343 | 26624 |
| TTCN_2968 | 16438 | TTCN_5288 | 26625 |
| GTCN_1559 | 16439 | GTCN_2810 | 26626 |
| GTCN_1560 | 16440 | GTCN_2811 | 26627 |
| TTCN_2969 | 16441 | TTCN_5289 | 26628 |
| ATCN_1828 | 16442 | TTCN_5290 | 26629 |
| ATCN_1829 | 16443 | CTCN_4965 | 26630 |
| ATCN_1830 | 16444 | ATCN_3344 | 26631 |
| ATCN_1831 | 16445 | TTCN_5291 | 26632 |
| TTCN_2970 | 16446 | ATCN_3345 | 26633 |
| CTCN_2577 | 16447 | TTCN_5292 | 26634 |
| GTCN_1561 | 16448 | CTCN_4966 | 26635 |
| GTCN_1562 | 16449 | GTCN_2812 | 26636 |
| GTCN_1563 | 16450 | GTCN_2813 | 26637 |
| GTCN_1564 | 16451 | GTCN_2814 | 26638 |
| CTCN_2578 | 16452 | TTCN_5293 | 26639 |
| CTCN_2579 | 16453 | TTCN_5294 | 26640 |
| TTCN_2971 | 16454 | ATCN_3346 | 26641 |
| ATCN_1832 | 16455 | TTCN_5295 | 26642 |
| CTCN_2580 | 16456 | TTCN_5296 | 26643 |
| GTCN_1565 | 16457 | ATCN_3347 | 26644 |
| TTCN_2972 | 16458 | GTCN_2815 | 26645 |
| GTCN_1566 | 16459 | CTCN_4967 | 26646 |
| CTCN_2581 | 16460 | TTCN_5297 | 26647 |
| TTCN_2973 | 16461 | GTCN_2816 | 26648 |
| ATCN_1833 | 16462 | CTCN_4968 | 26649 |
| CTCN_2582 | 16463 | CTCN_4969 | 26650 |
| CTCN_2583 | 16464 | CTCN_4970 | 26651 |
| CTCN_2584 | 16465 | TTCN_5298 | 26652 |
| CTCN_2585 | 16466 | TTCN_5299 | 26653 |
| TTCN_2974 | 16467 | GTCN_2817 | 26654 |
| ATCN_1834 | 16468 | TTCN_5300 | 26655 |
| GTCN_1567 | 16469 | ATCN_3348 | 26656 |
| TTCN_2975 | 16470 | ATCN_3349 | 26657 |
| TTCN_2976 | 16471 | GTCN_2818 | 26658 |
| ATCN_1835 | 16472 | ATCN_3350 | 26659 |
| CTCN_2586 | 16473 | ATCN_3351 | 26660 |
| CTCN_2587 | 16474 | ATCN_3352 | 26661 |
| TTCN_2977 | 16475 | TTCN_5301 | 26662 |
| TTCN_2978 | 16476 | GTCN_2819 | 26663 |
| TTCN_2979 | 16477 | CTCN_4971 | 26664 |
| CTCN_2588 | 16478 | TTCN_5302 | 26665 |
| ATCN_1836 | 16479 | TTCN_5303 | 26666 |
| TTCN_2980 | 16480 | TTCN_5304 | 26667 |
| TTCN_2981 | 16481 | TTCN_5305 | 26668 |
| CTCN_2589 | 16482 | ATCN_3353 | 26669 |
| TTCN_2982 | 16483 | ATCN_3354 | 26670 |
| CTCN_2590 | 16484 | CTCN_4972 | 26671 |
| CTCN_2591 | 16485 | ATCN_3355 | 26672 |
| ATCN_1837 | 16486 | GTCN_2820 | 26673 |

| | | | |
|---|---|---|---|
| ATCN_1838 | 16487 | ATCN_3356 | 26674 |
| ATCN_1839 | 16488 | ATCN_3357 | 26675 |
| CTCN_2592 | 16489 | TTCN_5306 | 26676 |
| GTCN_1568 | 16490 | TTCN_5307 | 26677 |
| ATCN_1840 | 16491 | GTCN_2821 | 26678 |
| ATCN_1841 | 16492 | ATCN_3358 | 26679 |
| ATCN_1842 | 16493 | TTCN_5308 | 26680 |
| ATCN_1843 | 16494 | TTCN_5309 | 26681 |
| CTCN_2593 | 16495 | TTCN_5310 | 26682 |
| CTCN_2594 | 16496 | TTCN_5311 | 26683 |
| ATCN_1844 | 16497 | ATCN_3359 | 26684 |
| ATCN_1845 | 16498 | TTCN_5312 | 26685 |
| ATCN_1846 | 16499 | CTCN_4973 | 26686 |
| CTCN_2595 | 16500 | TTCN_5313 | 26687 |
| CTCN_2596 | 16501 | TTCN_5314 | 26688 |
| ATCN_1847 | 16502 | ATCN_3360 | 26689 |
| CTCN_2597 | 16503 | CTCN_4974 | 26690 |
| TTCN_2983 | 16504 | GTCN_2822 | 26691 |
| CTCN_2598 | 16505 | CTCN_4975 | 26692 |
| TTCN_2984 | 16506 | TTCN_5315 | 26693 |
| ATCN_1848 | 16507 | TTCN_5316 | 26694 |
| ATCN_1849 | 16508 | TTCN_5317 | 26695 |
| CTCN_2599 | 16509 | TTCN_5318 | 26696 |
| TTCN_2985 | 16510 | ATCN_3361 | 26697 |
| TTCN_2986 | 16511 | TTCN_5319 | 26698 |
| TTCN_2987 | 16512 | TTCN_5320 | 26699 |
| TTCN_2988 | 16513 | ATCN_3362 | 26700 |
| ATCN_1850 | 16514 | CTCN_4976 | 26701 |
| ATCN_1851 | 16515 | TTCN_5321 | 26702 |
| TTCN_2989 | 16516 | TTCN_5322 | 26703 |
| ATCN_1852 | 16517 | CTCN_4977 | 26704 |
| ATCN_1853 | 16518 | TTCN_5323 | 26705 |
| TTCN_2990 | 16519 | TTCN_5324 | 26706 |
| TTCN_2991 | 16520 | GTCN_2823 | 26707 |
| ATCN_1854 | 16521 | GTCN_2824 | 26708 |
| CTCN_2600 | 16522 | TTCN_5325 | 26709 |
| TTCN_2992 | 16523 | TTCN_5326 | 26710 |
| GTCN_1569 | 16524 | CTCN_4978 | 26711 |
| TTCN_2993 | 16525 | ATCN_3363 | 26712 |
| GTCN_1570 | 16526 | ATCN_3364 | 26713 |
| CTCN_2601 | 16527 | TTCN_5327 | 26714 |
| CTCN_2602 | 16528 | ATCN_3365 | 26715 |
| GTCN_1571 | 16529 | CTCN_4979 | 26716 |
| ATCN_1855 | 16530 | TTCN_5328 | 26717 |
| TTCN_2994 | 16531 | ATCN_3366 | 26718 |
| ATCN_1856 | 16532 | ATCN_3367 | 26719 |
| TTCN_2995 | 16533 | TTCN_5329 | 26720 |
| ATCN_1857 | 16534 | TTCN_5330 | 26721 |
| CTCN_2603 | 16535 | CTCN_4980 | 26722 |
| ATCN_1858 | 16536 | TTCN_5331 | 26723 |
| TTCN_2996 | 16537 | TTCN_5332 | 26724 |
| ATCN_1859 | 16538 | TTCN_5333 | 26725 |
| ATCN_1860 | 16539 | TTCN_5334 | 26726 |
| ATCN_1861 | 16540 | TTCN_5335 | 26727 |
| TTCN_2997 | 16541 | ATCN_3368 | 26728 |

FIG. 36 (continued)

| | | | |
|---|---|---|---|
| TTCN_2998 | 16542 | GTCN_2825 | 26729 |
| ATCN_1862 | 16543 | TTCN_5336 | 26730 |
| CTCN_2604 | 16544 | ATCN_3369 | 26731 |
| CTCN_2605 | 16545 | ATCN_3370 | 26732 |
| GTCN_1572 | 16546 | TTCN_5337 | 26733 |
| CTCN_2606 | 16547 | CTCN_4981 | 26734 |
| TTCN_2999 | 16548 | CTCN_4982 | 26735 |
| TTCN_3000 | 16549 | CTCN_4983 | 26736 |
| TTCN_3001 | 16550 | TTCN_5338 | 26737 |
| CTCN_2607 | 16551 | TTCN_5339 | 26738 |
| TTCN_3002 | 16552 | ATCN_3371 | 26739 |
| TTCN_3003 | 16553 | GTCN_2826 | 26740 |
| TTCN_3004 | 16554 | ATCN_3372 | 26741 |
| GTCN_1573 | 16555 | GTCN_2827 | 26742 |
| ATCN_1863 | 16556 | TTCN_5340 | 26743 |
| CTCN_2608 | 16557 | TTCN_5341 | 26744 |
| TTCN_3005 | 16558 | ATCN_3373 | 26745 |
| CTCN_2609 | 16559 | CTCN_4984 | 26746 |
| GTCN_1574 | 16560 | CTCN_4985 | 26747 |
| GTCN_1575 | 16561 | TTCN_5342 | 26748 |
| TTCN_3006 | 16562 | TTCN_5343 | 26749 |
| TTCN_3007 | 16563 | CTCN_4986 | 26750 |
| GTCN_1576 | 16564 | TTCN_5344 | 26751 |
| CTCN_2610 | 16565 | ATCN_3374 | 26752 |
| TTCN_3008 | 16566 | TTCN_5345 | 26753 |
| GTCN_1577 | 16567 | GTCN_2828 | 26754 |
| GTCN_1578 | 16568 | GTCN_2829 | 26755 |
| CTCN_2611 | 16569 | TTCN_5346 | 26756 |
| CTCN_2612 | 16570 | TTCN_5347 | 26757 |
| TTCN_3009 | 16571 | TTCN_5348 | 26758 |
| TTCN_3010 | 16572 | TTCN_5349 | 26759 |
| CTCN_2613 | 16573 | GTCN_2830 | 26760 |
| CTCN_2614 | 16574 | ATCN_3375 | 26761 |
| ATCN_1864 | 16575 | TTCN_5350 | 26762 |
| TTCN_3011 | 16576 | TTCN_5351 | 26763 |
| ATCN_1865 | 16577 | TTCN_5352 | 26764 |
| GTCN_1579 | 16578 | CTCN_4987 | 26765 |
| ATCN_1866 | 16579 | CTCN_4988 | 26766 |
| GTCN_1580 | 16580 | CTCN_4989 | 26767 |
| TTCN_3012 | 16581 | GTCN_2831 | 26768 |
| ATCN_1867 | 16582 | TTCN_5353 | 26769 |
| TTCN_3013 | 16583 | TTCN_5354 | 26770 |
| CTCN_2615 | 16584 | TTCN_5355 | 26771 |
| TTCN_3014 | 16585 | ATCN_3376 | 26772 |
| ATCN_1868 | 16586 | CTCN_4990 | 26773 |
| TTCN_3015 | 16587 | TTCN_5356 | 26774 |
| ATCN_1869 | 16588 | GTCN_2832 | 26775 |
| ATCN_1870 | 16589 | GTCN_2833 | 26776 |
| CTCN_2616 | 16590 | CTCN_4991 | 26777 |
| TTCN_3016 | 16591 | TTCN_5357 | 26778 |
| GTCN_1581 | 16592 | CTCN_4992 | 26779 |
| GTCN_1582 | 16593 | TTCN_5358 | 26780 |
| CTCN_2617 | 16594 | TTCN_5359 | 26781 |
| TTCN_3017 | 16595 | GTCN_2834 | 26782 |
| TTCN_3018 | 16596 | GTCN_2835 | 26783 |

| | | | |
|---|---|---|---|
| GTCN_1583 | 16597 | GTCN_2836 | 26784 |
| ATCN_1871 | 16598 | ATCN_3377 | 26785 |
| GTCN_1584 | 16599 | TTCN_5360 | 26786 |
| ATCN_1872 | 16600 | ATCN_3378 | 26787 |
| TTCN_3019 | 16601 | GTCN_2837 | 26788 |
| TTCN_3020 | 16602 | ATCN_3379 | 26789 |
| TTCN_3021 | 16603 | TTCN_5361 | 26790 |
| ATCN_1873 | 16604 | TTCN_5362 | 26791 |
| TTCN_3022 | 16605 | CTCN_4993 | 26792 |
| TTCN_3023 | 16606 | CTCN_4994 | 26793 |
| TTCN_3024 | 16607 | GTCN_2838 | 26794 |
| TTCN_3025 | 16608 | TTCN_5363 | 26795 |
| GTCN_1585 | 16609 | GTCN_2839 | 26796 |
| CTCN_2618 | 16610 | CTCN_4995 | 26797 |
| CTCN_2619 | 16611 | GTCN_2840 | 26798 |
| TTCN_3026 | 16612 | GTCN_2841 | 26799 |
| TTCN_3027 | 16613 | ATCN_3380 | 26800 |
| ATCN_1874 | 16614 | ATCN_3381 | 26801 |
| ATCN_1875 | 16615 | ATCN_3382 | 26802 |
| TTCN_3028 | 16616 | CTCN_4996 | 26803 |
| CTCN_2620 | 16617 | GTCN_2842 | 26804 |
| GTCN_1586 | 16618 | GTCN_2843 | 26805 |
| CTCN_2621 | 16619 | CTCN_4997 | 26806 |
| GTCN_1587 | 16620 | CTCN_4998 | 26807 |
| ATCN_1876 | 16621 | TTCN_5364 | 26808 |
| ATCN_1877 | 16622 | ATCN_3383 | 26809 |
| CTCN_2622 | 16623 | CTCN_4999 | 26810 |
| CTCN_2623 | 16624 | TTCN_5365 | 26811 |
| CTCN_2624 | 16625 | TTCN_5366 | 26812 |
| TTCN_3029 | 16626 | GTCN_2844 | 26813 |
| ATCN_1878 | 16627 | CTCN_5000 | 26814 |
| TTCN_3030 | 16628 | TTCN_5367 | 26815 |
| GTCN_1588 | 16629 | GTCN_2845 | 26816 |
| CTCN_2625 | 16630 | GTCN_2846 | 26817 |
| CTCN_2626 | 16631 | TTCN_5368 | 26818 |
| CTCN_2627 | 16632 | ATCN_3384 | 26819 |
| GTCN_1589 | 16633 | ATCN_3385 | 26820 |
| TTCN_3031 | 16634 | GTCN_2847 | 26821 |
| ATCN_1879 | 16635 | TTCN_5369 | 26822 |
| TTCN_3032 | 16636 | TTCN_5370 | 26823 |
| CTCN_2628 | 16637 | TTCN_5371 | 26824 |
| CTCN_2629 | 16638 | TTCN_5372 | 26825 |
| CTCN_2630 | 16639 | TTCN_5373 | 26826 |
| CTCN_2631 | 16640 | GTCN_2848 | 26827 |
| TTCN_3033 | 16641 | CTCN_5001 | 26828 |
| CTCN_2632 | 16642 | CTCN_5002 | 26829 |
| CTCN_2633 | 16643 | GTCN_2849 | 26830 |
| ATCN_1880 | 16644 | CTCN_5003 | 26831 |
| TTCN_3034 | 16645 | GTCN_2850 | 26832 |
| CTCN_2634 | 16646 | CTCN_5004 | 26833 |
| TTCN_3035 | 16647 | TTCN_5374 | 26834 |
| GTCN_1590 | 16648 | ATCN_3386 | 26835 |
| CTCN_2635 | 16649 | TTCN_5375 | 26836 |
| CTCN_2636 | 16650 | TTCN_5376 | 26837 |
| ATCN_1881 | 16651 | ATCN_3387 | 26838 |

FIG. 36 (continued)

| | | | |
|---|---|---|---|
| ATCN_1882 | 16652 | TTCN_5377 | 26839 |
| CTCN_2637 | 16653 | CTCN_5005 | 26840 |
| CTCN_2638 | 16654 | CTCN_5006 | 26841 |
| CTCN_2639 | 16655 | TTCN_5378 | 26842 |
| TTCN_3036 | 16656 | TTCN_5379 | 26843 |
| CTCN_2640 | 16657 | CTCN_5007 | 26844 |
| GTCN_1591 | 16658 | GTCN_2851 | 26845 |
| CTCN_2641 | 16659 | CTCN_5008 | 26846 |
| TTCN_3037 | 16660 | TTCN_5380 | 26847 |
| CTCN_2642 | 16661 | ATCN_3388 | 26848 |
| CTCN_2643 | 16662 | CTCN_5009 | 26849 |
| ATCN_1883 | 16663 | TTCN_5381 | 26850 |
| TTCN_3038 | 16664 | TTCN_5382 | 26851 |
| TTCN_3039 | 16665 | GTCN_2852 | 26852 |
| GTCN_1592 | 16666 | TTCN_5383 | 26853 |
| TTCN_3040 | 16667 | GTCN_2853 | 26854 |
| TTCN_3041 | 16668 | TTCN_5384 | 26855 |
| ATCN_1884 | 16669 | ATCN_3389 | 26856 |
| GTCN_1593 | 16670 | CTCN_5010 | 26857 |
| ATCN_1885 | 16671 | TTCN_5385 | 26858 |
| ATCN_1886 | 16672 | ATCN_3390 | 26859 |
| TTCN_3042 | 16673 | ATCN_3391 | 26860 |
| TTCN_3043 | 16674 | TTCN_5386 | 26861 |
| GTCN_1594 | 16675 | ATCN_3392 | 26862 |
| ATCN_1887 | 16676 | CTCN_5011 | 26863 |
| ATCN_1888 | 16677 | CTCN_5012 | 26864 |
| TTCN_3044 | 16678 | ATCN_3393 | 26865 |
| TTCN_3045 | 16679 | TTCN_5387 | 26866 |
| TTCN_3046 | 16680 | GTCN_2854 | 26867 |
| TTCN_3047 | 16681 | ATCN_3394 | 26868 |
| GTCN_1595 | 16682 | TTCN_5388 | 26869 |
| TTCN_3048 | 16683 | ATCN_3395 | 26870 |
| ATCN_1889 | 16684 | ATCN_3396 | 26871 |
| CTCN_2644 | 16685 | TTCN_5389 | 26872 |
| ATCN_1890 | 16686 | TTCN_5390 | 26873 |
| TTCN_3049 | 16687 | CTCN_5013 | 26874 |
| CTCN_2645 | 16688 | GTCN_2855 | 26875 |
| CTCN_2646 | 16689 | GTCN_2856 | 26876 |
| TTCN_3050 | 16690 | GTCN_2857 | 26877 |
| CTCN_2647 | 16691 | CTCN_5014 | 26878 |
| CTCN_2648 | 16692 | GTCN_2858 | 26879 |
| ATCN_1891 | 16693 | ATCN_3397 | 26880 |
| CTCN_2649 | 16694 | CTCN_5015 | 26881 |
| TTCN_3051 | 16695 | TTCN_5391 | 26882 |
| TTCN_3052 | 16696 | TTCN_5392 | 26883 |
| CTCN_2650 | 16697 | GTCN_2859 | 26884 |
| TTCN_3053 | 16698 | ATCN_3398 | 26885 |
| CTCN_2651 | 16699 | GTCN_2860 | 26886 |
| TTCN_3054 | 16700 | GTCN_2861 | 26887 |
| GTCN_1596 | 16701 | CTCN_5016 | 26888 |
| ATCN_1892 | 16702 | CTCN_5017 | 26889 |
| ATCN_1893 | 16703 | GTCN_2862 | 26890 |
| ATCN_1894 | 16704 | GTCN_2863 | 26891 |
| ATCN_1895 | 16705 | GTCN_2864 | 26892 |
| TTCN_3055 | 16706 | CTCN_5018 | 26893 |

| | | | |
|---|---|---|---|
| TTCN_3056 | 16707 | ATCN_3399 | 26894 |
| GTCN_1597 | 16708 | GTCN_2865 | 26895 |
| CTCN_2652 | 16709 | TTCN_5393 | 26896 |
| TTCN_3057 | 16710 | GTCN_2866 | 26897 |
| CTCN_2653 | 16711 | GTCN_2867 | 26898 |
| TTCN_3058 | 16712 | CTCN_5019 | 26899 |
| GTCN_1598 | 16713 | GTCN_2868 | 26900 |
| CTCN_2654 | 16714 | CTCN_5020 | 26901 |
| TTCN_3059 | 16715 | GTCN_2869 | 26902 |
| TTCN_3060 | 16716 | TTCN_5394 | 26903 |
| CTCN_2655 | 16717 | CTCN_5021 | 26904 |
| ATCN_1896 | 16718 | TTCN_5395 | 26905 |
| ATCN_1897 | 16719 | TTCN_5396 | 26906 |
| ATCN_1898 | 16720 | TTCN_5397 | 26907 |
| TTCN_3061 | 16721 | CTCN_5022 | 26908 |
| CTCN_2656 | 16722 | TTCN_5398 | 26909 |
| GTCN_1599 | 16723 | GTCN_2870 | 26910 |
| TTCN_3062 | 16724 | TTCN_5399 | 26911 |
| CTCN_2657 | 16725 | TTCN_5400 | 26912 |
| TTCN_3063 | 16726 | CTCN_5023 | 26913 |
| TTCN_3064 | 16727 | TTCN_5401 | 26914 |
| TTCN_3065 | 16728 | TTCN_5402 | 26915 |
| TTCN_3066 | 16729 | TTCN_5403 | 26916 |
| GTCN_1600 | 16730 | TTCN_5404 | 26917 |
| CTCN_2658 | 16731 | ATCN_3400 | 26918 |
| TTCN_3067 | 16732 | TTCN_5405 | 26919 |
| ATCN_1899 | 16733 | GTCN_2871 | 26920 |
| GTCN_1601 | 16734 | TTCN_5406 | 26921 |
| ATCN_1900 | 16735 | GTCN_2872 | 26922 |
| ATCN_1901 | 16736 | TTCN_5407 | 26923 |
| TTCN_3068 | 16737 | CTCN_5024 | 26924 |
| CTCN_2659 | 16738 | GTCN_2873 | 26925 |
| GTCN_1602 | 16739 | GTCN_2874 | 26926 |
| CTCN_2660 | 16740 | CTCN_5025 | 26927 |
| CTCN_2661 | 16741 | TTCN_5408 | 26928 |
| CTCN_2662 | 16742 | CTCN_5026 | 26929 |
| GTCN_1603 | 16743 | TTCN_5409 | 26930 |
| CTCN_2663 | 16744 | TTCN_5410 | 26931 |
| CTCN_2664 | 16745 | TTCN_5411 | 26932 |
| ATCN_1902 | 16746 | CTCN_5027 | 26933 |
| CTCN_2665 | 16747 | TTCN_5412 | 26934 |
| GTCN_1604 | 16748 | CTCN_5028 | 26935 |
| CTCN_2666 | 16749 | ATCN_3401 | 26936 |
| ATCN_1903 | 16750 | CTCN_5029 | 26937 |
| TTCN_3069 | 16751 | CTCN_5030 | 26938 |
| ATCN_1904 | 16752 | GTCN_2875 | 26939 |
| TTCN_3070 | 16753 | TTCN_5413 | 26940 |
| CTCN_2667 | 16754 | ATCN_3402 | 26941 |
| CTCN_2668 | 16755 | CTCN_5031 | 26942 |
| GTCN_1605 | 16756 | GTCN_2876 | 26943 |
| CTCN_2669 | 16757 | ATCN_3403 | 26944 |
| CTCN_2670 | 16758 | CTCN_5032 | 26945 |
| CTCN_2671 | 16759 | CTCN_5033 | 26946 |
| TTCN_3071 | 16760 | CTCN_5034 | 26947 |
| ATCN_1905 | 16761 | TTCN_5414 | 26948 |

FIG. 36 (continued)

| | | | |
|---|---|---|---|
| CTCN_2672 | 16762 | ATCN_3404 | 26949 |
| TTCN_3072 | 16763 | ATCN_3405 | 26950 |
| TTCN_3073 | 16764 | TTCN_5415 | 26951 |
| GTCN_1606 | 16765 | CTCN_5035 | 26952 |
| CTCN_2673 | 16766 | ATCN_3406 | 26953 |
| TTCN_3074 | 16767 | ATCN_3407 | 26954 |
| ATCN_1906 | 16768 | CTCN_5036 | 26955 |
| TTCN_3075 | 16769 | TTCN_5416 | 26956 |
| ATCN_1907 | 16770 | TTCN_5417 | 26957 |
| CTCN_2674 | 16771 | GTCN_2877 | 26958 |
| GTCN_1607 | 16772 | TTCN_5418 | 26959 |
| ATCN_1908 | 16773 | GTCN_2878 | 26960 |
| ATCN_1909 | 16774 | CTCN_5037 | 26961 |
| ATCN_1910 | 16775 | TTCN_5419 | 26962 |
| GTCN_1608 | 16776 | TTCN_5420 | 26963 |
| TTCN_3076 | 16777 | TTCN_5421 | 26964 |
| TTCN_3077 | 16778 | TTCN_5422 | 26965 |
| ATCN_1911 | 16779 | TTCN_5423 | 26966 |
| TTCN_3078 | 16780 | CTCN_5038 | 26967 |
| CTCN_2675 | 16781 | GTCN_2879 | 26968 |
| CTCN_2676 | 16782 | ATCN_3408 | 26969 |
| TTCN_3079 | 16783 | GTCN_2880 | 26970 |
| ATCN_1912 | 16784 | TTCN_5424 | 26971 |
| TTCN_3080 | 16785 | ATCN_3409 | 26972 |
| TTCN_3081 | 16786 | ATCN_3410 | 26973 |
| CTCN_2677 | 16787 | GTCN_2881 | 26974 |
| CTCN_2678 | 16788 | TTCN_5425 | 26975 |
| CTCN_2679 | 16789 | ATCN_3411 | 26976 |
| TTCN_3082 | 16790 | CTCN_5039 | 26977 |
| TTCN_3083 | 16791 | GTCN_2882 | 26978 |
| ATCN_1913 | 16792 | CTCN_5040 | 26979 |
| ATCN_1914 | 16793 | CTCN_5041 | 26980 |
| GTCN_1609 | 16794 | ATCN_3412 | 26981 |
| GTCN_1610 | 16795 | GTCN_2883 | 26982 |
| CTCN_2680 | 16796 | CTCN_5042 | 26983 |
| TTCN_3084 | 16797 | ATCN_3413 | 26984 |
| TTCN_3085 | 16798 | CTCN_5043 | 26985 |
| CTCN_2681 | 16799 | TTCN_5426 | 26986 |
| GTCN_1611 | 16800 | ATCN_3414 | 26987 |
| CTCN_2682 | 16801 | CTCN_5044 | 26988 |
| GTCN_1612 | 16802 | GTCN_2884 | 26989 |
| CTCN_2683 | 16803 | TTCN_5427 | 26990 |
| GTCN_1613 | 16804 | GTCN_2885 | 26991 |
| CTCN_2684 | 16805 | TTCN_5428 | 26992 |
| GTCN_1614 | 16806 | CTCN_5045 | 26993 |
| CTCN_2685 | 16807 | TTCN_5429 | 26994 |
| CTCN_2686 | 16808 | GTCN_2886 | 26995 |
| CTCN_2687 | 16809 | TTCN_5430 | 26996 |
| CTCN_2688 | 16810 | GTCN_2887 | 26997 |
| TTCN_3086 | 16811 | TTCN_5431 | 26998 |
| ATCN_1915 | 16812 | CTCN_5046 | 26999 |
| TTCN_3087 | 16813 | CTCN_5047 | 27000 |
| ATCN_1916 | 16814 | GTCN_2888 | 27001 |
| TTCN_3088 | 16815 | ATCN_3415 | 27002 |
| CTCN_2689 | 16816 | GTCN_2889 | 27003 |

| | | | |
|---|---|---|---|
| CTCN_2690 | 16817 | TTCN_5432 | 27004 |
| CTCN_2691 | 16818 | TTCN_5433 | 27005 |
| TTCN_3089 | 16819 | GTCN_2890 | 27006 |
| CTCN_2692 | 16820 | TTCN_5434 | 27007 |
| TTCN_3090 | 16821 | ATCN_3416 | 27008 |
| ATCN_1917 | 16822 | ATCN_3417 | 27009 |
| GTCN_1615 | 16823 | ATCN_3418 | 27010 |
| CTCN_2693 | 16824 | CTCN_5048 | 27011 |
| CTCN_2694 | 16825 | TTCN_5435 | 27012 |
| TTCN_3091 | 16826 | TTCN_5436 | 27013 |
| CTCN_2695 | 16827 | TTCN_5437 | 27014 |
| CTCN_2696 | 16828 | ATCN_3419 | 27015 |
| ATCN_1918 | 16829 | ATCN_3420 | 27016 |
| ATCN_1919 | 16830 | CTCN_5049 | 27017 |
| GTCN_1616 | 16831 | ATCN_3421 | 27018 |
| TTCN_3092 | 16832 | TTCN_5438 | 27019 |
| TTCN_3093 | 16833 | TTCN_5439 | 27020 |
| ATCN_1920 | 16834 | CTCN_5050 | 27021 |
| TTCN_3094 | 16835 | GTCN_2891 | 27022 |
| ATCN_1921 | 16836 | ATCN_3422 | 27023 |
| CTCN_2697 | 16837 | CTCN_5051 | 27024 |
| CTCN_2698 | 16838 | GTCN_2892 | 27025 |
| CTCN_2699 | 16839 | CTCN_5052 | 27026 |
| TTCN_3095 | 16840 | GTCN_2893 | 27027 |
| TTCN_3096 | 16841 | TTCN_5440 | 27028 |
| ATCN_1922 | 16842 | CTCN_5053 | 27029 |
| GTCN_1617 | 16843 | CTCN_5054 | 27030 |
| ATCN_1923 | 16844 | CTCN_5055 | 27031 |
| GTCN_1618 | 16845 | TTCN_5441 | 27032 |
| CTCN_2700 | 16846 | CTCN_5056 | 27033 |
| TTCN_3097 | 16847 | GTCN_2894 | 27034 |
| CTCN_2701 | 16848 | CTCN_5057 | 27035 |
| CTCN_2702 | 16849 | TTCN_5442 | 27036 |
| TTCN_3098 | 16850 | ATCN_3423 | 27037 |
| GTCN_1619 | 16851 | ATCN_3424 | 27038 |
| CTCN_2703 | 16852 | ATCN_3425 | 27039 |
| CTCN_2704 | 16853 | ATCN_3426 | 27040 |
| CTCN_2705 | 16854 | TTCN_5443 | 27041 |
| TTCN_3099 | 16855 | ATCN_3427 | 27042 |
| CTCN_2706 | 16856 | GTCN_2895 | 27043 |
| CTCN_2707 | 16857 | GTCN_2896 | 27044 |
| CTCN_2708 | 16858 | TTCN_5444 | 27045 |
| CTCN_2709 | 16859 | TTCN_5445 | 27046 |
| TTCN_3100 | 16860 | TTCN_5446 | 27047 |
| GTCN_1620 | 16861 | TTCN_5447 | 27048 |
| GTCN_1621 | 16862 | TTCN_5448 | 27049 |
| TTCN_3101 | 16863 | TTCN_5449 | 27050 |
| TTCN_3102 | 16864 | GTCN_2897 | 27051 |
| TTCN_3103 | 16865 | ATCN_3428 | 27052 |
| TTCN_3104 | 16866 | ATCN_3429 | 27053 |
| GTCN_1622 | 16867 | TTCN_5450 | 27054 |
| ATCN_1924 | 16868 | CTCN_5058 | 27055 |
| ATCN_1925 | 16869 | GTCN_2898 | 27056 |
| CTCN_2710 | 16870 | CTCN_5059 | 27057 |
| GTCN_1623 | 16871 | ATCN_3430 | 27058 |

FIG. 36 (continued)

| | | | |
|---|---|---|---|
| CTCN_2711 | 16872 | GTCN_2899 | 27059 |
| CTCN_2712 | 16873 | ATCN_3431 | 27060 |
| CTCN_2713 | 16874 | ATCN_3432 | 27061 |
| TTCN_3105 | 16875 | CTCN_5060 | 27062 |
| TTCN_3106 | 16876 | ATCN_3433 | 27063 |
| TTCN_3107 | 16877 | GTCN_2900 | 27064 |
| CTCN_2714 | 16878 | GTCN_2901 | 27065 |
| CTCN_2715 | 16879 | GTCN_2902 | 27066 |
| CTCN_2716 | 16880 | TTCN_5451 | 27067 |
| GTCN_1624 | 16881 | TTCN_5452 | 27068 |
| CTCN_2717 | 16882 | ATCN_3434 | 27069 |
| ATCN_1926 | 16883 | CTCN_5061 | 27070 |
| TTCN_3108 | 16884 | TTCN_5453 | 27071 |
| CTCN_2718 | 16885 | CTCN_5062 | 27072 |
| TTCN_3109 | 16886 | ATCN_3435 | 27073 |
| TTCN_3110 | 16887 | CTCN_5063 | 27074 |
| GTCN_1625 | 16888 | ATCN_3436 | 27075 |
| CTCN_2719 | 16889 | TTCN_5454 | 27076 |
| CTCN_2720 | 16890 | CTCN_5064 | 27077 |
| TTCN_3111 | 16891 | GTCN_2903 | 27078 |
| GTCN_1626 | 16892 | TTCN_5455 | 27079 |
| GTCN_1627 | 16893 | GTCN_2904 | 27080 |
| TTCN_3112 | 16894 | CTCN_5065 | 27081 |
| GTCN_1628 | 16895 | ATCN_3437 | 27082 |
| TTCN_3113 | 16896 | ATCN_3438 | 27083 |
| CTCN_2721 | 16897 | GTCN_2905 | 27084 |
| ATCN_1927 | 16898 | GTCN_2906 | 27085 |
| ATCN_1928 | 16899 | GTCN_2907 | 27086 |
| GTCN_1629 | 16900 | GTCN_2908 | 27087 |
| TTCN_3114 | 16901 | CTCN_5066 | 27088 |
| GTCN_1630 | 16902 | TTCN_5456 | 27089 |
| TTCN_3115 | 16903 | CTCN_5067 | 27090 |
| TTCN_3116 | 16904 | TTCN_5457 | 27091 |
| ATCN_1929 | 16905 | TTCN_5458 | 27092 |
| TTCN_3117 | 16906 | ATCN_3439 | 27093 |
| CTCN_2722 | 16907 | ATCN_3440 | 27094 |
| CTCN_2723 | 16908 | CTCN_5068 | 27095 |
| TTCN_3118 | 16909 | ATCN_3441 | 27096 |
| CTCN_2724 | 16910 | ATCN_3442 | 27097 |
| GTCN_1631 | 16911 | ATCN_3443 | 27098 |
| CTCN_2725 | 16912 | ATCN_3444 | 27099 |
| CTCN_2726 | 16913 | CTCN_5069 | 27100 |
| GTCN_1632 | 16914 | CTCN_5070 | 27101 |
| CTCN_2727 | 16915 | ATCN_3445 | 27102 |
| TTCN_3119 | 16916 | GTCN_2909 | 27103 |
| CTCN_2728 | 16917 | CTCN_5071 | 27104 |
| TTCN_3120 | 16918 | TTCN_5459 | 27105 |
| TTCN_3121 | 16919 | CTCN_5072 | 27106 |
| GTCN_1633 | 16920 | ATCN_3446 | 27107 |
| ATCN_1930 | 16921 | GTCN_2910 | 27108 |
| TTCN_3122 | 16922 | ATCN_3447 | 27109 |
| CTCN_2729 | 16923 | CTCN_5073 | 27110 |
| TTCN_3123 | 16924 | CTCN_5074 | 27111 |
| ATCN_1931 | 16925 | TTCN_5460 | 27112 |
| CTCN_2730 | 16926 | TTCN_5461 | 27113 |

| | | | |
|---|---|---|---|
| TTCN_3124 | 16927 | CTCN_5075 | 27114 |
| GTCN_1634 | 16928 | CTCN_5076 | 27115 |
| TTCN_3125 | 16929 | GTCN_2911 | 27116 |
| TTCN_3126 | 16930 | CTCN_5077 | 27117 |
| ATCN_1932 | 16931 | ATCN_3448 | 27118 |
| TTCN_3127 | 16932 | ATCN_3449 | 27119 |
| TTCN_3128 | 16933 | CTCN_5078 | 27120 |
| ATCN_1933 | 16934 | TTCN_5462 | 27121 |
| TTCN_3129 | 16935 | TTCN_5463 | 27122 |
| ATCN_1934 | 16936 | CTCN_5079 | 27123 |
| TTCN_3130 | 16937 | GTCN_2912 | 27124 |
| TTCN_3131 | 16938 | TTCN_5464 | 27125 |
| GTCN_1635 | 16939 | CTCN_5080 | 27126 |
| GTCN_1636 | 16940 | CTCN_5081 | 27127 |
| TTCN_3132 | 16941 | CTCN_5082 | 27128 |
| ATCN_1935 | 16942 | CTCN_5083 | 27129 |
| ATCN_1936 | 16943 | CTCN_5084 | 27130 |
| ATCN_1937 | 16944 | TTCN_5465 | 27131 |
| CTCN_2731 | 16945 | TTCN_5466 | 27132 |
| TTCN_3133 | 16946 | CTCN_5085 | 27133 |
| ATCN_1938 | 16947 | GTCN_2913 | 27134 |
| ATCN_1939 | 16948 | GTCN_2914 | 27135 |
| TTCN_3134 | 16949 | GTCN_2915 | 27136 |
| GTCN_1637 | 16950 | TTCN_5467 | 27137 |
| ATCN_1940 | 16951 | CTCN_5086 | 27138 |
| TTCN_3135 | 16952 | ATCN_3450 | 27139 |
| TTCN_3136 | 16953 | CTCN_5087 | 27140 |
| CTCN_2732 | 16954 | GTCN_2916 | 27141 |
| TTCN_3137 | 16955 | TTCN_5468 | 27142 |
| GTCN_1638 | 16956 | ATCN_3451 | 27143 |
| TTCN_3138 | 16957 | ATCN_3452 | 27144 |
| ATCN_1941 | 16958 | TTCN_5469 | 27145 |
| TTCN_3139 | 16959 | TTCN_5470 | 27146 |
| TTCN_3140 | 16960 | TTCN_5471 | 27147 |
| ATCN_1942 | 16961 | GTCN_2917 | 27148 |
| ATCN_1943 | 16962 | TTCN_5472 | 27149 |
| GTCN_1639 | 16963 | ATCN_3453 | 27150 |
| ATCN_1944 | 16964 | TTCN_5473 | 27151 |
| TTCN_3141 | 16965 | ATCN_3454 | 27152 |
| GTCN_1640 | 16966 | CTCN_5088 | 27153 |
| TTCN_3142 | 16967 | ATCN_3455 | 27154 |
| ATCN_1945 | 16968 | GTCN_2918 | 27155 |
| ATCN_1946 | 16969 | ATCN_3456 | 27156 |
| CTCN_2733 | 16970 | CTCN_5089 | 27157 |
| GTCN_1641 | 16971 | ATCN_3457 | 27158 |
| TTCN_3143 | 16972 | GTCN_2919 | 27159 |
| GTCN_1642 | 16973 | ATCN_3458 | 27160 |
| ATCN_1947 | 16974 | ATCN_3459 | 27161 |
| GTCN_1643 | 16975 | ATCN_3460 | 27162 |
| GTCN_1644 | 16976 | TTCN_5474 | 27163 |
| CTCN_2734 | 16977 | TTCN_5475 | 27164 |
| GTCN_1645 | 16978 | CTCN_5090 | 27165 |
| CTCN_2735 | 16979 | CTCN_5091 | 27166 |
| TTCN_3144 | 16980 | TTCN_5476 | 27167 |
| TTCN_3145 | 16981 | TTCN_5477 | 27168 |

FIG. 36 (continued)

| | | | |
|---|---|---|---|
| TTCN_3146 | 16982 | GTCN_2920 | 27169 |
| TTCN_3147 | 16983 | TTCN_5478 | 27170 |
| GTCN_1646 | 16984 | TTCN_5479 | 27171 |
| TTCN_3148 | 16985 | TTCN_5480 | 27172 |
| GTCN_1647 | 16986 | TTCN_5481 | 27173 |
| GTCN_1648 | 16987 | TTCN_5482 | 27174 |
| GTCN_1649 | 16988 | TTCN_5483 | 27175 |
| ATCN_1948 | 16989 | CTCN_5092 | 27176 |
| TTCN_3149 | 16990 | CTCN_5093 | 27177 |
| ATCN_1949 | 16991 | TTCN_5484 | 27178 |
| CTCN_2736 | 16992 | ATCN_3461 | 27179 |
| ATCN_1950 | 16993 | ATCN_3462 | 27180 |
| TTCN_3150 | 16994 | ATCN_3463 | 27181 |
| GTCN_1650 | 16995 | CTCN_5094 | 27182 |
| ATCN_1951 | 16996 | TTCN_5485 | 27183 |
| TTCN_3151 | 16997 | GTCN_2921 | 27184 |
| ATCN_1952 | 16998 | CTCN_5095 | 27185 |
| TTCN_3152 | 16999 | CTCN_5096 | 27186 |
| TTCN_3153 | 17000 | CTCN_5097 | 27187 |
| CTCN_2737 | 17001 | CTCN_5098 | 27188 |
| TTCN_3154 | 17002 | CTCN_5099 | 27189 |
| GTCN_1651 | 17003 | CTCN_5100 | 27190 |
| ATCN_1953 | 17004 | CTCN_5101 | 27191 |
| ATCN_1954 | 17005 | CTCN_5102 | 27192 |
| CTCN_2738 | 17006 | CTCN_5103 | 27193 |
| TTCN_3155 | 17007 | CTCN_5104 | 27194 |
| TTCN_3156 | 17008 | CTCN_5105 | 27195 |
| TTCN_3157 | 17009 | TTCN_5486 | 27196 |
| CTCN_2739 | 17010 | GTCN_2922 | 27197 |
| GTCN_1652 | 17011 | ATCN_3464 | 27198 |
| TTCN_3158 | 17012 | TTCN_5487 | 27199 |
| TTCN_3159 | 17013 | TTCN_5488 | 27200 |
| GTCN_1653 | 17014 | CTCN_5106 | 27201 |
| TTCN_3160 | 17015 | CTCN_5107 | 27202 |
| CTCN_2740 | 17016 | GTCN_2923 | 27203 |
| CTCN_2741 | 17017 | TTCN_5489 | 27204 |
| CTCN_2742 | 17018 | TTCN_5490 | 27205 |
| GTCN_1654 | 17019 | CTCN_5108 | 27206 |
| TTCN_3161 | 17020 | CTCN_5109 | 27207 |
| CTCN_2743 | 17021 | CTCN_5110 | 27208 |
| ATCN_1955 | 17022 | CTCN_5111 | 27209 |
| TTCN_3162 | 17023 | TTCN_5491 | 27210 |
| ATCN_1956 | 17024 | CTCN_5112 | 27211 |
| CTCN_2744 | 17025 | CTCN_5113 | 27212 |
| CTCN_2745 | 17026 | CTCN_5114 | 27213 |
| TTCN_3163 | 17027 | CTCN_5115 | 27214 |
| TTCN_3164 | 17028 | TTCN_5492 | 27215 |
| TTCN_3165 | 17029 | TTCN_5493 | 27216 |
| ATCN_1957 | 17030 | CTCN_5116 | 27217 |
| CTCN_2746 | 17031 | CTCN_5117 | 27218 |
| CTCN_2747 | 17032 | TTCN_5494 | 27219 |
| CTCN_2748 | 17033 | CTCN_5118 | 27220 |
| CTCN_2749 | 17034 | GTCN_2924 | 27221 |
| CTCN_2750 | 17035 | GTCN_2925 | 27222 |
| GTCN_1655 | 17036 | CTCN_5119 | 27223 |

| | | | |
|---|---|---|---|
| GTCN_1656 | 17037 | GTCN_2926 | 27224 |
| TTCN_3166 | 17038 | CTCN_5120 | 27225 |
| TTCN_3167 | 17039 | CTCN_5121 | 27226 |
| ATCN_1958 | 17040 | TTCN_5495 | 27227 |
| CTCN_2751 | 17041 | ATCN_3465 | 27228 |
| ATCN_1959 | 17042 | TTCN_5496 | 27229 |
| ATCN_1960 | 17043 | TTCN_5497 | 27230 |
| TTCN_3168 | 17044 | TTCN_5498 | 27231 |
| ATCN_1961 | 17045 | TTCN_5499 | 27232 |
| ATCN_1962 | 17046 | ATCN_3466 | 27233 |
| TTCN_3169 | 17047 | TTCN_5500 | 27234 |
| TTCN_3170 | 17048 | CTCN_5122 | 27235 |
| TTCN_3171 | 17049 | CTCN_5123 | 27236 |
| TTCN_3172 | 17050 | ATCN_3467 | 27237 |
| ATCN_1963 | 17051 | GTCN_2927 | 27238 |
| TTCN_3173 | 17052 | GTCN_2928 | 27239 |
| ATCN_1964 | 17053 | CTCN_5124 | 27240 |
| ATCN_1965 | 17054 | CTCN_5125 | 27241 |
| CTCN_2752 | 17055 | GTCN_2929 | 27242 |
| TTCN_3174 | 17056 | TTCN_5501 | 27243 |
| TTCN_3175 | 17057 | CTCN_5126 | 27244 |
| GTCN_1657 | 17058 | CTCN_5127 | 27245 |
| ATCN_1966 | 17059 | TTCN_5502 | 27246 |
| CTCN_2753 | 17060 | GTCN_2930 | 27247 |
| TTCN_3176 | 17061 | TTCN_5503 | 27248 |
| CTCN_2754 | 17062 | CTCN_5128 | 27249 |
| GTCN_1658 | 17063 | TTCN_5504 | 27250 |
| ATCN_1967 | 17064 | ATCN_3468 | 27251 |
| TTCN_3177 | 17065 | CTCN_5129 | 27252 |
| CTCN_2755 | 17066 | CTCN_5130 | 27253 |
| CTCN_2756 | 17067 | TTCN_5505 | 27254 |
| GTCN_1659 | 17068 | CTCN_5131 | 27255 |
| GTCN_1660 | 17069 | ATCN_3469 | 27256 |
| GTCN_1661 | 17070 | ATCN_3470 | 27257 |
| TTCN_3178 | 17071 | CTCN_5132 | 27258 |
| CTCN_2757 | 17072 | GTCN_2931 | 27259 |
| TTCN_3179 | 17073 | CTCN_5133 | 27260 |
| ATCN_1968 | 17074 | CTCN_5134 | 27261 |
| TTCN_3180 | 17075 | GTCN_2932 | 27262 |
| TTCN_3181 | 17076 | CTCN_5135 | 27263 |
| TTCN_3182 | 17077 | TTCN_5506 | 27264 |
| TTCN_3183 | 17078 | TTCN_5507 | 27265 |
| CTCN_2758 | 17079 | TTCN_5508 | 27266 |
| GTCN_1662 | 17080 | CTCN_5136 | 27267 |
| TTCN_3184 | 17081 | CTCN_5137 | 27268 |
| CTCN_2759 | 17082 | CTCN_5138 | 27269 |
| ATCN_1969 | 17083 | CTCN_5139 | 27270 |
| ATCN_1970 | 17084 | CTCN_5140 | 27271 |
| GTCN_1663 | 17085 | CTCN_5141 | 27272 |
| TTCN_3185 | 17086 | TTCN_5509 | 27273 |
| CTCN_2760 | 17087 | CTCN_5142 | 27274 |
| GTCN_1664 | 17088 | CTCN_5143 | 27275 |
| ATCN_1971 | 17089 | GTCN_2933 | 27276 |
| CTCN_2761 | 17090 | CTCN_5144 | 27277 |
| CTCN_2762 | 17091 | CTCN_5145 | 27278 |

FIG. 36 (continued)

| | | | |
|---|---|---|---|
| GTCN_1665 | 17092 | CTCN_5146 | 27279 |
| TTCN_3186 | 17093 | CTCN_5147 | 27280 |
| TTCN_3187 | 17094 | TTCN_5510 | 27281 |
| CTCN_2763 | 17095 | ATCN_3471 | 27282 |
| GTCN_1666 | 17096 | TTCN_5511 | 27283 |
| CTCN_2764 | 17097 | TTCN_5512 | 27284 |
| GTCN_1667 | 17098 | TTCN_5513 | 27285 |
| GTCN_1668 | 17099 | TTCN_5514 | 27286 |
| CTCN_2765 | 17100 | TTCN_5515 | 27287 |
| CTCN_2766 | 17101 | TTCN_5516 | 27288 |
| CTCN_2767 | 17102 | TTCN_5517 | 27289 |
| CTCN_2768 | 17103 | TTCN_5518 | 27290 |
| ATCN_1972 | 17104 | TTCN_5519 | 27291 |
| CTCN_2769 | 17105 | TTCN_5520 | 27292 |
| GTCN_1669 | 17106 | TTCN_5521 | 27293 |
| CTCN_2770 | 17107 | TTCN_5522 | 27294 |
| CTCN_2771 | 17108 | TTCN_5523 | 27295 |
| GTCN_1670 | 17109 | CTCN_5148 | 27296 |
| CTCN_2772 | 17110 | TTCN_5524 | 27297 |
| GTCN_1671 | 17111 | GTCN_2934 | 27298 |
| CTCN_2773 | 17112 | CTCN_5149 | 27299 |
| TTCN_3188 | 17113 | ATCN_3472 | 27300 |
| GTCN_1672 | 17114 | TTCN_5525 | 27301 |
| TTCN_3189 | 17115 | TTCN_5526 | 27302 |
| TTCN_3190 | 17116 | ATCN_3473 | 27303 |
| TTCN_3191 | 17117 | TTCN_5527 | 27304 |
| CTCN_2774 | 17118 | TTCN_5528 | 27305 |
| ATCN_1973 | 17119 | ATCN_3474 | 27306 |
| TTCN_3192 | 17120 | TTCN_5529 | 27307 |
| TTCN_3193 | 17121 | CTCN_5150 | 27308 |
| CTCN_2775 | 17122 | TTCN_5530 | 27309 |
| CTCN_2776 | 17123 | GTCN_2935 | 27310 |
| ATCN_1974 | 17124 | TTCN_5531 | 27311 |
| TTCN_3194 | 17125 | ATCN_3475 | 27312 |
| CTCN_2777 | 17126 | GTCN_2936 | 27313 |
| ATCN_1975 | 17127 | GTCN_2937 | 27314 |
| ATCN_1976 | 17128 | TTCN_5532 | 27315 |
| TTCN_3195 | 17129 | TTCN_5533 | 27316 |
| TTCN_3196 | 17130 | ATCN_3476 | 27317 |
| TTCN_3197 | 17131 | ATCN_3477 | 27318 |
| ATCN_1977 | 17132 | TTCN_5534 | 27319 |
| TTCN_3198 | 17133 | GTCN_2938 | 27320 |
| TTCN_3199 | 17134 | GTCN_2939 | 27321 |
| CTCN_2778 | 17135 | TTCN_5535 | 27322 |
| TTCN_3200 | 17136 | TTCN_5536 | 27323 |
| ATCN_1978 | 17137 | GTCN_2940 | 27324 |
| ATCN_1979 | 17138 | ATCN_3478 | 27325 |
| CTCN_2779 | 17139 | ATCN_3479 | 27326 |
| TTCN_3201 | 17140 | TTCN_5537 | 27327 |
| TTCN_3202 | 17141 | CTCN_5151 | 27328 |
| GTCN_1673 | 17142 | ATCN_3480 | 27329 |
| CTCN_2780 | 17143 | CTCN_5152 | 27330 |
| TTCN_3203 | 17144 | GTCN_2941 | 27331 |
| TTCN_3204 | 17145 | CTCN_5153 | 27332 |
| GTCN_1674 | 17146 | CTCN_5154 | 27333 |

| | | | |
|---|---|---|---|
| TTCN_3205 | 17147 | GTCN_2942 | 27334 |
| TTCN_3206 | 17148 | TTCN_5538 | 27335 |
| ATCN_1980 | 17149 | TTCN_5539 | 27336 |
| TTCN_3207 | 17150 | GTCN_2943 | 27337 |
| TTCN_3208 | 17151 | ATCN_3481 | 27338 |
| ATCN_1981 | 17152 | TTCN_5540 | 27339 |
| ATCN_1982 | 17153 | GTCN_2944 | 27340 |
| CTCN_2781 | 17154 | TTCN_5541 | 27341 |
| TTCN_3209 | 17155 | TTCN_5542 | 27342 |
| ATCN_1983 | 17156 | ATCN_3482 | 27343 |
| GTCN_1675 | 17157 | GTCN_2945 | 27344 |
| TTCN_3210 | 17158 | ATCN_3483 | 27345 |
| CTCN_2782 | 17159 | TTCN_5543 | 27346 |
| TTCN_3211 | 17160 | TTCN_5544 | 27347 |
| CTCN_2783 | 17161 | TTCN_5545 | 27348 |
| GTCN_1676 | 17162 | ATCN_3484 | 27349 |
| TTCN_3212 | 17163 | TTCN_5546 | 27350 |
| GTCN_1677 | 17164 | CTCN_5155 | 27351 |
| CTCN_2784 | 17165 | ATCN_3485 | 27352 |
| TTCN_3213 | 17166 | TTCN_5547 | 27353 |
| TTCN_3214 | 17167 | TTCN_5548 | 27354 |
| GTCN_1678 | 17168 | TTCN_5549 | 27355 |
| CTCN_2785 | 17169 | ATCN_3486 | 27356 |
| ATCN_1984 | 17170 | CTCN_5156 | 27357 |
| ATCN_1985 | 17171 | ATCN_3487 | 27358 |
| CTCN_2786 | 17172 | TTCN_5550 | 27359 |
| ATCN_1986 | 17173 | ATCN_3488 | 27360 |
| CTCN_2787 | 17174 | GTCN_2946 | 27361 |
| CTCN_2788 | 17175 | ATCN_3489 | 27362 |
| CTCN_2789 | 17176 | TTCN_5551 | 27363 |
| ATCN_1987 | 17177 | TTCN_5552 | 27364 |
| TTCN_3215 | 17178 | CTCN_5157 | 27365 |
| CTCN_2790 | 17179 | GTCN_2947 | 27366 |
| TTCN_3216 | 17180 | CTCN_5158 | 27367 |
| GTCN_1679 | 17181 | ATCN_3490 | 27368 |
| TTCN_3217 | 17182 | ATCN_3491 | 27369 |
| ATCN_1988 | 17183 | TTCN_5553 | 27370 |
| ATCN_1989 | 17184 | CTCN_5159 | 27371 |
| TTCN_3218 | 17185 | GTCN_2948 | 27372 |
| TTCN_3219 | 17186 | GTCN_2949 | 27373 |
| GTCN_1680 | 17187 | GTCN_2950 | 27374 |
| ATCN_1990 | 17188 | TTCN_5554 | 27375 |
| GTCN_1681 | 17189 | CTCN_5160 | 27376 |
| TTCN_3220 | 17190 | TTCN_5555 | 27377 |
| TTCN_3221 | 17191 | CTCN_5161 | 27378 |
| CTCN_2791 | 17192 | CTCN_5162 | 27379 |
| CTCN_2792 | 17193 | TTCN_5556 | 27380 |
| TTCN_3222 | 17194 | CTCN_5163 | 27381 |
| CTCN_2793 | 17195 | CTCN_5164 | 27382 |
| ATCN_1991 | 17196 | CTCN_5165 | 27383 |
| CTCN_2794 | 17197 | TTCN_5557 | 27384 |
| GTCN_1682 | 17198 | TTCN_5558 | 27385 |
| CTCN_2795 | 17199 | ATCN_3492 | 27386 |
| TTCN_3223 | 17200 | CTCN_5166 | 27387 |
| CTCN_2796 | 17201 | ATCN_3493 | 27388 |

FIG. 36 (continued)

| | | | |
|---|---|---|---|
| ATCN_1992 | 17202 | ATCN_3494 | 27389 |
| ATCN_1993 | 17203 | ATCN_3495 | 27390 |
| TTCN_3224 | 17204 | ATCN_3496 | 27391 |
| CTCN_2797 | 17205 | ATCN_3497 | 27392 |
| ATCN_1994 | 17206 | ATCN_3498 | 27393 |
| TTCN_3225 | 17207 | TTCN_5559 | 27394 |
| ATCN_1995 | 17208 | TTCN_5560 | 27395 |
| TTCN_3226 | 17209 | CTCN_5167 | 27396 |
| GTCN_1683 | 17210 | TTCN_5561 | 27397 |
| CTCN_2798 | 17211 | TTCN_5562 | 27398 |
| CTCN_2799 | 17212 | TTCN_5563 | 27399 |
| CTCN_2800 | 17213 | ATCN_3499 | 27400 |
| GTCN_1684 | 17214 | TTCN_5564 | 27401 |
| GTCN_1685 | 17215 | GTCN_2951 | 27402 |
| ATCN_1996 | 17216 | CTCN_5168 | 27403 |
| CTCN_2801 | 17217 | ATCN_3500 | 27404 |
| CTCN_2802 | 17218 | ATCN_3501 | 27405 |
| GTCN_1686 | 17219 | ATCN_3502 | 27406 |
| ATCN_1997 | 17220 | ATCN_3503 | 27407 |
| GTCN_1687 | 17221 | CTCN_5169 | 27408 |
| ATCN_1998 | 17222 | TTCN_5565 | 27409 |
| GTCN_1688 | 17223 | TTCN_5566 | 27410 |
| GTCN_1689 | 17224 | GTCN_2952 | 27411 |
| ATCN_1999 | 17225 | TTCN_5567 | 27412 |
| GTCN_1690 | 17226 | ATCN_3504 | 27413 |
| CTCN_2803 | 17227 | TTCN_5568 | 27414 |
| CTCN_2804 | 17228 | CTCN_5170 | 27415 |
| CTCN_2805 | 17229 | GTCN_2953 | 27416 |
| CTCN_2806 | 17230 | CTCN_5171 | 27417 |
| CTCN_2807 | 17231 | TTCN_5569 | 27418 |
| GTCN_1691 | 17232 | CTCN_5172 | 27419 |
| CTCN_2808 | 17233 | CTCN_5173 | 27420 |
| CTCN_2809 | 17234 | CTCN_5174 | 27421 |
| ATCN_2000 | 17235 | CTCN_5175 | 27422 |
| CTCN_2810 | 17236 | CTCN_5176 | 27423 |
| GTCN_1692 | 17237 | TTCN_5570 | 27424 |
| TTCN_3227 | 17238 | GTCN_2954 | 27425 |
| CTCN_2811 | 17239 | TTCN_5571 | 27426 |
| TTCN_3228 | 17240 | CTCN_5177 | 27427 |
| CTCN_2812 | 17241 | GTCN_2955 | 27428 |
| GTCN_1693 | 17242 | ATCN_3505 | 27429 |
| GTCN_1694 | 17243 | CTCN_5178 | 27430 |
| CTCN_2813 | 17244 | TTCN_5572 | 27431 |
| CTCN_2814 | 17245 | ATCN_3506 | 27432 |
| CTCN_2815 | 17246 | ATCN_3507 | 27433 |
| TTCN_3229 | 17247 | TTCN_5573 | 27434 |
| ATCN_2001 | 17248 | TTCN_5574 | 27435 |
| CTCN_2816 | 17249 | CTCN_5179 | 27436 |
| TTCN_3230 | 17250 | CTCN_5180 | 27437 |
| GTCN_1695 | 17251 | ATCN_3508 | 27438 |
| GTCN_1696 | 17252 | ATCN_3509 | 27439 |
| CTCN_2817 | 17253 | TTCN_5575 | 27440 |
| TTCN_3231 | 17254 | TTCN_5576 | 27441 |
| CTCN_2818 | 17255 | ATCN_3510 | 27442 |
| ATCN_2002 | 17256 | TTCN_5577 | 27443 |

| | | | |
|---|---|---|---|
| TTCN_3232 | 17257 | ATCN_3511 | 27444 |
| TTCN_3233 | 17258 | TTCN_5578 | 27445 |
| TTCN_3234 | 17259 | CTCN_5181 | 27446 |
| GTCN_1697 | 17260 | TTCN_5579 | 27447 |
| TTCN_3235 | 17261 | TTCN_5580 | 27448 |
| CTCN_2819 | 17262 | ATCN_3512 | 27449 |
| TTCN_3236 | 17263 | TTCN_5581 | 27450 |
| CTCN_2820 | 17264 | CTCN_5182 | 27451 |
| GTCN_1698 | 17265 | TTCN_5582 | 27452 |
| CTCN_2821 | 17266 | GTCN_2956 | 27453 |
| GTCN_1699 | 17267 | TTCN_5583 | 27454 |
| GTCN_1700 | 17268 | | |
| TTCN_3237 | 17269 | | |
| TTCN_3238 | 17270 | | |
| ATCN_2003 | 17271 | | |
| ATCN_2004 | 17272 | | |

232782441 v1

FIG. 37: Table 3C

| Spacer | SEQ ID NO. | Spacer | SEQ ID NO. |
|---|---|---|---|
| CTCN_0 | 27455 | CTCN_4863 | 41514 |
| TTCN_0 | 27456 | TTCN_3918 | 41515 |
| ATCN_0 | 27457 | GTCN_2506 | 41516 |
| CTCN_1 | 27458 | CTCN_4864 | 41517 |
| GTCN_0 | 27459 | CTCN_4865 | 41518 |
| GTCN_1 | 27460 | GTCN_2507 | 41519 |
| TTCN_1 | 27461 | CTCN_4866 | 41520 |
| GTCN_2 | 27462 | TTCN_3919 | 41521 |
| TTCN_2 | 27463 | ATCN_2772 | 41522 |
| TTCN_3 | 27464 | GTCN_2508 | 41523 |
| ATCN_1 | 27465 | TTCN_3920 | 41524 |
| GTCN_3 | 27466 | TTCN_3921 | 41525 |
| TTCN_4 | 27467 | TTCN_3922 | 41526 |
| GTCN_4 | 27468 | TTCN_3923 | 41527 |
| ATCN_2 | 27469 | ATCN_2773 | 41528 |
| TTCN_5 | 27470 | ATCN_2774 | 41529 |
| CTCN_2 | 27471 | TTCN_3924 | 41530 |
| CTCN_3 | 27472 | CTCN_4867 | 41531 |
| ATCN_3 | 27473 | CTCN_4868 | 41532 |
| CTCN_4 | 27474 | GTCN_2509 | 41533 |
| ATCN_4 | 27475 | CTCN_4869 | 41534 |
| ATCN_5 | 27476 | ATCN_2775 | 41535 |
| CTCN_5 | 27477 | ATCN_2776 | 41536 |
| GTCN_5 | 27478 | CTCN_4870 | 41537 |
| CTCN_6 | 27479 | GTCN_2510 | 41538 |
| ATCN_6 | 27480 | CTCN_4871 | 41539 |
| ATCN_7 | 27481 | TTCN_3925 | 41540 |
| CTCN_7 | 27482 | CTCN_4872 | 41541 |
| GTCN_6 | 27483 | CTCN_4873 | 41542 |
| TTCN_6 | 27484 | GTCN_2511 | 41543 |
| TTCN_7 | 27485 | CTCN_4874 | 41544 |
| GTCN_7 | 27486 | ATCN_2777 | 41545 |
| CTCN_8 | 27487 | TTCN_3926 | 41546 |
| GTCN_8 | 27488 | TTCN_3927 | 41547 |
| CTCN_9 | 27489 | TTCN_3928 | 41548 |
| CTCN_10 | 27490 | GTCN_2512 | 41549 |
| CTCN_11 | 27491 | TTCN_3929 | 41550 |
| CTCN_12 | 27492 | TTCN_3930 | 41551 |
| TTCN_8 | 27493 | GTCN_2513 | 41552 |
| GTCN_9 | 27494 | TTCN_3931 | 41553 |
| TTCN_9 | 27495 | GTCN_2514 | 41554 |
| TTCN_10 | 27496 | TTCN_3932 | 41555 |
| CTCN_13 | 27497 | CTCN_4875 | 41556 |
| CTCN_14 | 27498 | GTCN_2515 | 41557 |
| CTCN_15 | 27499 | CTCN_4876 | 41558 |
| ATCN_8 | 27500 | TTCN_3933 | 41559 |
| ATCN_9 | 27501 | GTCN_2516 | 41560 |
| CTCN_16 | 27502 | CTCN_4877 | 41561 |
| GTCN_10 | 27503 | CTCN_4878 | 41562 |
| CTCN_17 | 27504 | CTCN_4879 | 41563 |
| CTCN_18 | 27505 | GTCN_2517 | 41564 |
| TTCN_11 | 27506 | GTCN_2518 | 41565 |
| ATCN_10 | 27507 | ATCN_2778 | 41566 |
| CTCN_19 | 27508 | GTCN_2519 | 41567 |
| TTCN_12 | 27509 | CTCN_4880 | 41568 |
| TTCN_13 | 27510 | GTCN_2520 | 41569 |
| GTCN_11 | 27511 | CTCN_4881 | 41570 |
| TTCN_14 | 27512 | GTCN_2521 | 41571 |
| CTCN_20 | 27513 | CTCN_4882 | 41572 |
| TTCN_15 | 27514 | ATCN_2779 | 41573 |
| CTCN_21 | 27515 | ATCN_2780 | 41574 |
| GTCN_12 | 27516 | TTCN_3934 | 41575 |
| CTCN_22 | 27517 | ATCN_2781 | 41576 |
| CTCN_23 | 27518 | TTCN_3935 | 41577 |
| ATCN_11 | 27519 | CTCN_4883 | 41578 |
| ATCN_12 | 27520 | TTCN_3936 | 41579 |
| TTCN_16 | 27521 | GTCN_2522 | 41580 |
| TTCN_17 | 27522 | GTCN_2523 | 41581 |
| GTCN_13 | 27523 | TTCN_3937 | 41582 |
| CTCN_24 | 27524 | CTCN_4884 | 41583 |
| TTCN_18 | 27525 | GTCN_2524 | 41584 |
| TTCN_19 | 27526 | TTCN_3938 | 41585 |
| GTCN_14 | 27527 | TTCN_3939 | 41586 |
| CTCN_25 | 27528 | CTCN_4885 | 41587 |
| TTCN_20 | 27529 | TTCN_3940 | 41588 |
| ATCN_13 | 27530 | ATCN_2782 | 41589 |
| GTCN_15 | 27531 | TTCN_3941 | 41590 |
| TTCN_21 | 27532 | TTCN_3942 | 41591 |
| ATCN_14 | 27533 | ATCN_2783 | 41592 |
| ATCN_15 | 27534 | CTCN_4886 | 41593 |
| TTCN_22 | 27535 | ATCN_2784 | 41594 |
| TTCN_23 | 27536 | TTCN_3943 | 41595 |

FIG. 37 (continued)

| | | | |
|---|---|---|---|
| CTCN_26 | 27537 | TTCN_3944 | 41596 |
| TTCN_24 | 27538 | ATCN_2785 | 41597 |
| ATCN_16 | 27539 | GTCN_2525 | 41598 |
| TTCN_25 | 27540 | TTCN_3945 | 41599 |
| TTCN_26 | 27541 | TTCN_3946 | 41600 |
| GTCN_16 | 27542 | ATCN_2786 | 41601 |
| TTCN_27 | 27543 | ATCN_2787 | 41602 |
| TTCN_28 | 27544 | TTCN_3947 | 41603 |
| ATCN_17 | 27545 | TTCN_3948 | 41604 |
| TTCN_29 | 27546 | GTCN_2526 | 41605 |
| ATCN_18 | 27547 | CTCN_4887 | 41606 |
| GTCN_17 | 27548 | ATCN_2788 | 41607 |
| TTCN_30 | 27549 | CTCN_4888 | 41608 |
| TTCN_31 | 27550 | CTCN_4889 | 41609 |
| ATCN_19 | 27551 | TTCN_3949 | 41610 |
| GTCN_18 | 27552 | GTCN_2527 | 41611 |
| ATCN_20 | 27553 | ATCN_2789 | 41612 |
| TTCN_32 | 27554 | GTCN_2528 | 41613 |
| ATCN_21 | 27555 | CTCN_4890 | 41614 |
| CTCN_27 | 27556 | CTCN_4891 | 41615 |
| GTCN_19 | 27557 | CTCN_4892 | 41616 |
| TTCN_33 | 27558 | CTCN_4893 | 41617 |
| TTCN_34 | 27559 | TTCN_3950 | 41618 |
| TTCN_35 | 27560 | GTCN_2529 | 41619 |
| CTCN_28 | 27561 | GTCN_2530 | 41620 |
| CTCN_29 | 27562 | CTCN_4894 | 41621 |
| ATCN_22 | 27563 | ATCN_2790 | 41622 |
| ATCN_23 | 27564 | CTCN_4895 | 41623 |
| ATCN_24 | 27565 | CTCN_4896 | 41624 |
| ATCN_25 | 27566 | CTCN_4897 | 41625 |
| CTCN_30 | 27567 | GTCN_2531 | 41626 |
| TTCN_36 | 27568 | CTCN_4898 | 41627 |
| ATCN_26 | 27569 | CTCN_4899 | 41628 |
| CTCN_31 | 27570 | GTCN_2532 | 41629 |
| TTCN_37 | 27571 | TTCN_3951 | 41630 |
| TTCN_38 | 27572 | GTCN_2533 | 41631 |
| ATCN_27 | 27573 | CTCN_4900 | 41632 |
| GTCN_20 | 27574 | CTCN_4901 | 41633 |
| CTCN_32 | 27575 | GTCN_2534 | 41634 |
| CTCN_33 | 27576 | TTCN_3952 | 41635 |
| TTCN_39 | 27577 | CTCN_4902 | 41636 |
| TTCN_40 | 27578 | ATCN_2791 | 41637 |
| TTCN_41 | 27579 | GTCN_2535 | 41638 |
| CTCN_34 | 27580 | CTCN_4903 | 41639 |
| TTCN_42 | 27581 | CTCN_4904 | 41640 |
| GTCN_21 | 27582 | GTCN_2536 | 41641 |
| ATCN_28 | 27583 | CTCN_4905 | 41642 |
| ATCN_29 | 27584 | TTCN_3953 | 41643 |
| TTCN_43 | 27585 | CTCN_4906 | 41644 |
| GTCN_22 | 27586 | GTCN_2537 | 41645 |
| GTCN_23 | 27587 | TTCN_3954 | 41646 |
| ATCN_30 | 27588 | CTCN_4907 | 41647 |
| TTCN_44 | 27589 | TTCN_3955 | 41648 |
| TTCN_45 | 27590 | CTCN_4908 | 41649 |
| TTCN_46 | 27591 | GTCN_2538 | 41650 |
| ATCN_31 | 27592 | CTCN_4909 | 41651 |
| CTCN_35 | 27593 | CTCN_4910 | 41652 |
| CTCN_36 | 27594 | GTCN_2539 | 41653 |
| CTCN_37 | 27595 | GTCN_2540 | 41654 |
| ATCN_32 | 27596 | CTCN_4911 | 41655 |
| GTCN_24 | 27597 | TTCN_3956 | 41656 |
| ATCN_33 | 27598 | CTCN_4912 | 41657 |
| TTCN_47 | 27599 | CTCN_4913 | 41658 |
| ATCN_34 | 27600 | GTCN_2541 | 41659 |
| TTCN_48 | 27601 | CTCN_4914 | 41660 |
| GTCN_25 | 27602 | CTCN_4915 | 41661 |
| GTCN_26 | 27603 | ATCN_2792 | 41662 |
| GTCN_27 | 27604 | CTCN_4916 | 41663 |
| ATCN_35 | 27605 | TTCN_3957 | 41664 |
| ATCN_36 | 27606 | TTCN_3958 | 41665 |
| CTCN_38 | 27607 | ATCN_2793 | 41666 |
| GTCN_28 | 27608 | CTCN_4917 | 41667 |
| TTCN_49 | 27609 | GTCN_2542 | 41668 |
| GTCN_29 | 27610 | TTCN_3959 | 41669 |
| ATCN_37 | 27611 | CTCN_4918 | 41670 |
| ATCN_38 | 27612 | TTCN_3960 | 41671 |
| TTCN_50 | 27613 | TTCN_3961 | 41672 |
| CTCN_39 | 27614 | TTCN_3962 | 41673 |
| GTCN_30 | 27615 | ATCN_2794 | 41674 |
| TTCN_51 | 27616 | GTCN_2543 | 41675 |
| CTCN_40 | 27617 | ATCN_2795 | 41676 |
| TTCN_52 | 27618 | CTCN_4919 | 41677 |
| CTCN_41 | 27619 | CTCN_4920 | 41678 |
| CTCN_42 | 27620 | ATCN_2796 | 41679 |
| TTCN_53 | 27621 | CTCN_4921 | 41680 |
| ATCN_39 | 27622 | TTCN_3963 | 41681 |

FIG. 37 (continued)

| | | | |
|---|---|---|---|
| CTCN_43 | 27623 | TTCN_3964 | 41682 |
| GTCN_31 | 27624 | GTCN_2544 | 41683 |
| TTCN_54 | 27625 | ATCN_2797 | 41684 |
| TTCN_55 | 27626 | GTCN_2545 | 41685 |
| GTCN_32 | 27627 | TTCN_3965 | 41686 |
| ATCN_40 | 27628 | TTCN_3966 | 41687 |
| ATCN_41 | 27629 | ATCN_2798 | 41688 |
| ATCN_42 | 27630 | GTCN_2546 | 41689 |
| CTCN_44 | 27631 | ATCN_2799 | 41690 |
| TTCN_56 | 27632 | GTCN_2547 | 41691 |
| ATCN_43 | 27633 | TTCN_3967 | 41692 |
| GTCN_33 | 27634 | TTCN_3968 | 41693 |
| TTCN_57 | 27635 | ATCN_2800 | 41694 |
| TTCN_58 | 27636 | CTCN_4922 | 41695 |
| TTCN_59 | 27637 | ATCN_2801 | 41696 |
| CTCN_45 | 27638 | CTCN_4923 | 41697 |
| ATCN_44 | 27639 | CTCN_4924 | 41698 |
| TTCN_60 | 27640 | TTCN_3969 | 41699 |
| ATCN_45 | 27641 | GTCN_2548 | 41700 |
| TTCN_61 | 27642 | GTCN_2549 | 41701 |
| ATCN_46 | 27643 | GTCN_2550 | 41702 |
| CTCN_46 | 27644 | ATCN_2802 | 41703 |
| TTCN_62 | 27645 | CTCN_4925 | 41704 |
| TTCN_63 | 27646 | TTCN_3970 | 41705 |
| GTCN_34 | 27647 | CTCN_4926 | 41706 |
| CTCN_47 | 27648 | TTCN_3971 | 41707 |
| GTCN_35 | 27649 | GTCN_2551 | 41708 |
| GTCN_36 | 27650 | GTCN_2552 | 41709 |
| TTCN_64 | 27651 | TTCN_3972 | 41710 |
| TTCN_65 | 27652 | TTCN_3973 | 41711 |
| TTCN_66 | 27653 | ATCN_2803 | 41712 |
| CTCN_48 | 27654 | CTCN_4927 | 41713 |
| GTCN_37 | 27655 | CTCN_4928 | 41714 |
| TTCN_67 | 27656 | TTCN_3974 | 41715 |
| GTCN_38 | 27657 | CTCN_4929 | 41716 |
| CTCN_49 | 27658 | TTCN_3975 | 41717 |
| TTCN_68 | 27659 | GTCN_2553 | 41718 |
| ATCN_47 | 27660 | GTCN_2554 | 41719 |
| ATCN_48 | 27661 | ATCN_2804 | 41720 |
| TTCN_69 | 27662 | TTCN_3976 | 41721 |
| GTCN_39 | 27663 | GTCN_2555 | 41722 |
| TTCN_70 | 27664 | TTCN_3977 | 41723 |
| GTCN_40 | 27665 | TTCN_3978 | 41724 |

| | | | |
|---|---|---|---|
| TTCN_71 | 27666 | CTCN_4930 | 41725 |
| GTCN_41 | 27667 | ATCN_2805 | 41726 |
| TTCN_72 | 27668 | GTCN_2556 | 41727 |
| CTCN_50 | 27669 | CTCN_4931 | 41728 |
| CTCN_51 | 27670 | CTCN_4932 | 41729 |
| CTCN_52 | 27671 | CTCN_4933 | 41730 |
| CTCN_53 | 27672 | CTCN_4934 | 41731 |
| CTCN_54 | 27673 | CTCN_4935 | 41732 |
| GTCN_42 | 27674 | CTCN_4936 | 41733 |
| TTCN_73 | 27675 | GTCN_2557 | 41734 |
| GTCN_43 | 27676 | ATCN_2806 | 41735 |
| CTCN_55 | 27677 | ATCN_2807 | 41736 |
| CTCN_56 | 27678 | GTCN_2558 | 41737 |
| GTCN_44 | 27679 | ATCN_2808 | 41738 |
| GTCN_45 | 27680 | TTCN_3979 | 41739 |
| CTCN_57 | 27681 | GTCN_2559 | 41740 |
| GTCN_46 | 27682 | TTCN_3980 | 41741 |
| GTCN_47 | 27683 | ATCN_2809 | 41742 |
| GTCN_48 | 27684 | TTCN_3981 | 41743 |
| CTCN_58 | 27685 | ATCN_2810 | 41744 |
| TTCN_74 | 27686 | ATCN_2811 | 41745 |
| GTCN_49 | 27687 | CTCN_4937 | 41746 |
| ATCN_49 | 27688 | ATCN_2812 | 41747 |
| TTCN_75 | 27689 | ATCN_2813 | 41748 |
| CTCN_59 | 27690 | ATCN_2814 | 41749 |
| CTCN_60 | 27691 | CTCN_4938 | 41750 |
| GTCN_50 | 27692 | GTCN_2560 | 41751 |
| CTCN_61 | 27693 | CTCN_4939 | 41752 |
| TTCN_76 | 27694 | CTCN_4940 | 41753 |
| CTCN_62 | 27695 | CTCN_4941 | 41754 |
| TTCN_77 | 27696 | GTCN_2561 | 41755 |
| CTCN_63 | 27697 | TTCN_3982 | 41756 |
| TTCN_78 | 27698 | TTCN_3983 | 41757 |
| CTCN_64 | 27699 | GTCN_2562 | 41758 |
| CTCN_65 | 27700 | GTCN_2563 | 41759 |
| ATCN_50 | 27701 | GTCN_2564 | 41760 |
| ATCN_51 | 27702 | ATCN_2815 | 41761 |
| TTCN_79 | 27703 | CTCN_4942 | 41762 |
| GTCN_51 | 27704 | GTCN_2565 | 41763 |
| GTCN_52 | 27705 | ATCN_2816 | 41764 |
| TTCN_80 | 27706 | CTCN_4943 | 41765 |
| TTCN_81 | 27707 | ATCN_2817 | 41766 |
| CTCN_66 | 27708 | CTCN_4944 | 41767 |

FIG. 37 (continued)

| | | | |
|---|---|---|---|
| CTCN_67 | 27709 | CTCN_4945 | 41768 |
| TTCN_82 | 27710 | CTCN_4946 | 41769 |
| TTCN_83 | 27711 | GTCN_2566 | 41770 |
| CTCN_68 | 27712 | CTCN_4947 | 41771 |
| CTCN_69 | 27713 | CTCN_4948 | 41772 |
| TTCN_84 | 27714 | GTCN_2567 | 41773 |
| GTCN_53 | 27715 | GTCN_2568 | 41774 |
| GTCN_54 | 27716 | CTCN_4949 | 41775 |
| TTCN_85 | 27717 | ATCN_2818 | 41776 |
| CTCN_70 | 27718 | ATCN_2819 | 41777 |
| TTCN_86 | 27719 | GTCN_2569 | 41778 |
| CTCN_71 | 27720 | TTCN_3984 | 41779 |
| TTCN_87 | 27721 | ATCN_2820 | 41780 |
| GTCN_55 | 27722 | ATCN_2821 | 41781 |
| ATCN_52 | 27723 | CTCN_4950 | 41782 |
| CTCN_72 | 27724 | TTCN_3985 | 41783 |
| CTCN_73 | 27725 | CTCN_4951 | 41784 |
| GTCN_56 | 27726 | TTCN_3986 | 41785 |
| GTCN_57 | 27727 | GTCN_2570 | 41786 |
| CTCN_74 | 27728 | CTCN_4952 | 41787 |
| GTCN_58 | 27729 | TTCN_3987 | 41788 |
| TTCN_88 | 27730 | TTCN_3988 | 41789 |
| GTCN_59 | 27731 | ATCN_2822 | 41790 |
| CTCN_75 | 27732 | CTCN_4953 | 41791 |
| GTCN_60 | 27733 | GTCN_2571 | 41792 |
| CTCN_76 | 27734 | CTCN_4954 | 41793 |
| CTCN_77 | 27735 | ATCN_2823 | 41794 |
| GTCN_61 | 27736 | TTCN_3989 | 41795 |
| GTCN_62 | 27737 | GTCN_2572 | 41796 |
| CTCN_78 | 27738 | GTCN_2573 | 41797 |
| TTCN_89 | 27739 | CTCN_4955 | 41798 |
| ATCN_53 | 27740 | CTCN_4956 | 41799 |
| TTCN_90 | 27741 | CTCN_4957 | 41800 |
| TTCN_91 | 27742 | TTCN_3990 | 41801 |
| GTCN_63 | 27743 | ATCN_2824 | 41802 |
| CTCN_79 | 27744 | ATCN_2825 | 41803 |
| GTCN_64 | 27745 | GTCN_2574 | 41804 |
| TTCN_92 | 27746 | CTCN_4958 | 41805 |
| GTCN_65 | 27747 | GTCN_2575 | 41806 |
| ATCN_54 | 27748 | CTCN_4959 | 41807 |
| CTCN_80 | 27749 | TTCN_3991 | 41808 |
| TTCN_93 | 27750 | CTCN_4960 | 41809 |
| GTCN_66 | 27751 | ATCN_2826 | 41810 |

| | | | |
|---|---|---|---|
| TTCN_94 | 27752 | ATCN_2827 | 41811 |
| TTCN_95 | 27753 | ATCN_2828 | 41812 |
| CTCN_81 | 27754 | TTCN_3992 | 41813 |
| CTCN_82 | 27755 | GTCN_2576 | 41814 |
| ATCN_55 | 27756 | CTCN_4961 | 41815 |
| TTCN_96 | 27757 | CTCN_4962 | 41816 |
| CTCN_83 | 27758 | GTCN_2577 | 41817 |
| CTCN_84 | 27759 | CTCN_4963 | 41818 |
| TTCN_97 | 27760 | CTCN_4964 | 41819 |
| TTCN_98 | 27761 | CTCN_4965 | 41820 |
| ATCN_56 | 27762 | CTCN_4966 | 41821 |
| ATCN_57 | 27763 | TTCN_3993 | 41822 |
| CTCN_85 | 27764 | CTCN_4967 | 41823 |
| GTCN_67 | 27765 | CTCN_4968 | 41824 |
| GTCN_68 | 27766 | GTCN_2578 | 41825 |
| ATCN_58 | 27767 | GTCN_2579 | 41826 |
| ATCN_59 | 27768 | TTCN_3994 | 41827 |
| GTCN_69 | 27769 | GTCN_2580 | 41828 |
| CTCN_86 | 27770 | CTCN_4969 | 41829 |
| CTCN_87 | 27771 | TTCN_3995 | 41830 |
| TTCN_99 | 27772 | CTCN_4970 | 41831 |
| CTCN_88 | 27773 | ATCN_2829 | 41832 |
| TTCN_100 | 27774 | CTCN_4971 | 41833 |
| ATCN_60 | 27775 | CTCN_4972 | 41834 |
| TTCN_101 | 27776 | ATCN_2830 | 41835 |
| ATCN_61 | 27777 | TTCN_3996 | 41836 |
| CTCN_89 | 27778 | TTCN_3997 | 41837 |
| CTCN_90 | 27779 | TTCN_3998 | 41838 |
| GTCN_70 | 27780 | ATCN_2831 | 41839 |
| CTCN_91 | 27781 | CTCN_4973 | 41840 |
| CTCN_92 | 27782 | GTCN_2581 | 41841 |
| TTCN_102 | 27783 | GTCN_2582 | 41842 |
| GTCN_71 | 27784 | CTCN_4974 | 41843 |
| CTCN_93 | 27785 | CTCN_4975 | 41844 |
| CTCN_94 | 27786 | ATCN_2832 | 41845 |
| GTCN_72 | 27787 | GTCN_2583 | 41846 |
| TTCN_103 | 27788 | CTCN_4976 | 41847 |
| TTCN_104 | 27789 | CTCN_4977 | 41848 |
| GTCN_73 | 27790 | TTCN_3999 | 41849 |
| CTCN_95 | 27791 | CTCN_4978 | 41850 |
| GTCN_74 | 27792 | TTCN_4000 | 41851 |
| GTCN_75 | 27793 | GTCN_2584 | 41852 |
| CTCN_96 | 27794 | GTCN_2585 | 41853 |

FIG. 37 (continued)

| | | | |
|---|---|---|---|
| ATCN_62 | 27795 | CTCN_4979 | 41854 |
| ATCN_63 | 27796 | CTCN_4980 | 41855 |
| CTCN_97 | 27797 | GTCN_2586 | 41856 |
| CTCN_98 | 27798 | CTCN_4981 | 41857 |
| TTCN_105 | 27799 | TTCN_4001 | 41858 |
| CTCN_99 | 27800 | CTCN_4982 | 41859 |
| CTCN_100 | 27801 | TTCN_4002 | 41860 |
| TTCN_106 | 27802 | TTCN_4003 | 41861 |
| ATCN_64 | 27803 | GTCN_2587 | 41862 |
| TTCN_107 | 27804 | CTCN_4983 | 41863 |
| CTCN_101 | 27805 | GTCN_2588 | 41864 |
| CTCN_102 | 27806 | CTCN_4984 | 41865 |
| GTCN_76 | 27807 | ATCN_2833 | 41866 |
| CTCN_103 | 27808 | ATCN_2834 | 41867 |
| CTCN_104 | 27809 | TTCN_4004 | 41868 |
| GTCN_77 | 27810 | CTCN_4985 | 41869 |
| TTCN_108 | 27811 | CTCN_4986 | 41870 |
| CTCN_105 | 27812 | TTCN_4005 | 41871 |
| TTCN_109 | 27813 | ATCN_2835 | 41872 |
| GTCN_78 | 27814 | TTCN_4006 | 41873 |
| GTCN_79 | 27815 | TTCN_4007 | 41874 |
| CTCN_106 | 27816 | TTCN_4008 | 41875 |
| TTCN_110 | 27817 | CTCN_4987 | 41876 |
| CTCN_107 | 27818 | CTCN_4988 | 41877 |
| GTCN_80 | 27819 | GTCN_2589 | 41878 |
| CTCN_108 | 27820 | ATCN_2836 | 41879 |
| ATCN_65 | 27821 | GTCN_2590 | 41880 |
| ATCN_66 | 27822 | TTCN_4009 | 41881 |
| CTCN_109 | 27823 | CTCN_4989 | 41882 |
| ATCN_67 | 27824 | GTCN_2591 | 41883 |
| CTCN_110 | 27825 | GTCN_2592 | 41884 |
| CTCN_111 | 27826 | CTCN_4990 | 41885 |
| TTCN_111 | 27827 | CTCN_4991 | 41886 |
| ATCN_68 | 27828 | GTCN_2593 | 41887 |
| TTCN_112 | 27829 | CTCN_4992 | 41888 |
| CTCN_112 | 27830 | ATCN_2837 | 41889 |
| TTCN_113 | 27831 | ATCN_2838 | 41890 |
| CTCN_113 | 27832 | CTCN_4993 | 41891 |
| CTCN_114 | 27833 | CTCN_4994 | 41892 |
| CTCN_115 | 27834 | ATCN_2839 | 41893 |
| GTCN_81 | 27835 | CTCN_4995 | 41894 |
| ATCN_69 | 27836 | CTCN_4996 | 41895 |
| ATCN_70 | 27837 | TTCN_4010 | 41896 |

| | | | |
|---|---|---|---|
| TTCN_114 | 27838 | TTCN_4011 | 41897 |
| ATCN_71 | 27839 | CTCN_4997 | 41898 |
| ATCN_72 | 27840 | CTCN_4998 | 41899 |
| GTCN_82 | 27841 | CTCN_4999 | 41900 |
| TTCN_115 | 27842 | GTCN_2594 | 41901 |
| GTCN_83 | 27843 | GTCN_2595 | 41902 |
| CTCN_116 | 27844 | GTCN_2596 | 41903 |
| CTCN_117 | 27845 | CTCN_5000 | 41904 |
| CTCN_118 | 27846 | TTCN_4012 | 41905 |
| TTCN_116 | 27847 | GTCN_2597 | 41906 |
| TTCN_117 | 27848 | ATCN_2840 | 41907 |
| CTCN_119 | 27849 | TTCN_4013 | 41908 |
| ATCN_73 | 27850 | ATCN_2841 | 41909 |
| CTCN_120 | 27851 | TTCN_4014 | 41910 |
| GTCN_84 | 27852 | GTCN_2598 | 41911 |
| CTCN_121 | 27853 | GTCN_2599 | 41912 |
| ATCN_74 | 27854 | CTCN_5001 | 41913 |
| CTCN_122 | 27855 | GTCN_2600 | 41914 |
| CTCN_123 | 27856 | ATCN_2842 | 41915 |
| ATCN_75 | 27857 | TTCN_4015 | 41916 |
| ATCN_76 | 27858 | GTCN_2601 | 41917 |
| ATCN_77 | 27859 | CTCN_5002 | 41918 |
| CTCN_124 | 27860 | CTCN_5003 | 41919 |
| GTCN_85 | 27861 | TTCN_4016 | 41920 |
| CTCN_125 | 27862 | GTCN_2602 | 41921 |
| TTCN_118 | 27863 | TTCN_4017 | 41922 |
| CTCN_126 | 27864 | TTCN_4018 | 41923 |
| GTCN_86 | 27865 | TTCN_4019 | 41924 |
| TTCN_119 | 27866 | GTCN_2603 | 41925 |
| GTCN_87 | 27867 | TTCN_4020 | 41926 |
| CTCN_127 | 27868 | GTCN_2604 | 41927 |
| CTCN_128 | 27869 | CTCN_5004 | 41928 |
| CTCN_129 | 27870 | GTCN_2605 | 41929 |
| CTCN_130 | 27871 | GTCN_2606 | 41930 |
| CTCN_131 | 27872 | CTCN_5005 | 41931 |
| ATCN_78 | 27873 | TTCN_4021 | 41932 |
| ATCN_79 | 27874 | CTCN_5006 | 41933 |
| TTCN_120 | 27875 | ATCN_2843 | 41934 |
| CTCN_132 | 27876 | ATCN_2844 | 41935 |
| CTCN_133 | 27877 | CTCN_5007 | 41936 |
| CTCN_134 | 27878 | TTCN_4022 | 41937 |
| CTCN_135 | 27879 | CTCN_5008 | 41938 |
| ATCN_80 | 27880 | ATCN_2845 | 41939 |

FIG. 37 (continued)

| | | | |
|---|---|---|---|
| ATCN_81 | 27881 | GTCN_2607 | 41940 |
| CTCN_136 | 27882 | CTCN_5009 | 41941 |
| GTCN_88 | 27883 | CTCN_5010 | 41942 |
| CTCN_137 | 27884 | GTCN_2608 | 41943 |
| CTCN_138 | 27885 | CTCN_5011 | 41944 |
| GTCN_89 | 27886 | TTCN_4023 | 41945 |
| GTCN_90 | 27887 | GTCN_2609 | 41946 |
| CTCN_139 | 27888 | CTCN_5012 | 41947 |
| TTCN_121 | 27889 | GTCN_2610 | 41948 |
| TTCN_122 | 27890 | CTCN_5013 | 41949 |
| CTCN_140 | 27891 | GTCN_2611 | 41950 |
| TTCN_123 | 27892 | TTCN_4024 | 41951 |
| ATCN_82 | 27893 | GTCN_2612 | 41952 |
| CTCN_141 | 27894 | CTCN_5014 | 41953 |
| GTCN_91 | 27895 | TTCN_4025 | 41954 |
| CTCN_142 | 27896 | TTCN_4026 | 41955 |
| CTCN_143 | 27897 | GTCN_2613 | 41956 |
| GTCN_92 | 27898 | GTCN_2614 | 41957 |
| TTCN_124 | 27899 | CTCN_5015 | 41958 |
| CTCN_144 | 27900 | TTCN_4027 | 41959 |
| CTCN_145 | 27901 | GTCN_2615 | 41960 |
| CTCN_146 | 27902 | CTCN_5016 | 41961 |
| CTCN_147 | 27903 | TTCN_4028 | 41962 |
| CTCN_148 | 27904 | CTCN_5017 | 41963 |
| TTCN_125 | 27905 | CTCN_5018 | 41964 |
| GTCN_93 | 27906 | GTCN_2616 | 41965 |
| TTCN_126 | 27907 | TTCN_4029 | 41966 |
| ATCN_83 | 27908 | CTCN_5019 | 41967 |
| CTCN_149 | 27909 | ATCN_2846 | 41968 |
| ATCN_84 | 27910 | CTCN_5020 | 41969 |
| CTCN_150 | 27911 | CTCN_5021 | 41970 |
| TTCN_127 | 27912 | CTCN_5022 | 41971 |
| TTCN_128 | 27913 | GTCN_2617 | 41972 |
| TTCN_129 | 27914 | TTCN_4030 | 41973 |
| TTCN_130 | 27915 | TTCN_4031 | 41974 |
| TTCN_131 | 27916 | GTCN_2618 | 41975 |
| CTCN_151 | 27917 | TTCN_4032 | 41976 |
| TTCN_132 | 27918 | CTCN_5023 | 41977 |
| CTCN_152 | 27919 | GTCN_2619 | 41978 |
| TTCN_133 | 27920 | CTCN_5024 | 41979 |
| ATCN_85 | 27921 | CTCN_5025 | 41980 |
| TTCN_134 | 27922 | GTCN_2620 | 41981 |
| TTCN_135 | 27923 | GTCN_2621 | 41982 |

| | | | |
|---|---|---|---|
| TTCN_136 | 27924 | TTCN_4033 | 41983 |
| CTCN_153 | 27925 | ATCN_2847 | 41984 |
| TTCN_137 | 27926 | ATCN_2848 | 41985 |
| TTCN_138 | 27927 | CTCN_5026 | 41986 |
| TTCN_139 | 27928 | CTCN_5027 | 41987 |
| GTCN_94 | 27929 | CTCN_5028 | 41988 |
| GTCN_95 | 27930 | ATCN_2849 | 41989 |
| CTCN_154 | 27931 | ATCN_2850 | 41990 |
| CTCN_155 | 27932 | CTCN_5029 | 41991 |
| CTCN_156 | 27933 | CTCN_5030 | 41992 |
| TTCN_140 | 27934 | CTCN_5031 | 41993 |
| GTCN_96 | 27935 | TTCN_4034 | 41994 |
| ATCN_86 | 27936 | GTCN_2622 | 41995 |
| CTCN_157 | 27937 | CTCN_5032 | 41996 |
| ATCN_87 | 27938 | GTCN_2623 | 41997 |
| ATCN_88 | 27939 | ATCN_2851 | 41998 |
| CTCN_158 | 27940 | CTCN_5033 | 41999 |
| ATCN_89 | 27941 | GTCN_2624 | 42000 |
| GTCN_97 | 27942 | CTCN_5034 | 42001 |
| GTCN_98 | 27943 | GTCN_2625 | 42002 |
| GTCN_99 | 27944 | TTCN_4035 | 42003 |
| ATCN_90 | 27945 | CTCN_5035 | 42004 |
| TTCN_141 | 27946 | CTCN_5036 | 42005 |
| CTCN_159 | 27947 | ATCN_2852 | 42006 |
| GTCN_100 | 27948 | TTCN_4036 | 42007 |
| CTCN_160 | 27949 | CTCN_5037 | 42008 |
| GTCN_101 | 27950 | CTCN_5038 | 42009 |
| GTCN_102 | 27951 | CTCN_5039 | 42010 |
| CTCN_161 | 27952 | ATCN_2853 | 42011 |
| ATCN_91 | 27953 | TTCN_4037 | 42012 |
| CTCN_162 | 27954 | TTCN_4038 | 42013 |
| ATCN_92 | 27955 | TTCN_4039 | 42014 |
| TTCN_142 | 27956 | GTCN_2626 | 42015 |
| ATCN_93 | 27957 | ATCN_2854 | 42016 |
| CTCN_163 | 27958 | GTCN_2627 | 42017 |
| TTCN_143 | 27959 | CTCN_5040 | 42018 |
| CTCN_164 | 27960 | TTCN_4040 | 42019 |
| CTCN_165 | 27961 | CTCN_5041 | 42020 |
| GTCN_103 | 27962 | CTCN_5042 | 42021 |
| ATCN_94 | 27963 | GTCN_2628 | 42022 |
| ATCN_95 | 27964 | CTCN_5043 | 42023 |
| GTCN_104 | 27965 | TTCN_4041 | 42024 |
| TTCN_144 | 27966 | CTCN_5044 | 42025 |

FIG. 37 (continued)

| | | | |
|---|---|---|---|
| GTCN_105 | 27967 | CTCN_5045 | 42026 |
| TTCN_145 | 27968 | GTCN_2629 | 42027 |
| GTCN_106 | 27969 | TTCN_4042 | 42028 |
| ATCN_96 | 27970 | TTCN_4043 | 42029 |
| CTCN_166 | 27971 | TTCN_4044 | 42030 |
| CTCN_167 | 27972 | TTCN_4045 | 42031 |
| GTCN_107 | 27973 | ATCN_2855 | 42032 |
| ATCN_97 | 27974 | CTCN_5046 | 42033 |
| GTCN_108 | 27975 | TTCN_4046 | 42034 |
| CTCN_168 | 27976 | TTCN_4047 | 42035 |
| CTCN_169 | 27977 | TTCN_4048 | 42036 |
| TTCN_146 | 27978 | CTCN_5047 | 42037 |
| CTCN_170 | 27979 | CTCN_5048 | 42038 |
| ATCN_98 | 27980 | GTCN_2630 | 42039 |
| GTCN_109 | 27981 | CTCN_5049 | 42040 |
| CTCN_171 | 27982 | GTCN_2631 | 42041 |
| GTCN_110 | 27983 | CTCN_5050 | 42042 |
| CTCN_172 | 27984 | CTCN_5051 | 42043 |
| CTCN_173 | 27985 | CTCN_5052 | 42044 |
| ATCN_99 | 27986 | GTCN_2632 | 42045 |
| GTCN_111 | 27987 | CTCN_5053 | 42046 |
| TTCN_147 | 27988 | GTCN_2633 | 42047 |
| GTCN_112 | 27989 | CTCN_5054 | 42048 |
| CTCN_174 | 27990 | GTCN_2634 | 42049 |
| GTCN_113 | 27991 | TTCN_4049 | 42050 |
| ATCN_100 | 27992 | GTCN_2635 | 42051 |
| TTCN_148 | 27993 | TTCN_4050 | 42052 |
| CTCN_175 | 27994 | CTCN_5055 | 42053 |
| CTCN_176 | 27995 | TTCN_4051 | 42054 |
| ATCN_101 | 27996 | CTCN_5056 | 42055 |
| TTCN_149 | 27997 | GTCN_2636 | 42056 |
| ATCN_102 | 27998 | TTCN_4052 | 42057 |
| ATCN_103 | 27999 | CTCN_5057 | 42058 |
| ATCN_104 | 28000 | GTCN_2637 | 42059 |
| ATCN_105 | 28001 | CTCN_5058 | 42060 |
| CTCN_177 | 28002 | TTCN_4053 | 42061 |
| ATCN_106 | 28003 | TTCN_4054 | 42062 |
| CTCN_178 | 28004 | GTCN_2638 | 42063 |
| ATCN_107 | 28005 | ATCN_2856 | 42064 |
| TTCN_150 | 28006 | CTCN_5059 | 42065 |
| ATCN_108 | 28007 | CTCN_5060 | 42066 |
| CTCN_179 | 28008 | TTCN_4055 | 42067 |
| CTCN_180 | 28009 | CTCN_5061 | 42068 |

| | | | |
|---|---|---|---|
| ATCN_109 | 28010 | CTCN_5062 | 42069 |
| ATCN_110 | 28011 | ATCN_2857 | 42070 |
| CTCN_181 | 28012 | ATCN_2858 | 42071 |
| GTCN_114 | 28013 | GTCN_2639 | 42072 |
| CTCN_182 | 28014 | ATCN_2859 | 42073 |
| CTCN_183 | 28015 | TTCN_4056 | 42074 |
| GTCN_115 | 28016 | CTCN_5063 | 42075 |
| TTCN_151 | 28017 | CTCN_5064 | 42076 |
| GTCN_116 | 28018 | CTCN_5065 | 42077 |
| CTCN_184 | 28019 | CTCN_5066 | 42078 |
| GTCN_117 | 28020 | CTCN_5067 | 42079 |
| CTCN_185 | 28021 | CTCN_5068 | 42080 |
| CTCN_186 | 28022 | GTCN_2640 | 42081 |
| CTCN_187 | 28023 | CTCN_5069 | 42082 |
| CTCN_188 | 28024 | GTCN_2641 | 42083 |
| TTCN_152 | 28025 | CTCN_5070 | 42084 |
| ATCN_111 | 28026 | TTCN_4057 | 42085 |
| TTCN_153 | 28027 | ATCN_2860 | 42086 |
| CTCN_189 | 28028 | GTCN_2642 | 42087 |
| CTCN_190 | 28029 | ATCN_2861 | 42088 |
| GTCN_118 | 28030 | ATCN_2862 | 42089 |
| ATCN_112 | 28031 | ATCN_2863 | 42090 |
| CTCN_191 | 28032 | GTCN_2643 | 42091 |
| GTCN_119 | 28033 | CTCN_5071 | 42092 |
| GTCN_120 | 28034 | CTCN_5072 | 42093 |
| GTCN_121 | 28035 | TTCN_4058 | 42094 |
| CTCN_192 | 28036 | ATCN_2864 | 42095 |
| ATCN_113 | 28037 | ATCN_2865 | 42096 |
| ATCN_114 | 28038 | TTCN_4059 | 42097 |
| ATCN_115 | 28039 | CTCN_5073 | 42098 |
| GTCN_122 | 28040 | GTCN_2644 | 42099 |
| ATCN_116 | 28041 | ATCN_2866 | 42100 |
| TTCN_154 | 28042 | ATCN_2867 | 42101 |
| GTCN_123 | 28043 | GTCN_2645 | 42102 |
| TTCN_155 | 28044 | CTCN_5074 | 42103 |
| CTCN_193 | 28045 | CTCN_5075 | 42104 |
| GTCN_124 | 28046 | CTCN_5076 | 42105 |
| ATCN_117 | 28047 | CTCN_5077 | 42106 |
| ATCN_118 | 28048 | CTCN_5078 | 42107 |
| CTCN_194 | 28049 | CTCN_5079 | 42108 |
| CTCN_195 | 28050 | ATCN_2868 | 42109 |
| GTCN_125 | 28051 | ATCN_2869 | 42110 |
| ATCN_119 | 28052 | ATCN_2870 | 42111 |

FIG. 37 (continued)

| | | | |
|---|---|---|---|
| TTCN_156 | 28053 | GTCN_2646 | 42112 |
| ATCN_120 | 28054 | GTCN_2647 | 42113 |
| TTCN_157 | 28055 | GTCN_2648 | 42114 |
| CTCN_196 | 28056 | ATCN_2871 | 42115 |
| ATCN_121 | 28057 | ATCN_2872 | 42116 |
| GTCN_126 | 28058 | TTCN_4060 | 42117 |
| ATCN_122 | 28059 | CTCN_5080 | 42118 |
| TTCN_158 | 28060 | GTCN_2649 | 42119 |
| TTCN_159 | 28061 | CTCN_5081 | 42120 |
| ATCN_123 | 28062 | ATCN_2873 | 42121 |
| TTCN_160 | 28063 | ATCN_2874 | 42122 |
| TTCN_161 | 28064 | CTCN_5082 | 42123 |
| GTCN_127 | 28065 | GTCN_2650 | 42124 |
| TTCN_162 | 28066 | CTCN_5083 | 42125 |
| TTCN_163 | 28067 | TTCN_4061 | 42126 |
| CTCN_197 | 28068 | CTCN_5084 | 42127 |
| CTCN_198 | 28069 | CTCN_5085 | 42128 |
| ATCN_124 | 28070 | ATCN_2875 | 42129 |
| TTCN_164 | 28071 | ATCN_2876 | 42130 |
| ATCN_125 | 28072 | CTCN_5086 | 42131 |
| CTCN_199 | 28073 | CTCN_5087 | 42132 |
| CTCN_200 | 28074 | CTCN_5088 | 42133 |
| GTCN_128 | 28075 | CTCN_5089 | 42134 |
| ATCN_126 | 28076 | TTCN_4062 | 42135 |
| TTCN_165 | 28077 | TTCN_4063 | 42136 |
| TTCN_166 | 28078 | CTCN_5090 | 42137 |
| TTCN_167 | 28079 | CTCN_5091 | 42138 |
| TTCN_168 | 28080 | CTCN_5092 | 42139 |
| GTCN_129 | 28081 | ATCN_2877 | 42140 |
| GTCN_130 | 28082 | CTCN_5093 | 42141 |
| GTCN_131 | 28083 | ATCN_2878 | 42142 |
| TTCN_169 | 28084 | CTCN_5094 | 42143 |
| TTCN_170 | 28085 | TTCN_4064 | 42144 |
| TTCN_171 | 28086 | ATCN_2879 | 42145 |
| TTCN_172 | 28087 | CTCN_5095 | 42146 |
| ATCN_127 | 28088 | ATCN_2880 | 42147 |
| ATCN_128 | 28089 | CTCN_5096 | 42148 |
| TTCN_173 | 28090 | CTCN_5097 | 42149 |
| GTCN_132 | 28091 | ATCN_2881 | 42150 |
| TTCN_174 | 28092 | ATCN_2882 | 42151 |
| TTCN_175 | 28093 | TTCN_4065 | 42152 |
| GTCN_133 | 28094 | TTCN_4066 | 42153 |
| CTCN_201 | 28095 | CTCN_5098 | 42154 |

| | | | |
|---|---|---|---|
| GTCN_134 | 28096 | TTCN_4067 | 42155 |
| GTCN_135 | 28097 | CTCN_5099 | 42156 |
| ATCN_129 | 28098 | ATCN_2883 | 42157 |
| ATCN_130 | 28099 | GTCN_2651 | 42158 |
| GTCN_136 | 28100 | GTCN_2652 | 42159 |
| TTCN_176 | 28101 | CTCN_5100 | 42160 |
| TTCN_177 | 28102 | CTCN_5101 | 42161 |
| GTCN_137 | 28103 | CTCN_5102 | 42162 |
| ATCN_131 | 28104 | ATCN_2884 | 42163 |
| GTCN_138 | 28105 | CTCN_5103 | 42164 |
| ATCN_132 | 28106 | GTCN_2653 | 42165 |
| TTCN_178 | 28107 | CTCN_5104 | 42166 |
| CTCN_202 | 28108 | GTCN_2654 | 42167 |
| ATCN_133 | 28109 | CTCN_5105 | 42168 |
| GTCN_139 | 28110 | TTCN_4068 | 42169 |
| GTCN_140 | 28111 | CTCN_5106 | 42170 |
| TTCN_179 | 28112 | ATCN_2885 | 42171 |
| ATCN_134 | 28113 | CTCN_5107 | 42172 |
| TTCN_180 | 28114 | CTCN_5108 | 42173 |
| CTCN_203 | 28115 | TTCN_4069 | 42174 |
| CTCN_204 | 28116 | CTCN_5109 | 42175 |
| GTCN_141 | 28117 | CTCN_5110 | 42176 |
| TTCN_181 | 28118 | GTCN_2655 | 42177 |
| CTCN_205 | 28119 | CTCN_5111 | 42178 |
| GTCN_142 | 28120 | CTCN_5112 | 42179 |
| ATCN_135 | 28121 | TTCN_4070 | 42180 |
| CTCN_206 | 28122 | ATCN_2886 | 42181 |
| ATCN_136 | 28123 | TTCN_4071 | 42182 |
| ATCN_137 | 28124 | CTCN_5113 | 42183 |
| CTCN_207 | 28125 | TTCN_4072 | 42184 |
| CTCN_208 | 28126 | CTCN_5114 | 42185 |
| CTCN_209 | 28127 | CTCN_5115 | 42186 |
| TTCN_182 | 28128 | GTCN_2656 | 42187 |
| TTCN_183 | 28129 | ATCN_2887 | 42188 |
| GTCN_143 | 28130 | TTCN_4073 | 42189 |
| CTCN_210 | 28131 | TTCN_4074 | 42190 |
| GTCN_144 | 28132 | CTCN_5116 | 42191 |
| CTCN_211 | 28133 | TTCN_4075 | 42192 |
| TTCN_184 | 28134 | TTCN_4076 | 42193 |
| TTCN_185 | 28135 | TTCN_4077 | 42194 |
| CTCN_212 | 28136 | CTCN_5117 | 42195 |
| CTCN_213 | 28137 | CTCN_5118 | 42196 |
| CTCN_214 | 28138 | ATCN_2888 | 42197 |

FIG. 37 (continued)

| | | | |
|---|---|---|---|
| CTCN_215 | 28139 | TTCN_4078 | 42198 |
| GTCN_145 | 28140 | CTCN_5119 | 42199 |
| CTCN_216 | 28141 | ATCN_2889 | 42200 |
| GTCN_146 | 28142 | TTCN_4079 | 42201 |
| GTCN_147 | 28143 | GTCN_2657 | 42202 |
| TTCN_186 | 28144 | TTCN_4080 | 42203 |
| GTCN_148 | 28145 | CTCN_5120 | 42204 |
| GTCN_149 | 28146 | ATCN_2890 | 42205 |
| CTCN_217 | 28147 | ATCN_2891 | 42206 |
| TTCN_187 | 28148 | TTCN_4081 | 42207 |
| CTCN_218 | 28149 | GTCN_2658 | 42208 |
| GTCN_150 | 28150 | CTCN_5121 | 42209 |
| GTCN_151 | 28151 | GTCN_2659 | 42210 |
| CTCN_219 | 28152 | GTCN_2660 | 42211 |
| GTCN_152 | 28153 | CTCN_5122 | 42212 |
| CTCN_220 | 28154 | CTCN_5123 | 42213 |
| CTCN_221 | 28155 | CTCN_5124 | 42214 |
| GTCN_153 | 28156 | TTCN_4082 | 42215 |
| TTCN_188 | 28157 | ATCN_2892 | 42216 |
| TTCN_189 | 28158 | CTCN_5125 | 42217 |
| CTCN_222 | 28159 | CTCN_5126 | 42218 |
| TTCN_190 | 28160 | CTCN_5127 | 42219 |
| ATCN_138 | 28161 | TTCN_4083 | 42220 |
| TTCN_191 | 28162 | ATCN_2893 | 42221 |
| TTCN_192 | 28163 | CTCN_5128 | 42222 |
| CTCN_223 | 28164 | TTCN_4084 | 42223 |
| GTCN_154 | 28165 | TTCN_4085 | 42224 |
| CTCN_224 | 28166 | TTCN_4086 | 42225 |
| GTCN_155 | 28167 | GTCN_2661 | 42226 |
| TTCN_193 | 28168 | GTCN_2662 | 42227 |
| CTCN_225 | 28169 | TTCN_4087 | 42228 |
| CTCN_226 | 28170 | ATCN_2894 | 42229 |
| ATCN_139 | 28171 | TTCN_4088 | 42230 |
| CTCN_227 | 28172 | CTCN_5129 | 42231 |
| TTCN_194 | 28173 | GTCN_2663 | 42232 |
| GTCN_156 | 28174 | CTCN_5130 | 42233 |
| CTCN_228 | 28175 | GTCN_2664 | 42234 |
| ATCN_140 | 28176 | CTCN_5131 | 42235 |
| GTCN_157 | 28177 | GTCN_2665 | 42236 |
| ATCN_141 | 28178 | GTCN_2666 | 42237 |
| GTCN_158 | 28179 | TTCN_4089 | 42238 |
| TTCN_195 | 28180 | GTCN_2667 | 42239 |
| ATCN_142 | 28181 | TTCN_4090 | 42240 |

| | | | |
|---|---|---|---|
| ATCN_143 | 28182 | CTCN_5132 | 42241 |
| GTCN_159 | 28183 | GTCN_2668 | 42242 |
| ATCN_144 | 28184 | CTCN_5133 | 42243 |
| GTCN_160 | 28185 | CTCN_5134 | 42244 |
| ATCN_145 | 28186 | ATCN_2895 | 42245 |
| GTCN_161 | 28187 | TTCN_4091 | 42246 |
| CTCN_229 | 28188 | GTCN_2669 | 42247 |
| CTCN_230 | 28189 | ATCN_2896 | 42248 |
| CTCN_231 | 28190 | ATCN_2897 | 42249 |
| GTCN_162 | 28191 | ATCN_2898 | 42250 |
| TTCN_196 | 28192 | GTCN_2670 | 42251 |
| ATCN_146 | 28193 | CTCN_5135 | 42252 |
| ATCN_147 | 28194 | GTCN_2671 | 42253 |
| GTCN_163 | 28195 | ATCN_2899 | 42254 |
| CTCN_232 | 28196 | ATCN_2900 | 42255 |
| TTCN_197 | 28197 | ATCN_2901 | 42256 |
| CTCN_233 | 28198 | GTCN_2672 | 42257 |
| ATCN_148 | 28199 | CTCN_5136 | 42258 |
| CTCN_234 | 28200 | TTCN_4092 | 42259 |
| CTCN_235 | 28201 | GTCN_2673 | 42260 |
| CTCN_236 | 28202 | TTCN_4093 | 42261 |
| GTCN_164 | 28203 | GTCN_2674 | 42262 |
| ATCN_149 | 28204 | TTCN_4094 | 42263 |
| TTCN_198 | 28205 | CTCN_5137 | 42264 |
| CTCN_237 | 28206 | GTCN_2675 | 42265 |
| GTCN_165 | 28207 | CTCN_5138 | 42266 |
| CTCN_238 | 28208 | CTCN_5139 | 42267 |
| TTCN_199 | 28209 | GTCN_2676 | 42268 |
| CTCN_239 | 28210 | TTCN_4095 | 42269 |
| CTCN_240 | 28211 | TTCN_4096 | 42270 |
| CTCN_241 | 28212 | GTCN_2677 | 42271 |
| ATCN_150 | 28213 | CTCN_5140 | 42272 |
| TTCN_200 | 28214 | CTCN_5141 | 42273 |
| CTCN_242 | 28215 | TTCN_4097 | 42274 |
| TTCN_201 | 28216 | ATCN_2902 | 42275 |
| TTCN_202 | 28217 | ATCN_2903 | 42276 |
| GTCN_166 | 28218 | TTCN_4098 | 42277 |
| CTCN_243 | 28219 | GTCN_2678 | 42278 |
| ATCN_151 | 28220 | ATCN_2904 | 42279 |
| ATCN_152 | 28221 | GTCN_2679 | 42280 |
| CTCN_244 | 28222 | TTCN_4099 | 42281 |
| GTCN_167 | 28223 | GTCN_2680 | 42282 |
| ATCN_153 | 28224 | CTCN_5142 | 42283 |

FIG. 37 (continued)

| | | | |
|---|---|---|---|
| TTCN_203 | 28225 | TTCN_4100 | 42284 |
| CTCN_245 | 28226 | CTCN_5143 | 42285 |
| CTCN_246 | 28227 | CTCN_5144 | 42286 |
| TTCN_204 | 28228 | CTCN_5145 | 42287 |
| CTCN_247 | 28229 | CTCN_5146 | 42288 |
| TTCN_205 | 28230 | GTCN_2681 | 42289 |
| TTCN_206 | 28231 | CTCN_5147 | 42290 |
| CTCN_248 | 28232 | CTCN_5148 | 42291 |
| CTCN_249 | 28233 | GTCN_2682 | 42292 |
| TTCN_207 | 28234 | CTCN_5149 | 42293 |
| GTCN_168 | 28235 | TTCN_4101 | 42294 |
| CTCN_250 | 28236 | CTCN_5150 | 42295 |
| CTCN_251 | 28237 | CTCN_5151 | 42296 |
| CTCN_252 | 28238 | GTCN_2683 | 42297 |
| CTCN_253 | 28239 | TTCN_4102 | 42298 |
| GTCN_169 | 28240 | TTCN_4103 | 42299 |
| GTCN_170 | 28241 | ATCN_2905 | 42300 |
| CTCN_254 | 28242 | TTCN_4104 | 42301 |
| CTCN_255 | 28243 | TTCN_4105 | 42302 |
| GTCN_171 | 28244 | TTCN_4106 | 42303 |
| CTCN_256 | 28245 | ATCN_2906 | 42304 |
| CTCN_257 | 28246 | CTCN_5152 | 42305 |
| CTCN_258 | 28247 | CTCN_5153 | 42306 |
| CTCN_259 | 28248 | GTCN_2684 | 42307 |
| CTCN_260 | 28249 | CTCN_5154 | 42308 |
| TTCN_208 | 28250 | CTCN_5155 | 42309 |
| ATCN_154 | 28251 | TTCN_4107 | 42310 |
| TTCN_209 | 28252 | CTCN_5156 | 42311 |
| CTCN_261 | 28253 | CTCN_5157 | 42312 |
| CTCN_262 | 28254 | CTCN_5158 | 42313 |
| CTCN_263 | 28255 | GTCN_2685 | 42314 |
| GTCN_172 | 28256 | CTCN_5159 | 42315 |
| ATCN_155 | 28257 | CTCN_5160 | 42316 |
| CTCN_264 | 28258 | TTCN_4108 | 42317 |
| GTCN_173 | 28259 | GTCN_2686 | 42318 |
| TTCN_210 | 28260 | ATCN_2907 | 42319 |
| CTCN_265 | 28261 | TTCN_4109 | 42320 |
| CTCN_266 | 28262 | TTCN_4110 | 42321 |
| GTCN_174 | 28263 | TTCN_4111 | 42322 |
| CTCN_267 | 28264 | TTCN_4112 | 42323 |
| ATCN_156 | 28265 | ATCN_2908 | 42324 |
| ATCN_157 | 28266 | CTCN_5161 | 42325 |
| CTCN_268 | 28267 | CTCN_5162 | 42326 |

| | | | |
|---|---|---|---|
| CTCN_269 | 28268 | CTCN_5163 | 42327 |
| ATCN_158 | 28269 | TTCN_4113 | 42328 |
| CTCN_270 | 28270 | TTCN_4114 | 42329 |
| GTCN_175 | 28271 | TTCN_4115 | 42330 |
| CTCN_271 | 28272 | CTCN_5164 | 42331 |
| CTCN_272 | 28273 | TTCN_4116 | 42332 |
| CTCN_273 | 28274 | CTCN_5165 | 42333 |
| CTCN_274 | 28275 | ATCN_2909 | 42334 |
| GTCN_176 | 28276 | CTCN_5166 | 42335 |
| ATCN_159 | 28277 | CTCN_5167 | 42336 |
| GTCN_177 | 28278 | CTCN_5168 | 42337 |
| CTCN_275 | 28279 | TTCN_4117 | 42338 |
| GTCN_178 | 28280 | ATCN_2910 | 42339 |
| CTCN_276 | 28281 | ATCN_2911 | 42340 |
| ATCN_160 | 28282 | CTCN_5169 | 42341 |
| TTCN_211 | 28283 | CTCN_5170 | 42342 |
| GTCN_179 | 28284 | CTCN_5171 | 42343 |
| GTCN_180 | 28285 | CTCN_5172 | 42344 |
| CTCN_277 | 28286 | TTCN_4118 | 42345 |
| TTCN_212 | 28287 | TTCN_4119 | 42346 |
| TTCN_213 | 28288 | CTCN_5173 | 42347 |
| ATCN_161 | 28289 | CTCN_5174 | 42348 |
| CTCN_278 | 28290 | CTCN_5175 | 42349 |
| CTCN_279 | 28291 | CTCN_5176 | 42350 |
| CTCN_280 | 28292 | GTCN_2687 | 42351 |
| TTCN_214 | 28293 | CTCN_5177 | 42352 |
| TTCN_215 | 28294 | ATCN_2912 | 42353 |
| TTCN_216 | 28295 | TTCN_4120 | 42354 |
| TTCN_217 | 28296 | GTCN_2688 | 42355 |
| GTCN_181 | 28297 | CTCN_5178 | 42356 |
| TTCN_218 | 28298 | TTCN_4121 | 42357 |
| CTCN_281 | 28299 | CTCN_5179 | 42358 |
| GTCN_182 | 28300 | CTCN_5180 | 42359 |
| TTCN_219 | 28301 | ATCN_2913 | 42360 |
| GTCN_183 | 28302 | ATCN_2914 | 42361 |
| GTCN_184 | 28303 | CTCN_5181 | 42362 |
| TTCN_220 | 28304 | TTCN_4122 | 42363 |
| TTCN_221 | 28305 | ATCN_2915 | 42364 |
| TTCN_222 | 28306 | CTCN_5182 | 42365 |
| GTCN_185 | 28307 | TTCN_4123 | 42366 |
| CTCN_282 | 28308 | ATCN_2916 | 42367 |
| TTCN_223 | 28309 | TTCN_4124 | 42368 |
| CTCN_283 | 28310 | GTCN_2689 | 42369 |

FIG. 37 (continued)

| | | | |
|---|---|---|---|
| GTCN_186 | 28311 | GTCN_2690 | 42370 |
| CTCN_284 | 28312 | ATCN_2917 | 42371 |
| ATCN_162 | 28313 | TTCN_4125 | 42372 |
| GTCN_187 | 28314 | ATCN_2918 | 42373 |
| CTCN_285 | 28315 | TTCN_4126 | 42374 |
| TTCN_224 | 28316 | TTCN_4127 | 42375 |
| TTCN_225 | 28317 | TTCN_4128 | 42376 |
| CTCN_286 | 28318 | TTCN_4129 | 42377 |
| CTCN_287 | 28319 | GTCN_2691 | 42378 |
| CTCN_288 | 28320 | CTCN_5183 | 42379 |
| CTCN_289 | 28321 | GTCN_2692 | 42380 |
| ATCN_163 | 28322 | TTCN_4130 | 42381 |
| TTCN_226 | 28323 | GTCN_2693 | 42382 |
| TTCN_227 | 28324 | GTCN_2694 | 42383 |
| ATCN_164 | 28325 | CTCN_5184 | 42384 |
| GTCN_188 | 28326 | CTCN_5185 | 42385 |
| CTCN_290 | 28327 | CTCN_5186 | 42386 |
| CTCN_291 | 28328 | ATCN_2919 | 42387 |
| GTCN_189 | 28329 | ATCN_2920 | 42388 |
| CTCN_292 | 28330 | TTCN_4131 | 42389 |
| ATCN_165 | 28331 | GTCN_2695 | 42390 |
| TTCN_228 | 28332 | TTCN_4132 | 42391 |
| TTCN_229 | 28333 | TTCN_4133 | 42392 |
| TTCN_230 | 28334 | CTCN_5187 | 42393 |
| ATCN_166 | 28335 | TTCN_4134 | 42394 |
| ATCN_167 | 28336 | TTCN_4135 | 42395 |
| TTCN_231 | 28337 | ATCN_2921 | 42396 |
| GTCN_190 | 28338 | CTCN_5188 | 42397 |
| TTCN_232 | 28339 | CTCN_5189 | 42398 |
| GTCN_191 | 28340 | ATCN_2922 | 42399 |
| GTCN_192 | 28341 | TTCN_4136 | 42400 |
| CTCN_293 | 28342 | CTCN_5190 | 42401 |
| TTCN_233 | 28343 | GTCN_2696 | 42402 |
| ATCN_168 | 28344 | ATCN_2923 | 42403 |
| ATCN_169 | 28345 | TTCN_4137 | 42404 |
| TTCN_234 | 28346 | CTCN_5191 | 42405 |
| CTCN_294 | 28347 | TTCN_4138 | 42406 |
| CTCN_295 | 28348 | TTCN_4139 | 42407 |
| ATCN_170 | 28349 | TTCN_4140 | 42408 |
| GTCN_193 | 28350 | CTCN_5192 | 42409 |
| CTCN_296 | 28351 | CTCN_5193 | 42410 |
| GTCN_194 | 28352 | ATCN_2924 | 42411 |
| CTCN_297 | 28353 | GTCN_2697 | 42412 |

| | | | |
|---|---|---|---|
| CTCN_298 | 28354 | TTCN_4141 | 42413 |
| GTCN_195 | 28355 | TTCN_4142 | 42414 |
| CTCN_299 | 28356 | CTCN_5194 | 42415 |
| CTCN_300 | 28357 | TTCN_4143 | 42416 |
| ATCN_171 | 28358 | TTCN_4144 | 42417 |
| CTCN_301 | 28359 | CTCN_5195 | 42418 |
| CTCN_302 | 28360 | CTCN_5196 | 42419 |
| ATCN_172 | 28361 | TTCN_4145 | 42420 |
| GTCN_196 | 28362 | ATCN_2925 | 42421 |
| CTCN_303 | 28363 | CTCN_5197 | 42422 |
| CTCN_304 | 28364 | TTCN_4146 | 42423 |
| CTCN_305 | 28365 | CTCN_5198 | 42424 |
| TTCN_235 | 28366 | TTCN_4147 | 42425 |
| TTCN_236 | 28367 | TTCN_4148 | 42426 |
| CTCN_306 | 28368 | TTCN_4149 | 42427 |
| GTCN_197 | 28369 | CTCN_5199 | 42428 |
| GTCN_198 | 28370 | GTCN_2698 | 42429 |
| GTCN_199 | 28371 | TTCN_4150 | 42430 |
| CTCN_307 | 28372 | GTCN_2699 | 42431 |
| CTCN_308 | 28373 | ATCN_2926 | 42432 |
| GTCN_200 | 28374 | GTCN_2700 | 42433 |
| CTCN_309 | 28375 | CTCN_5200 | 42434 |
| CTCN_310 | 28376 | TTCN_4151 | 42435 |
| TTCN_237 | 28377 | CTCN_5201 | 42436 |
| ATCN_173 | 28378 | CTCN_5202 | 42437 |
| TTCN_238 | 28379 | ATCN_2927 | 42438 |
| TTCN_239 | 28380 | CTCN_5203 | 42439 |
| CTCN_311 | 28381 | CTCN_5204 | 42440 |
| CTCN_312 | 28382 | GTCN_2701 | 42441 |
| TTCN_240 | 28383 | GTCN_2702 | 42442 |
| CTCN_313 | 28384 | TTCN_4152 | 42443 |
| CTCN_314 | 28385 | GTCN_2703 | 42444 |
| ATCN_174 | 28386 | CTCN_5205 | 42445 |
| GTCN_201 | 28387 | CTCN_5206 | 42446 |
| CTCN_315 | 28388 | TTCN_4153 | 42447 |
| GTCN_202 | 28389 | TTCN_4154 | 42448 |
| ATCN_175 | 28390 | TTCN_4155 | 42449 |
| TTCN_241 | 28391 | CTCN_5207 | 42450 |
| GTCN_203 | 28392 | ATCN_2928 | 42451 |
| ATCN_176 | 28393 | TTCN_4156 | 42452 |
| TTCN_242 | 28394 | CTCN_5208 | 42453 |
| TTCN_243 | 28395 | CTCN_5209 | 42454 |
| TTCN_244 | 28396 | TTCN_4157 | 42455 |

FIG. 37 (continued)

| | | | |
|---|---|---|---|
| TTCN_245 | 28397 | ATCN_2929 | 42456 |
| TTCN_246 | 28398 | ATCN_2930 | 42457 |
| TTCN_247 | 28399 | ATCN_2931 | 42458 |
| TTCN_248 | 28400 | TTCN_4158 | 42459 |
| TTCN_249 | 28401 | ATCN_2932 | 42460 |
| CTCN_316 | 28402 | ATCN_2933 | 42461 |
| ATCN_177 | 28403 | GTCN_2704 | 42462 |
| ATCN_178 | 28404 | ATCN_2934 | 42463 |
| ATCN_179 | 28405 | CTCN_5210 | 42464 |
| GTCN_204 | 28406 | GTCN_2705 | 42465 |
| GTCN_205 | 28407 | ATCN_2935 | 42466 |
| GTCN_206 | 28408 | CTCN_5211 | 42467 |
| ATCN_180 | 28409 | TTCN_4159 | 42468 |
| CTCN_317 | 28410 | TTCN_4160 | 42469 |
| ATCN_181 | 28411 | CTCN_5212 | 42470 |
| GTCN_207 | 28412 | TTCN_4161 | 42471 |
| TTCN_250 | 28413 | CTCN_5213 | 42472 |
| CTCN_318 | 28414 | CTCN_5214 | 42473 |
| TTCN_251 | 28415 | GTCN_2706 | 42474 |
| CTCN_319 | 28416 | ATCN_2936 | 42475 |
| GTCN_208 | 28417 | CTCN_5215 | 42476 |
| GTCN_209 | 28418 | CTCN_5216 | 42477 |
| TTCN_252 | 28419 | TTCN_4162 | 42478 |
| ATCN_182 | 28420 | CTCN_5217 | 42479 |
| GTCN_210 | 28421 | CTCN_5218 | 42480 |
| CTCN_320 | 28422 | TTCN_4163 | 42481 |
| ATCN_183 | 28423 | TTCN_4164 | 42482 |
| CTCN_321 | 28424 | CTCN_5219 | 42483 |
| TTCN_253 | 28425 | CTCN_5220 | 42484 |
| TTCN_254 | 28426 | TTCN_4165 | 42485 |
| ATCN_184 | 28427 | CTCN_5221 | 42486 |
| TTCN_255 | 28428 | CTCN_5222 | 42487 |
| TTCN_256 | 28429 | GTCN_2707 | 42488 |
| GTCN_211 | 28430 | TTCN_4166 | 42489 |
| TTCN_257 | 28431 | TTCN_4167 | 42490 |
| CTCN_322 | 28432 | TTCN_4168 | 42491 |
| GTCN_212 | 28433 | GTCN_2708 | 42492 |
| TTCN_258 | 28434 | GTCN_2709 | 42493 |
| ATCN_185 | 28435 | ATCN_2937 | 42494 |
| TTCN_259 | 28436 | CTCN_5223 | 42495 |
| CTCN_323 | 28437 | CTCN_5224 | 42496 |
| TTCN_260 | 28438 | TTCN_4169 | 42497 |
| ATCN_186 | 28439 | GTCN_2710 | 42498 |

| | | | |
|---|---|---|---|
| CTCN_324 | 28440 | TTCN_4170 | 42499 |
| TTCN_261 | 28441 | CTCN_5225 | 42500 |
| TTCN_262 | 28442 | ATCN_2938 | 42501 |
| TTCN_263 | 28443 | CTCN_5226 | 42502 |
| CTCN_325 | 28444 | TTCN_4171 | 42503 |
| GTCN_213 | 28445 | CTCN_5227 | 42504 |
| TTCN_264 | 28446 | GTCN_2711 | 42505 |
| CTCN_326 | 28447 | CTCN_5228 | 42506 |
| TTCN_265 | 28448 | TTCN_4172 | 42507 |
| ATCN_187 | 28449 | GTCN_2712 | 42508 |
| TTCN_266 | 28450 | TTCN_4173 | 42509 |
| TTCN_267 | 28451 | CTCN_5229 | 42510 |
| TTCN_268 | 28452 | TTCN_4174 | 42511 |
| TTCN_269 | 28453 | TTCN_4175 | 42512 |
| ATCN_188 | 28454 | CTCN_5230 | 42513 |
| TTCN_270 | 28455 | CTCN_5231 | 42514 |
| CTCN_327 | 28456 | GTCN_2713 | 42515 |
| CTCN_328 | 28457 | CTCN_5232 | 42516 |
| CTCN_329 | 28458 | TTCN_4176 | 42517 |
| CTCN_330 | 28459 | GTCN_2714 | 42518 |
| CTCN_331 | 28460 | CTCN_5233 | 42519 |
| CTCN_332 | 28461 | CTCN_5234 | 42520 |
| TTCN_271 | 28462 | TTCN_4177 | 42521 |
| GTCN_214 | 28463 | GTCN_2715 | 42522 |
| ATCN_189 | 28464 | GTCN_2716 | 42523 |
| ATCN_190 | 28465 | CTCN_5235 | 42524 |
| ATCN_191 | 28466 | CTCN_5236 | 42525 |
| CTCN_333 | 28467 | CTCN_5237 | 42526 |
| TTCN_272 | 28468 | ATCN_2939 | 42527 |
| CTCN_334 | 28469 | CTCN_5238 | 42528 |
| ATCN_192 | 28470 | CTCN_5239 | 42529 |
| CTCN_335 | 28471 | GTCN_2717 | 42530 |
| GTCN_215 | 28472 | GTCN_2718 | 42531 |
| TTCN_273 | 28473 | CTCN_5240 | 42532 |
| ATCN_193 | 28474 | GTCN_2719 | 42533 |
| ATCN_194 | 28475 | CTCN_5241 | 42534 |
| ATCN_195 | 28476 | CTCN_5242 | 42535 |
| CTCN_336 | 28477 | TTCN_4178 | 42536 |
| TTCN_274 | 28478 | TTCN_4179 | 42537 |
| TTCN_275 | 28479 | TTCN_4180 | 42538 |
| ATCN_196 | 28480 | CTCN_5243 | 42539 |
| ATCN_197 | 28481 | CTCN_5244 | 42540 |
| ATCN_198 | 28482 | TTCN_4181 | 42541 |

FIG. 37 (continued)

| | | | |
|---|---|---|---|
| ATCN_199 | 28483 | CTCN_5245 | 42542 |
| TTCN_276 | 28484 | ATCN_2940 | 42543 |
| CTCN_337 | 28485 | ATCN_2941 | 42544 |
| CTCN_338 | 28486 | ATCN_2942 | 42545 |
| ATCN_200 | 28487 | CTCN_5246 | 42546 |
| ATCN_201 | 28488 | GTCN_2720 | 42547 |
| GTCN_216 | 28489 | TTCN_4182 | 42548 |
| CTCN_339 | 28490 | TTCN_4183 | 42549 |
| ATCN_202 | 28491 | CTCN_5247 | 42550 |
| TTCN_277 | 28492 | GTCN_2721 | 42551 |
| CTCN_340 | 28493 | CTCN_5248 | 42552 |
| ATCN_203 | 28494 | CTCN_5249 | 42553 |
| ATCN_204 | 28495 | TTCN_4184 | 42554 |
| ATCN_205 | 28496 | CTCN_5250 | 42555 |
| ATCN_206 | 28497 | CTCN_5251 | 42556 |
| ATCN_207 | 28498 | CTCN_5252 | 42557 |
| CTCN_341 | 28499 | ATCN_2943 | 42558 |
| GTCN_217 | 28500 | TTCN_4185 | 42559 |
| TTCN_278 | 28501 | CTCN_5253 | 42560 |
| TTCN_279 | 28502 | ATCN_2944 | 42561 |
| CTCN_342 | 28503 | CTCN_5254 | 42562 |
| ATCN_208 | 28504 | CTCN_5255 | 42563 |
| TTCN_280 | 28505 | ATCN_2945 | 42564 |
| ATCN_209 | 28506 | TTCN_4186 | 42565 |
| GTCN_218 | 28507 | TTCN_4187 | 42566 |
| TTCN_281 | 28508 | TTCN_4188 | 42567 |
| TTCN_282 | 28509 | ATCN_2946 | 42568 |
| CTCN_343 | 28510 | CTCN_5256 | 42569 |
| GTCN_219 | 28511 | TTCN_4189 | 42570 |
| CTCN_344 | 28512 | GTCN_2722 | 42571 |
| ATCN_210 | 28513 | GTCN_2723 | 42572 |
| GTCN_220 | 28514 | GTCN_2724 | 42573 |
| TTCN_283 | 28515 | GTCN_2725 | 42574 |
| TTCN_284 | 28516 | TTCN_4190 | 42575 |
| ATCN_211 | 28517 | CTCN_5257 | 42576 |
| TTCN_285 | 28518 | TTCN_4191 | 42577 |
| TTCN_286 | 28519 | CTCN_5258 | 42578 |
| ATCN_212 | 28520 | ATCN_2947 | 42579 |
| ATCN_213 | 28521 | CTCN_5259 | 42580 |
| CTCN_345 | 28522 | CTCN_5260 | 42581 |
| TTCN_287 | 28523 | TTCN_4192 | 42582 |
| CTCN_346 | 28524 | CTCN_5261 | 42583 |
| TTCN_288 | 28525 | TTCN_4193 | 42584 |
| ATCN_214 | 28526 | GTCN_2726 | 42585 |
| GTCN_221 | 28527 | GTCN_2727 | 42586 |
| CTCN_347 | 28528 | TTCN_4194 | 42587 |
| CTCN_348 | 28529 | TTCN_4195 | 42588 |
| ATCN_215 | 28530 | CTCN_5262 | 42589 |
| ATCN_216 | 28531 | GTCN_2728 | 42590 |
| CTCN_349 | 28532 | ATCN_2948 | 42591 |
| CTCN_350 | 28533 | ATCN_2949 | 42592 |
| ATCN_217 | 28534 | TTCN_4196 | 42593 |
| CTCN_351 | 28535 | CTCN_5263 | 42594 |
| TTCN_289 | 28536 | TTCN_4197 | 42595 |
| ATCN_218 | 28537 | ATCN_2950 | 42596 |
| ATCN_219 | 28538 | ATCN_2951 | 42597 |
| TTCN_290 | 28539 | TTCN_4198 | 42598 |
| CTCN_352 | 28540 | CTCN_5264 | 42599 |
| TTCN_291 | 28541 | TTCN_4199 | 42600 |
| TTCN_292 | 28542 | CTCN_5265 | 42601 |
| GTCN_222 | 28543 | TTCN_4200 | 42602 |
| TTCN_293 | 28544 | ATCN_2952 | 42603 |
| TTCN_294 | 28545 | CTCN_5266 | 42604 |
| ATCN_220 | 28546 | CTCN_5267 | 42605 |
| ATCN_221 | 28547 | ATCN_2953 | 42606 |
| TTCN_295 | 28548 | TTCN_4201 | 42607 |
| GTCN_223 | 28549 | GTCN_2729 | 42608 |
| TTCN_296 | 28550 | TTCN_4202 | 42609 |
| TTCN_297 | 28551 | CTCN_5268 | 42610 |
| TTCN_298 | 28552 | CTCN_5269 | 42611 |
| TTCN_299 | 28553 | TTCN_4203 | 42612 |
| TTCN_300 | 28554 | CTCN_5270 | 42613 |
| GTCN_224 | 28555 | CTCN_5271 | 42614 |
| ATCN_222 | 28556 | GTCN_2730 | 42615 |
| ATCN_223 | 28557 | CTCN_5272 | 42616 |
| TTCN_301 | 28558 | GTCN_2731 | 42617 |
| TTCN_302 | 28559 | CTCN_5273 | 42618 |
| CTCN_353 | 28560 | GTCN_2732 | 42619 |
| TTCN_303 | 28561 | CTCN_5274 | 42620 |
| TTCN_304 | 28562 | TTCN_4204 | 42621 |
| TTCN_305 | 28563 | CTCN_5275 | 42622 |
| ATCN_224 | 28564 | CTCN_5276 | 42623 |
| CTCN_354 | 28565 | CTCN_5277 | 42624 |
| ATCN_225 | 28566 | TTCN_4205 | 42625 |
| TTCN_306 | 28567 | GTCN_2733 | 42626 |
| CTCN_355 | 28568 | GTCN_2734 | 42627 |

FIG. 37 (continued)

| | | | |
|---|---|---|---|
| CTCN_356 | 28569 | TTCN_4206 | 42628 |
| CTCN_357 | 28570 | CTCN_5278 | 42629 |
| GTCN_225 | 28571 | TTCN_4207 | 42630 |
| CTCN_358 | 28572 | CTCN_5279 | 42631 |
| GTCN_226 | 28573 | CTCN_5280 | 42632 |
| CTCN_359 | 28574 | CTCN_5281 | 42633 |
| CTCN_360 | 28575 | GTCN_2735 | 42634 |
| CTCN_361 | 28576 | CTCN_5282 | 42635 |
| CTCN_362 | 28577 | CTCN_5283 | 42636 |
| ATCN_226 | 28578 | GTCN_2736 | 42637 |
| ATCN_227 | 28579 | CTCN_5284 | 42638 |
| CTCN_363 | 28580 | CTCN_5285 | 42639 |
| GTCN_227 | 28581 | CTCN_5286 | 42640 |
| CTCN_364 | 28582 | CTCN_5287 | 42641 |
| CTCN_365 | 28583 | CTCN_5288 | 42642 |
| CTCN_366 | 28584 | GTCN_2737 | 42643 |
| GTCN_228 | 28585 | TTCN_4208 | 42644 |
| GTCN_229 | 28586 | TTCN_4209 | 42645 |
| CTCN_367 | 28587 | ATCN_2954 | 42646 |
| CTCN_368 | 28588 | CTCN_5289 | 42647 |
| TTCN_307 | 28589 | ATCN_2955 | 42648 |
| CTCN_369 | 28590 | TTCN_4210 | 42649 |
| CTCN_370 | 28591 | ATCN_2956 | 42650 |
| GTCN_230 | 28592 | CTCN_5290 | 42651 |
| CTCN_371 | 28593 | CTCN_5291 | 42652 |
| GTCN_231 | 28594 | ATCN_2957 | 42653 |
| CTCN_372 | 28595 | ATCN_2958 | 42654 |
| CTCN_373 | 28596 | CTCN_5292 | 42655 |
| CTCN_374 | 28597 | GTCN_2738 | 42656 |
| CTCN_375 | 28598 | ATCN_2959 | 42657 |
| CTCN_376 | 28599 | CTCN_5293 | 42658 |
| CTCN_377 | 28600 | ATCN_2960 | 42659 |
| GTCN_232 | 28601 | CTCN_5294 | 42660 |
| CTCN_378 | 28602 | ATCN_2961 | 42661 |
| CTCN_379 | 28603 | ATCN_2962 | 42662 |
| CTCN_380 | 28604 | CTCN_5295 | 42663 |
| CTCN_381 | 28605 | TTCN_4211 | 42664 |
| TTCN_308 | 28606 | TTCN_4212 | 42665 |
| TTCN_309 | 28607 | ATCN_2963 | 42666 |
| CTCN_382 | 28608 | ATCN_2964 | 42667 |
| CTCN_383 | 28609 | CTCN_5296 | 42668 |
| GTCN_233 | 28610 | TTCN_4213 | 42669 |
| CTCN_384 | 28611 | ATCN_2965 | 42670 |

| | | | |
|---|---|---|---|
| CTCN_385 | 28612 | CTCN_5297 | 42671 |
| ATCN_228 | 28613 | CTCN_5298 | 42672 |
| CTCN_386 | 28614 | ATCN_2966 | 42673 |
| CTCN_387 | 28615 | ATCN_2967 | 42674 |
| ATCN_229 | 28616 | CTCN_5299 | 42675 |
| GTCN_234 | 28617 | CTCN_5300 | 42676 |
| CTCN_388 | 28618 | CTCN_5301 | 42677 |
| TTCN_310 | 28619 | GTCN_2739 | 42678 |
| CTCN_389 | 28620 | CTCN_5302 | 42679 |
| TTCN_311 | 28621 | GTCN_2740 | 42680 |
| ATCN_230 | 28622 | GTCN_2741 | 42681 |
| TTCN_312 | 28623 | CTCN_5303 | 42682 |
| CTCN_390 | 28624 | GTCN_2742 | 42683 |
| CTCN_391 | 28625 | CTCN_5304 | 42684 |
| TTCN_313 | 28626 | TTCN_4214 | 42685 |
| ATCN_231 | 28627 | CTCN_5305 | 42686 |
| CTCN_392 | 28628 | CTCN_5306 | 42687 |
| GTCN_235 | 28629 | ATCN_2968 | 42688 |
| CTCN_393 | 28630 | CTCN_5307 | 42689 |
| GTCN_236 | 28631 | TTCN_4215 | 42690 |
| GTCN_237 | 28632 | TTCN_4216 | 42691 |
| TTCN_314 | 28633 | GTCN_2743 | 42692 |
| ATCN_232 | 28634 | GTCN_2744 | 42693 |
| ATCN_233 | 28635 | CTCN_5308 | 42694 |
| CTCN_394 | 28636 | GTCN_2745 | 42695 |
| TTCN_315 | 28637 | GTCN_2746 | 42696 |
| CTCN_395 | 28638 | CTCN_5309 | 42697 |
| TTCN_316 | 28639 | CTCN_5310 | 42698 |
| GTCN_238 | 28640 | TTCN_4217 | 42699 |
| CTCN_396 | 28641 | ATCN_2969 | 42700 |
| ATCN_234 | 28642 | TTCN_4218 | 42701 |
| ATCN_235 | 28643 | ATCN_2970 | 42702 |
| CTCN_397 | 28644 | CTCN_5311 | 42703 |
| ATCN_236 | 28645 | CTCN_5312 | 42704 |
| CTCN_398 | 28646 | GTCN_2747 | 42705 |
| CTCN_399 | 28647 | CTCN_5313 | 42706 |
| CTCN_400 | 28648 | CTCN_5314 | 42707 |
| TTCN_317 | 28649 | CTCN_5315 | 42708 |
| CTCN_401 | 28650 | CTCN_5316 | 42709 |
| GTCN_239 | 28651 | GTCN_2748 | 42710 |
| TTCN_318 | 28652 | GTCN_2749 | 42711 |
| GTCN_240 | 28653 | ATCN_2971 | 42712 |
| CTCN_402 | 28654 | GTCN_2750 | 42713 |

FIG. 37 (continued)

| | | | |
|---|---|---|---|
| CTCN_403 | 28655 | GTCN_2751 | 42714 |
| CTCN_404 | 28656 | GTCN_2752 | 42715 |
| TTCN_319 | 28657 | CTCN_5317 | 42716 |
| CTCN_405 | 28658 | ATCN_2972 | 42717 |
| CTCN_406 | 28659 | ATCN_2973 | 42718 |
| GTCN_241 | 28660 | CTCN_5318 | 42719 |
| GTCN_242 | 28661 | GTCN_2753 | 42720 |
| CTCN_407 | 28662 | TTCN_4219 | 42721 |
| CTCN_408 | 28663 | TTCN_4220 | 42722 |
| CTCN_409 | 28664 | CTCN_5319 | 42723 |
| GTCN_243 | 28665 | TTCN_4221 | 42724 |
| CTCN_410 | 28666 | ATCN_2974 | 42725 |
| GTCN_244 | 28667 | TTCN_4222 | 42726 |
| CTCN_411 | 28668 | ATCN_2975 | 42727 |
| CTCN_412 | 28669 | TTCN_4223 | 42728 |
| TTCN_320 | 28670 | TTCN_4224 | 42729 |
| CTCN_413 | 28671 | TTCN_4225 | 42730 |
| CTCN_414 | 28672 | TTCN_4226 | 42731 |
| CTCN_415 | 28673 | GTCN_2754 | 42732 |
| TTCN_321 | 28674 | CTCN_5320 | 42733 |
| CTCN_416 | 28675 | ATCN_2976 | 42734 |
| CTCN_417 | 28676 | CTCN_5321 | 42735 |
| ATCN_237 | 28677 | ATCN_2977 | 42736 |
| ATCN_238 | 28678 | ATCN_2978 | 42737 |
| CTCN_418 | 28679 | CTCN_5322 | 42738 |
| CTCN_419 | 28680 | ATCN_2979 | 42739 |
| TTCN_322 | 28681 | ATCN_2980 | 42740 |
| TTCN_323 | 28682 | CTCN_5323 | 42741 |
| CTCN_420 | 28683 | CTCN_5324 | 42742 |
| GTCN_245 | 28684 | GTCN_2755 | 42743 |
| TTCN_324 | 28685 | TTCN_4227 | 42744 |
| CTCN_421 | 28686 | CTCN_5325 | 42745 |
| GTCN_246 | 28687 | GTCN_2756 | 42746 |
| GTCN_247 | 28688 | GTCN_2757 | 42747 |
| CTCN_422 | 28689 | TTCN_4228 | 42748 |
| CTCN_423 | 28690 | GTCN_2758 | 42749 |
| CTCN_424 | 28691 | CTCN_5326 | 42750 |
| TTCN_325 | 28692 | TTCN_4229 | 42751 |
| CTCN_425 | 28693 | CTCN_5327 | 42752 |
| CTCN_426 | 28694 | GTCN_2759 | 42753 |
| CTCN_427 | 28695 | CTCN_5328 | 42754 |
| CTCN_428 | 28696 | CTCN_5329 | 42755 |
| CTCN_429 | 28697 | CTCN_5330 | 42756 |

| | | | |
|---|---|---|---|
| CTCN_430 | 28698 | TTCN_4230 | 42757 |
| CTCN_431 | 28699 | TTCN_4231 | 42758 |
| CTCN_432 | 28700 | ATCN_2981 | 42759 |
| CTCN_433 | 28701 | CTCN_5331 | 42760 |
| CTCN_434 | 28702 | CTCN_5332 | 42761 |
| TTCN_326 | 28703 | CTCN_5333 | 42762 |
| CTCN_435 | 28704 | CTCN_5334 | 42763 |
| TTCN_327 | 28705 | CTCN_5335 | 42764 |
| CTCN_436 | 28706 | ATCN_2982 | 42765 |
| TTCN_328 | 28707 | ATCN_2983 | 42766 |
| GTCN_248 | 28708 | GTCN_2760 | 42767 |
| GTCN_249 | 28709 | CTCN_5336 | 42768 |
| GTCN_250 | 28710 | CTCN_5337 | 42769 |
| TTCN_329 | 28711 | GTCN_2761 | 42770 |
| CTCN_437 | 28712 | CTCN_5338 | 42771 |
| CTCN_438 | 28713 | GTCN_2762 | 42772 |
| CTCN_439 | 28714 | CTCN_5339 | 42773 |
| ATCN_239 | 28715 | TTCN_4232 | 42774 |
| TTCN_330 | 28716 | CTCN_5340 | 42775 |
| ATCN_240 | 28717 | TTCN_4233 | 42776 |
| CTCN_440 | 28718 | CTCN_5341 | 42777 |
| TTCN_331 | 28719 | TTCN_4234 | 42778 |
| TTCN_332 | 28720 | TTCN_4235 | 42779 |
| TTCN_333 | 28721 | ATCN_2984 | 42780 |
| GTCN_251 | 28722 | TTCN_4236 | 42781 |
| CTCN_441 | 28723 | GTCN_2763 | 42782 |
| CTCN_442 | 28724 | CTCN_5342 | 42783 |
| TTCN_334 | 28725 | CTCN_5343 | 42784 |
| GTCN_252 | 28726 | ATCN_2985 | 42785 |
| ATCN_241 | 28727 | ATCN_2986 | 42786 |
| CTCN_443 | 28728 | ATCN_2987 | 42787 |
| GTCN_253 | 28729 | GTCN_2764 | 42788 |
| GTCN_254 | 28730 | CTCN_5344 | 42789 |
| GTCN_255 | 28731 | GTCN_2765 | 42790 |
| CTCN_444 | 28732 | CTCN_5345 | 42791 |
| CTCN_445 | 28733 | TTCN_4237 | 42792 |
| GTCN_256 | 28734 | TTCN_4238 | 42793 |
| GTCN_257 | 28735 | CTCN_5346 | 42794 |
| CTCN_446 | 28736 | CTCN_5347 | 42795 |
| CTCN_447 | 28737 | GTCN_2766 | 42796 |
| GTCN_258 | 28738 | CTCN_5348 | 42797 |
| TTCN_335 | 28739 | TTCN_4239 | 42798 |
| CTCN_448 | 28740 | GTCN_2767 | 42799 |

FIG. 37 (continued)

| | | | |
|---|---|---|---|
| CTCN_449 | 28741 | CTCN_5349 | 42800 |
| CTCN_450 | 28742 | GTCN_2768 | 42801 |
| CTCN_451 | 28743 | CTCN_5350 | 42802 |
| CTCN_452 | 28744 | GTCN_2769 | 42803 |
| GTCN_259 | 28745 | CTCN_5351 | 42804 |
| TTCN_336 | 28746 | GTCN_2770 | 42805 |
| GTCN_260 | 28747 | TTCN_4240 | 42806 |
| GTCN_261 | 28748 | CTCN_5352 | 42807 |
| CTCN_453 | 28749 | ATCN_2988 | 42808 |
| TTCN_337 | 28750 | TTCN_4241 | 42809 |
| TTCN_338 | 28751 | GTCN_2771 | 42810 |
| GTCN_262 | 28752 | TTCN_4242 | 42811 |
| CTCN_454 | 28753 | TTCN_4243 | 42812 |
| TTCN_339 | 28754 | CTCN_5353 | 42813 |
| GTCN_263 | 28755 | GTCN_2772 | 42814 |
| GTCN_264 | 28756 | CTCN_5354 | 42815 |
| ATCN_242 | 28757 | ATCN_2989 | 42816 |
| TTCN_340 | 28758 | ATCN_2990 | 42817 |
| CTCN_455 | 28759 | TTCN_4244 | 42818 |
| CTCN_456 | 28760 | CTCN_5355 | 42819 |
| GTCN_265 | 28761 | GTCN_2773 | 42820 |
| ATCN_243 | 28762 | TTCN_4245 | 42821 |
| CTCN_457 | 28763 | ATCN_2991 | 42822 |
| CTCN_458 | 28764 | GTCN_2774 | 42823 |
| TTCN_341 | 28765 | TTCN_4246 | 42824 |
| CTCN_459 | 28766 | TTCN_4247 | 42825 |
| CTCN_460 | 28767 | CTCN_5356 | 42826 |
| TTCN_342 | 28768 | TTCN_4248 | 42827 |
| ATCN_244 | 28769 | CTCN_5357 | 42828 |
| TTCN_343 | 28770 | GTCN_2775 | 42829 |
| CTCN_461 | 28771 | CTCN_5358 | 42830 |
| TTCN_344 | 28772 | ATCN_2992 | 42831 |
| CTCN_462 | 28773 | CTCN_5359 | 42832 |
| GTCN_266 | 28774 | CTCN_5360 | 42833 |
| CTCN_463 | 28775 | CTCN_5361 | 42834 |
| GTCN_267 | 28776 | GTCN_2776 | 42835 |
| ATCN_245 | 28777 | ATCN_2993 | 42836 |
| TTCN_345 | 28778 | ATCN_2994 | 42837 |
| TTCN_346 | 28779 | TTCN_4249 | 42838 |
| ATCN_246 | 28780 | CTCN_5362 | 42839 |
| TTCN_347 | 28781 | CTCN_5363 | 42840 |
| CTCN_464 | 28782 | CTCN_5364 | 42841 |
| ATCN_247 | 28783 | CTCN_5365 | 42842 |

| | | | |
|---|---|---|---|
| TTCN_348 | 28784 | CTCN_5366 | 42843 |
| TTCN_349 | 28785 | CTCN_5367 | 42844 |
| TTCN_350 | 28786 | ATCN_2995 | 42845 |
| CTCN_465 | 28787 | TTCN_4250 | 42846 |
| TTCN_351 | 28788 | GTCN_2777 | 42847 |
| ATCN_248 | 28789 | TTCN_4251 | 42848 |
| CTCN_466 | 28790 | CTCN_5368 | 42849 |
| TTCN_352 | 28791 | TTCN_4252 | 42850 |
| ATCN_249 | 28792 | GTCN_2778 | 42851 |
| CTCN_467 | 28793 | TTCN_4253 | 42852 |
| CTCN_468 | 28794 | CTCN_5369 | 42853 |
| CTCN_469 | 28795 | CTCN_5370 | 42854 |
| CTCN_470 | 28796 | ATCN_2996 | 42855 |
| CTCN_471 | 28797 | ATCN_2997 | 42856 |
| TTCN_353 | 28798 | ATCN_2998 | 42857 |
| ATCN_250 | 28799 | TTCN_4254 | 42858 |
| ATCN_251 | 28800 | TTCN_4255 | 42859 |
| GTCN_268 | 28801 | TTCN_4256 | 42860 |
| CTCN_472 | 28802 | GTCN_2779 | 42861 |
| ATCN_252 | 28803 | ATCN_2999 | 42862 |
| TTCN_354 | 28804 | CTCN_5371 | 42863 |
| CTCN_473 | 28805 | CTCN_5372 | 42864 |
| TTCN_355 | 28806 | ATCN_3000 | 42865 |
| CTCN_474 | 28807 | TTCN_4257 | 42866 |
| CTCN_475 | 28808 | CTCN_5373 | 42867 |
| ATCN_253 | 28809 | GTCN_2780 | 42868 |
| ATCN_254 | 28810 | GTCN_2781 | 42869 |
| GTCN_269 | 28811 | GTCN_2782 | 42870 |
| GTCN_270 | 28812 | CTCN_5374 | 42871 |
| TTCN_356 | 28813 | ATCN_3001 | 42872 |
| ATCN_255 | 28814 | ATCN_3002 | 42873 |
| CTCN_476 | 28815 | CTCN_5375 | 42874 |
| TTCN_357 | 28816 | TTCN_4258 | 42875 |
| GTCN_271 | 28817 | TTCN_4259 | 42876 |
| CTCN_477 | 28818 | TTCN_4260 | 42877 |
| CTCN_478 | 28819 | CTCN_5376 | 42878 |
| ATCN_256 | 28820 | CTCN_5377 | 42879 |
| TTCN_358 | 28821 | CTCN_5378 | 42880 |
| CTCN_479 | 28822 | CTCN_5379 | 42881 |
| TTCN_359 | 28823 | GTCN_2783 | 42882 |
| TTCN_360 | 28824 | GTCN_2784 | 42883 |
| GTCN_272 | 28825 | ATCN_3003 | 42884 |
| GTCN_273 | 28826 | CTCN_5380 | 42885 |

FIG. 37 (continued)

| | | | |
|---|---|---|---|
| CTCN_480 | 28827 | ATCN_3004 | 42886 |
| ATCN_257 | 28828 | TTCN_4261 | 42887 |
| CTCN_481 | 28829 | ATCN_3005 | 42888 |
| GTCN_274 | 28830 | CTCN_5381 | 42889 |
| CTCN_482 | 28831 | TTCN_4262 | 42890 |
| GTCN_275 | 28832 | TTCN_4263 | 42891 |
| GTCN_276 | 28833 | ATCN_3006 | 42892 |
| CTCN_483 | 28834 | GTCN_2785 | 42893 |
| ATCN_258 | 28835 | GTCN_2786 | 42894 |
| CTCN_484 | 28836 | CTCN_5382 | 42895 |
| GTCN_277 | 28837 | ATCN_3007 | 42896 |
| CTCN_485 | 28838 | TTCN_4264 | 42897 |
| GTCN_278 | 28839 | TTCN_4265 | 42898 |
| GTCN_279 | 28840 | TTCN_4266 | 42899 |
| CTCN_486 | 28841 | ATCN_3008 | 42900 |
| ATCN_259 | 28842 | CTCN_5383 | 42901 |
| CTCN_487 | 28843 | TTCN_4267 | 42902 |
| GTCN_280 | 28844 | CTCN_5384 | 42903 |
| CTCN_488 | 28845 | CTCN_5385 | 42904 |
| GTCN_281 | 28846 | TTCN_4268 | 42905 |
| CTCN_489 | 28847 | TTCN_4269 | 42906 |
| ATCN_260 | 28848 | CTCN_5386 | 42907 |
| CTCN_490 | 28849 | TTCN_4270 | 42908 |
| GTCN_282 | 28850 | GTCN_2787 | 42909 |
| CTCN_491 | 28851 | ATCN_3009 | 42910 |
| GTCN_283 | 28852 | ATCN_3010 | 42911 |
| GTCN_284 | 28853 | CTCN_5387 | 42912 |
| CTCN_492 | 28854 | GTCN_2788 | 42913 |
| ATCN_261 | 28855 | ATCN_3011 | 42914 |
| CTCN_493 | 28856 | ATCN_3012 | 42915 |
| GTCN_285 | 28857 | TTCN_4271 | 42916 |
| CTCN_494 | 28858 | TTCN_4272 | 42917 |
| GTCN_286 | 28859 | TTCN_4273 | 42918 |
| GTCN_287 | 28860 | TTCN_4274 | 42919 |
| CTCN_495 | 28861 | TTCN_4275 | 42920 |
| ATCN_262 | 28862 | TTCN_4276 | 42921 |
| CTCN_496 | 28863 | CTCN_5388 | 42922 |
| GTCN_288 | 28864 | GTCN_2789 | 42923 |
| CTCN_497 | 28865 | CTCN_5389 | 42924 |
| GTCN_289 | 28866 | GTCN_2790 | 42925 |
| GTCN_290 | 28867 | TTCN_4277 | 42926 |
| CTCN_498 | 28868 | GTCN_2791 | 42927 |
| ATCN_263 | 28869 | TTCN_4278 | 42928 |

| | | | |
|---|---|---|---|
| CTCN_499 | 28870 | GTCN_2792 | 42929 |
| GTCN_291 | 28871 | ATCN_3013 | 42930 |
| CTCN_500 | 28872 | ATCN_3014 | 42931 |
| GTCN_292 | 28873 | TTCN_4279 | 42932 |
| GTCN_293 | 28874 | TTCN_4280 | 42933 |
| CTCN_501 | 28875 | GTCN_2793 | 42934 |
| ATCN_264 | 28876 | CTCN_5390 | 42935 |
| GTCN_294 | 28877 | CTCN_5391 | 42936 |
| CTCN_502 | 28878 | CTCN_5392 | 42937 |
| GTCN_295 | 28879 | TTCN_4281 | 42938 |
| GTCN_296 | 28880 | TTCN_4282 | 42939 |
| CTCN_503 | 28881 | ATCN_3015 | 42940 |
| ATCN_265 | 28882 | TTCN_4283 | 42941 |
| CTCN_504 | 28883 | ATCN_3016 | 42942 |
| GTCN_297 | 28884 | CTCN_5393 | 42943 |
| CTCN_505 | 28885 | CTCN_5394 | 42944 |
| GTCN_298 | 28886 | TTCN_4284 | 42945 |
| GTCN_299 | 28887 | TTCN_4285 | 42946 |
| CTCN_506 | 28888 | TTCN_4286 | 42947 |
| ATCN_266 | 28889 | TTCN_4287 | 42948 |
| GTCN_300 | 28890 | TTCN_4288 | 42949 |
| CTCN_507 | 28891 | CTCN_5395 | 42950 |
| GTCN_301 | 28892 | TTCN_4289 | 42951 |
| GTCN_302 | 28893 | GTCN_2794 | 42952 |
| CTCN_508 | 28894 | CTCN_5396 | 42953 |
| TTCN_361 | 28895 | CTCN_5397 | 42954 |
| TTCN_362 | 28896 | CTCN_5398 | 42955 |
| CTCN_509 | 28897 | ATCN_3017 | 42956 |
| ATCN_267 | 28898 | ATCN_3018 | 42957 |
| CTCN_510 | 28899 | GTCN_2795 | 42958 |
| ATCN_268 | 28900 | ATCN_3019 | 42959 |
| CTCN_511 | 28901 | TTCN_4290 | 42960 |
| TTCN_363 | 28902 | TTCN_4291 | 42961 |
| CTCN_512 | 28903 | GTCN_2796 | 42962 |
| CTCN_513 | 28904 | CTCN_5399 | 42963 |
| GTCN_303 | 28905 | GTCN_2797 | 42964 |
| CTCN_514 | 28906 | GTCN_2798 | 42965 |
| GTCN_304 | 28907 | CTCN_5400 | 42966 |
| CTCN_515 | 28908 | CTCN_5401 | 42967 |
| CTCN_516 | 28909 | TTCN_4292 | 42968 |
| CTCN_517 | 28910 | CTCN_5402 | 42969 |
| ATCN_269 | 28911 | ATCN_3020 | 42970 |
| CTCN_518 | 28912 | TTCN_4293 | 42971 |

FIG. 37 (continued)

| | | | |
|---|---|---|---|
| CTCN_519 | 28913 | GTCN_2799 | 42972 |
| ATCN_270 | 28914 | GTCN_2800 | 42973 |
| ATCN_271 | 28915 | CTCN_5403 | 42974 |
| CTCN_520 | 28916 | GTCN_2801 | 42975 |
| GTCN_305 | 28917 | CTCN_5404 | 42976 |
| ATCN_272 | 28918 | GTCN_2802 | 42977 |
| TTCN_364 | 28919 | ATCN_3021 | 42978 |
| TTCN_365 | 28920 | TTCN_4294 | 42979 |
| CTCN_521 | 28921 | TTCN_4295 | 42980 |
| TTCN_366 | 28922 | CTCN_5405 | 42981 |
| ATCN_273 | 28923 | TTCN_4296 | 42982 |
| ATCN_274 | 28924 | TTCN_4297 | 42983 |
| GTCN_306 | 28925 | TTCN_4298 | 42984 |
| CTCN_522 | 28926 | TTCN_4299 | 42985 |
| ATCN_275 | 28927 | CTCN_5406 | 42986 |
| ATCN_276 | 28928 | TTCN_4300 | 42987 |
| CTCN_523 | 28929 | TTCN_4301 | 42988 |
| CTCN_524 | 28930 | TTCN_4302 | 42989 |
| TTCN_367 | 28931 | CTCN_5407 | 42990 |
| ATCN_277 | 28932 | TTCN_4303 | 42991 |
| CTCN_525 | 28933 | GTCN_2803 | 42992 |
| ATCN_278 | 28934 | TTCN_4304 | 42993 |
| CTCN_526 | 28935 | TTCN_4305 | 42994 |
| TTCN_368 | 28936 | CTCN_5408 | 42995 |
| TTCN_369 | 28937 | TTCN_4306 | 42996 |
| GTCN_307 | 28938 | TTCN_4307 | 42997 |
| CTCN_527 | 28939 | CTCN_5409 | 42998 |
| CTCN_528 | 28940 | ATCN_3022 | 42999 |
| CTCN_529 | 28941 | GTCN_2804 | 43000 |
| ATCN_279 | 28942 | GTCN_2805 | 43001 |
| ATCN_280 | 28943 | GTCN_2806 | 43002 |
| CTCN_530 | 28944 | CTCN_5410 | 43003 |
| CTCN_531 | 28945 | CTCN_5411 | 43004 |
| CTCN_532 | 28946 | TTCN_4308 | 43005 |
| CTCN_533 | 28947 | ATCN_3023 | 43006 |
| ATCN_281 | 28948 | ATCN_3024 | 43007 |
| ATCN_282 | 28949 | CTCN_5412 | 43008 |
| CTCN_534 | 28950 | GTCN_2807 | 43009 |
| GTCN_308 | 28951 | CTCN_5413 | 43010 |
| CTCN_535 | 28952 | GTCN_2808 | 43011 |
| TTCN_370 | 28953 | CTCN_5414 | 43012 |
| GTCN_309 | 28954 | ATCN_3025 | 43013 |
| CTCN_536 | 28955 | CTCN_5415 | 43014 |

| | | | |
|---|---|---|---|
| GTCN_310 | 28956 | TTCN_4309 | 43015 |
| GTCN_311 | 28957 | TTCN_4310 | 43016 |
| GTCN_312 | 28958 | GTCN_2809 | 43017 |
| GTCN_313 | 28959 | GTCN_2810 | 43018 |
| ATCN_283 | 28960 | CTCN_5416 | 43019 |
| ATCN_284 | 28961 | TTCN_4311 | 43020 |
| TTCN_371 | 28962 | CTCN_5417 | 43021 |
| GTCN_314 | 28963 | GTCN_2811 | 43022 |
| ATCN_285 | 28964 | GTCN_2812 | 43023 |
| ATCN_286 | 28965 | CTCN_5418 | 43024 |
| ATCN_287 | 28966 | TTCN_4312 | 43025 |
| TTCN_372 | 28967 | GTCN_2813 | 43026 |
| TTCN_373 | 28968 | CTCN_5419 | 43027 |
| CTCN_537 | 28969 | GTCN_2814 | 43028 |
| CTCN_538 | 28970 | GTCN_2815 | 43029 |
| ATCN_288 | 28971 | CTCN_5420 | 43030 |
| TTCN_374 | 28972 | TTCN_4313 | 43031 |
| CTCN_539 | 28973 | GTCN_2816 | 43032 |
| CTCN_540 | 28974 | CTCN_5421 | 43033 |
| GTCN_315 | 28975 | TTCN_4314 | 43034 |
| TTCN_375 | 28976 | ATCN_3026 | 43035 |
| TTCN_376 | 28977 | GTCN_2817 | 43036 |
| TTCN_377 | 28978 | TTCN_4315 | 43037 |
| TTCN_378 | 28979 | CTCN_5422 | 43038 |
| TTCN_379 | 28980 | TTCN_4316 | 43039 |
| TTCN_380 | 28981 | ATCN_3027 | 43040 |
| CTCN_541 | 28982 | ATCN_3028 | 43041 |
| TTCN_381 | 28983 | ATCN_3029 | 43042 |
| CTCN_542 | 28984 | TTCN_4317 | 43043 |
| CTCN_543 | 28985 | ATCN_3030 | 43044 |
| GTCN_316 | 28986 | GTCN_2818 | 43045 |
| CTCN_544 | 28987 | CTCN_5423 | 43046 |
| CTCN_545 | 28988 | GTCN_2819 | 43047 |
| TTCN_382 | 28989 | GTCN_2820 | 43048 |
| CTCN_546 | 28990 | CTCN_5424 | 43049 |
| CTCN_547 | 28991 | CTCN_5425 | 43050 |
| TTCN_383 | 28992 | CTCN_5426 | 43051 |
| TTCN_384 | 28993 | TTCN_4318 | 43052 |
| GTCN_317 | 28994 | CTCN_5427 | 43053 |
| GTCN_318 | 28995 | CTCN_5428 | 43054 |
| TTCN_385 | 28996 | GTCN_2821 | 43055 |
| CTCN_548 | 28997 | ATCN_3031 | 43056 |
| CTCN_549 | 28998 | TTCN_4319 | 43057 |

FIG. 37 (continued)

| | | | |
|---|---|---|---|
| TTCN_386 | 28999 | GTCN_2822 | 43058 |
| ATCN_289 | 29000 | CTCN_5429 | 43059 |
| CTCN_550 | 29001 | ATCN_3032 | 43060 |
| TTCN_387 | 29002 | ATCN_3033 | 43061 |
| TTCN_388 | 29003 | GTCN_2823 | 43062 |
| GTCN_319 | 29004 | TTCN_4320 | 43063 |
| CTCN_551 | 29005 | GTCN_2824 | 43064 |
| CTCN_552 | 29006 | TTCN_4321 | 43065 |
| CTCN_553 | 29007 | TTCN_4322 | 43066 |
| GTCN_320 | 29008 | TTCN_4323 | 43067 |
| GTCN_321 | 29009 | TTCN_4324 | 43068 |
| ATCN_290 | 29010 | GTCN_2825 | 43069 |
| GTCN_322 | 29011 | ATCN_3034 | 43070 |
| GTCN_323 | 29012 | CTCN_5430 | 43071 |
| CTCN_554 | 29013 | CTCN_5431 | 43072 |
| TTCN_389 | 29014 | GTCN_2826 | 43073 |
| TTCN_390 | 29015 | CTCN_5432 | 43074 |
| TTCN_391 | 29016 | CTCN_5433 | 43075 |
| GTCN_324 | 29017 | ATCN_3035 | 43076 |
| TTCN_392 | 29018 | ATCN_3036 | 43077 |
| CTCN_555 | 29019 | ATCN_3037 | 43078 |
| GTCN_325 | 29020 | ATCN_3038 | 43079 |
| TTCN_393 | 29021 | TTCN_4325 | 43080 |
| GTCN_326 | 29022 | GTCN_2827 | 43081 |
| CTCN_556 | 29023 | CTCN_5434 | 43082 |
| CTCN_557 | 29024 | GTCN_2828 | 43083 |
| GTCN_327 | 29025 | CTCN_5435 | 43084 |
| CTCN_558 | 29026 | TTCN_4326 | 43085 |
| ATCN_291 | 29027 | ATCN_3039 | 43086 |
| CTCN_559 | 29028 | GTCN_2829 | 43087 |
| GTCN_328 | 29029 | CTCN_5436 | 43088 |
| GTCN_329 | 29030 | CTCN_5437 | 43089 |
| CTCN_560 | 29031 | ATCN_3040 | 43090 |
| ATCN_292 | 29032 | ATCN_3041 | 43091 |
| ATCN_293 | 29033 | CTCN_5438 | 43092 |
| TTCN_394 | 29034 | ATCN_3042 | 43093 |
| CTCN_561 | 29035 | CTCN_5439 | 43094 |
| CTCN_562 | 29036 | GTCN_2830 | 43095 |
| CTCN_563 | 29037 | ATCN_3043 | 43096 |
| GTCN_330 | 29038 | TTCN_4327 | 43097 |
| GTCN_331 | 29039 | TTCN_4328 | 43098 |
| TTCN_395 | 29040 | CTCN_5440 | 43099 |
| CTCN_564 | 29041 | TTCN_4329 | 43100 |

| | | | |
|---|---|---|---|
| CTCN_565 | 29042 | CTCN_5441 | 43101 |
| CTCN_566 | 29043 | GTCN_2831 | 43102 |
| ATCN_294 | 29044 | TTCN_4330 | 43103 |
| GTCN_332 | 29045 | CTCN_5442 | 43104 |
| CTCN_567 | 29046 | TTCN_4331 | 43105 |
| CTCN_568 | 29047 | ATCN_3044 | 43106 |
| ATCN_295 | 29048 | ATCN_3045 | 43107 |
| ATCN_296 | 29049 | CTCN_5443 | 43108 |
| CTCN_569 | 29050 | ATCN_3046 | 43109 |
| CTCN_570 | 29051 | CTCN_5444 | 43110 |
| ATCN_297 | 29052 | CTCN_5445 | 43111 |
| ATCN_298 | 29053 | CTCN_5446 | 43112 |
| ATCN_299 | 29054 | GTCN_2832 | 43113 |
| CTCN_571 | 29055 | CTCN_5447 | 43114 |
| TTCN_396 | 29056 | TTCN_4332 | 43115 |
| CTCN_572 | 29057 | TTCN_4333 | 43116 |
| TTCN_397 | 29058 | CTCN_5448 | 43117 |
| ATCN_300 | 29059 | CTCN_5449 | 43118 |
| TTCN_398 | 29060 | TTCN_4334 | 43119 |
| CTCN_573 | 29061 | CTCN_5450 | 43120 |
| CTCN_574 | 29062 | ATCN_3047 | 43121 |
| CTCN_575 | 29063 | CTCN_5451 | 43122 |
| TTCN_399 | 29064 | ATCN_3048 | 43123 |
| TTCN_400 | 29065 | GTCN_2833 | 43124 |
| TTCN_401 | 29066 | CTCN_5452 | 43125 |
| CTCN_576 | 29067 | ATCN_3049 | 43126 |
| CTCN_577 | 29068 | TTCN_4335 | 43127 |
| CTCN_578 | 29069 | GTCN_2834 | 43128 |
| TTCN_402 | 29070 | CTCN_5453 | 43129 |
| CTCN_579 | 29071 | GTCN_2835 | 43130 |
| GTCN_333 | 29072 | CTCN_5454 | 43131 |
| TTCN_403 | 29073 | CTCN_5455 | 43132 |
| GTCN_334 | 29074 | TTCN_4336 | 43133 |
| GTCN_335 | 29075 | TTCN_4337 | 43134 |
| TTCN_404 | 29076 | TTCN_4338 | 43135 |
| GTCN_336 | 29077 | TTCN_4339 | 43136 |
| TTCN_405 | 29078 | CTCN_5456 | 43137 |
| ATCN_301 | 29079 | TTCN_4340 | 43138 |
| ATCN_302 | 29080 | GTCN_2836 | 43139 |
| CTCN_580 | 29081 | GTCN_2837 | 43140 |
| GTCN_337 | 29082 | GTCN_2838 | 43141 |
| TTCN_406 | 29083 | GTCN_2839 | 43142 |
| CTCN_581 | 29084 | GTCN_2840 | 43143 |

FIG. 37 (continued)

| | | | |
|---|---|---|---|
| CTCN_582 | 29085 | TTCN_4341 | 43144 |
| ATCN_303 | 29086 | ATCN_3050 | 43145 |
| TTCN_407 | 29087 | TTCN_4342 | 43146 |
| TTCN_408 | 29088 | ATCN_3051 | 43147 |
| GTCN_338 | 29089 | ATCN_3052 | 43148 |
| TTCN_409 | 29090 | ATCN_3053 | 43149 |
| TTCN_410 | 29091 | CTCN_5457 | 43150 |
| GTCN_339 | 29092 | TTCN_4343 | 43151 |
| CTCN_583 | 29093 | TTCN_4344 | 43152 |
| ATCN_304 | 29094 | CTCN_5458 | 43153 |
| CTCN_584 | 29095 | CTCN_5459 | 43154 |
| GTCN_340 | 29096 | ATCN_3054 | 43155 |
| CTCN_585 | 29097 | TTCN_4345 | 43156 |
| TTCN_411 | 29098 | GTCN_2841 | 43157 |
| TTCN_412 | 29099 | CTCN_5460 | 43158 |
| ATCN_305 | 29100 | CTCN_5461 | 43159 |
| TTCN_413 | 29101 | ATCN_3055 | 43160 |
| CTCN_586 | 29102 | GTCN_2842 | 43161 |
| TTCN_414 | 29103 | CTCN_5462 | 43162 |
| GTCN_341 | 29104 | CTCN_5463 | 43163 |
| TTCN_415 | 29105 | GTCN_2843 | 43164 |
| GTCN_342 | 29106 | TTCN_4346 | 43165 |
| TTCN_416 | 29107 | ATCN_3056 | 43166 |
| TTCN_417 | 29108 | CTCN_5464 | 43167 |
| TTCN_418 | 29109 | TTCN_4347 | 43168 |
| GTCN_343 | 29110 | GTCN_2844 | 43169 |
| GTCN_344 | 29111 | ATCN_3057 | 43170 |
| TTCN_419 | 29112 | ATCN_3058 | 43171 |
| GTCN_345 | 29113 | CTCN_5465 | 43172 |
| ATCN_306 | 29114 | CTCN_5466 | 43173 |
| TTCN_420 | 29115 | TTCN_4348 | 43174 |
| TTCN_421 | 29116 | TTCN_4349 | 43175 |
| TTCN_422 | 29117 | ATCN_3059 | 43176 |
| CTCN_587 | 29118 | ATCN_3060 | 43177 |
| TTCN_423 | 29119 | GTCN_2845 | 43178 |
| CTCN_588 | 29120 | ATCN_3061 | 43179 |
| ATCN_307 | 29121 | CTCN_5467 | 43180 |
| CTCN_589 | 29122 | TTCN_4350 | 43181 |
| TTCN_424 | 29123 | GTCN_2846 | 43182 |
| TTCN_425 | 29124 | GTCN_2847 | 43183 |
| ATCN_308 | 29125 | ATCN_3062 | 43184 |
| ATCN_309 | 29126 | ATCN_3063 | 43185 |
| TTCN_426 | 29127 | ATCN_3064 | 43186 |

| | | | |
|---|---|---|---|
| CTCN_590 | 29128 | ATCN_3065 | 43187 |
| GTCN_346 | 29129 | TTCN_4351 | 43188 |
| GTCN_347 | 29130 | CTCN_5468 | 43189 |
| TTCN_427 | 29131 | GTCN_2848 | 43190 |
| TTCN_428 | 29132 | GTCN_2849 | 43191 |
| ATCN_310 | 29133 | TTCN_4352 | 43192 |
| CTCN_591 | 29134 | ATCN_3066 | 43193 |
| ATCN_311 | 29135 | TTCN_4353 | 43194 |
| CTCN_592 | 29136 | TTCN_4354 | 43195 |
| ATCN_312 | 29137 | ATCN_3067 | 43196 |
| GTCN_348 | 29138 | TTCN_4355 | 43197 |
| TTCN_429 | 29139 | GTCN_2850 | 43198 |
| CTCN_593 | 29140 | CTCN_5469 | 43199 |
| TTCN_430 | 29141 | CTCN_5470 | 43200 |
| CTCN_594 | 29142 | GTCN_2851 | 43201 |
| ATCN_313 | 29143 | GTCN_2852 | 43202 |
| TTCN_431 | 29144 | TTCN_4356 | 43203 |
| TTCN_432 | 29145 | ATCN_3068 | 43204 |
| CTCN_595 | 29146 | ATCN_3069 | 43205 |
| CTCN_596 | 29147 | ATCN_3070 | 43206 |
| TTCN_433 | 29148 | TTCN_4357 | 43207 |
| TTCN_434 | 29149 | GTCN_2853 | 43208 |
| GTCN_349 | 29150 | ATCN_3071 | 43209 |
| CTCN_597 | 29151 | CTCN_5471 | 43210 |
| ATCN_314 | 29152 | CTCN_5472 | 43211 |
| GTCN_350 | 29153 | ATCN_3072 | 43212 |
| TTCN_435 | 29154 | ATCN_3073 | 43213 |
| TTCN_436 | 29155 | TTCN_4358 | 43214 |
| CTCN_598 | 29156 | GTCN_2854 | 43215 |
| CTCN_599 | 29157 | CTCN_5473 | 43216 |
| GTCN_351 | 29158 | TTCN_4359 | 43217 |
| ATCN_315 | 29159 | TTCN_4360 | 43218 |
| CTCN_600 | 29160 | TTCN_4361 | 43219 |
| TTCN_437 | 29161 | CTCN_5474 | 43220 |
| TTCN_438 | 29162 | ATCN_3074 | 43221 |
| CTCN_601 | 29163 | TTCN_4362 | 43222 |
| TTCN_439 | 29164 | ATCN_3075 | 43223 |
| CTCN_602 | 29165 | ATCN_3076 | 43224 |
| ATCN_316 | 29166 | CTCN_5475 | 43225 |
| CTCN_603 | 29167 | CTCN_5476 | 43226 |
| CTCN_604 | 29168 | ATCN_3077 | 43227 |
| CTCN_605 | 29169 | GTCN_2855 | 43228 |
| TTCN_440 | 29170 | CTCN_5477 | 43229 |

FIG. 37 (continued)

| | | | |
|---|---|---|---|
| ATCN_317 | 29171 | CTCN_5478 | 43230 |
| CTCN_606 | 29172 | GTCN_2856 | 43231 |
| CTCN_607 | 29173 | CTCN_5479 | 43232 |
| TTCN_441 | 29174 | GTCN_2857 | 43233 |
| TTCN_442 | 29175 | GTCN_2858 | 43234 |
| ATCN_318 | 29176 | CTCN_5480 | 43235 |
| GTCN_352 | 29177 | CTCN_5481 | 43236 |
| GTCN_353 | 29178 | TTCN_4363 | 43237 |
| ATCN_319 | 29179 | GTCN_2859 | 43238 |
| TTCN_443 | 29180 | GTCN_2860 | 43239 |
| CTCN_608 | 29181 | TTCN_4364 | 43240 |
| GTCN_354 | 29182 | CTCN_5482 | 43241 |
| TTCN_444 | 29183 | ATCN_3078 | 43242 |
| ATCN_320 | 29184 | ATCN_3079 | 43243 |
| GTCN_355 | 29185 | GTCN_2861 | 43244 |
| TTCN_445 | 29186 | TTCN_4365 | 43245 |
| GTCN_356 | 29187 | TTCN_4366 | 43246 |
| TTCN_446 | 29188 | CTCN_5483 | 43247 |
| ATCN_321 | 29189 | CTCN_5484 | 43248 |
| GTCN_357 | 29190 | ATCN_3080 | 43249 |
| GTCN_358 | 29191 | ATCN_3081 | 43250 |
| TTCN_447 | 29192 | ATCN_3082 | 43251 |
| CTCN_609 | 29193 | ATCN_3083 | 43252 |
| GTCN_359 | 29194 | ATCN_3084 | 43253 |
| ATCN_322 | 29195 | GTCN_2862 | 43254 |
| CTCN_610 | 29196 | CTCN_5485 | 43255 |
| ATCN_323 | 29197 | CTCN_5486 | 43256 |
| ATCN_324 | 29198 | CTCN_5487 | 43257 |
| ATCN_325 | 29199 | GTCN_2863 | 43258 |
| CTCN_611 | 29200 | GTCN_2864 | 43259 |
| CTCN_612 | 29201 | TTCN_4367 | 43260 |
| CTCN_613 | 29202 | CTCN_5488 | 43261 |
| CTCN_614 | 29203 | GTCN_2865 | 43262 |
| GTCN_360 | 29204 | GTCN_2866 | 43263 |
| ATCN_326 | 29205 | CTCN_5489 | 43264 |
| ATCN_327 | 29206 | CTCN_5490 | 43265 |
| CTCN_615 | 29207 | GTCN_2867 | 43266 |
| GTCN_361 | 29208 | CTCN_5491 | 43267 |
| CTCN_616 | 29209 | TTCN_4368 | 43268 |
| TTCN_448 | 29210 | CTCN_5492 | 43269 |
| CTCN_617 | 29211 | TTCN_4369 | 43270 |
| TTCN_449 | 29212 | CTCN_5493 | 43271 |
| TTCN_450 | 29213 | GTCN_2868 | 43272 |

| | | | |
|---|---|---|---|
| CTCN_618 | 29214 | CTCN_5494 | 43273 |
| CTCN_619 | 29215 | ATCN_3085 | 43274 |
| TTCN_451 | 29216 | CTCN_5495 | 43275 |
| TTCN_452 | 29217 | CTCN_5496 | 43276 |
| ATCN_328 | 29218 | TTCN_4370 | 43277 |
| TTCN_453 | 29219 | CTCN_5497 | 43278 |
| TTCN_454 | 29220 | GTCN_2869 | 43279 |
| CTCN_620 | 29221 | CTCN_5498 | 43280 |
| GTCN_362 | 29222 | TTCN_4371 | 43281 |
| CTCN_621 | 29223 | CTCN_5499 | 43282 |
| TTCN_455 | 29224 | GTCN_2870 | 43283 |
| CTCN_622 | 29225 | GTCN_2871 | 43284 |
| TTCN_456 | 29226 | CTCN_5500 | 43285 |
| GTCN_363 | 29227 | TTCN_4372 | 43286 |
| ATCN_329 | 29228 | CTCN_5501 | 43287 |
| ATCN_330 | 29229 | ATCN_3086 | 43288 |
| ATCN_331 | 29230 | ATCN_3087 | 43289 |
| TTCN_457 | 29231 | TTCN_4373 | 43290 |
| CTCN_623 | 29232 | CTCN_5502 | 43291 |
| TTCN_458 | 29233 | CTCN_5503 | 43292 |
| GTCN_364 | 29234 | TTCN_4374 | 43293 |
| CTCN_624 | 29235 | ATCN_3088 | 43294 |
| GTCN_365 | 29236 | CTCN_5504 | 43295 |
| CTCN_625 | 29237 | ATCN_3089 | 43296 |
| CTCN_626 | 29238 | GTCN_2872 | 43297 |
| CTCN_627 | 29239 | ATCN_3090 | 43298 |
| CTCN_628 | 29240 | ATCN_3091 | 43299 |
| GTCN_366 | 29241 | ATCN_3092 | 43300 |
| TTCN_459 | 29242 | ATCN_3093 | 43301 |
| GTCN_367 | 29243 | GTCN_2873 | 43302 |
| TTCN_460 | 29244 | GTCN_2874 | 43303 |
| TTCN_461 | 29245 | TTCN_4375 | 43304 |
| GTCN_368 | 29246 | TTCN_4376 | 43305 |
| CTCN_629 | 29247 | TTCN_4377 | 43306 |
| TTCN_462 | 29248 | CTCN_5505 | 43307 |
| TTCN_463 | 29249 | TTCN_4378 | 43308 |
| TTCN_464 | 29250 | TTCN_4379 | 43309 |
| TTCN_465 | 29251 | TTCN_4380 | 43310 |
| CTCN_630 | 29252 | CTCN_5506 | 43311 |
| ATCN_332 | 29253 | TTCN_4381 | 43312 |
| ATCN_333 | 29254 | CTCN_5507 | 43313 |
| TTCN_466 | 29255 | CTCN_5508 | 43314 |
| CTCN_631 | 29256 | CTCN_5509 | 43315 |

FIG. 37 (continued)

| | | | |
|---|---|---|---|
| TTCN_467 | 29257 | CTCN_5510 | 43316 |
| ATCN_334 | 29258 | TTCN_4382 | 43317 |
| CTCN_632 | 29259 | TTCN_4383 | 43318 |
| CTCN_633 | 29260 | TTCN_4384 | 43319 |
| CTCN_634 | 29261 | CTCN_5511 | 43320 |
| TTCN_468 | 29262 | TTCN_4385 | 43321 |
| TTCN_469 | 29263 | TTCN_4386 | 43322 |
| GTCN_369 | 29264 | TTCN_4387 | 43323 |
| TTCN_470 | 29265 | CTCN_5512 | 43324 |
| GTCN_370 | 29266 | TTCN_4388 | 43325 |
| TTCN_471 | 29267 | TTCN_4389 | 43326 |
| GTCN_371 | 29268 | CTCN_5513 | 43327 |
| CTCN_635 | 29269 | TTCN_4390 | 43328 |
| ATCN_335 | 29270 | GTCN_2875 | 43329 |
| ATCN_336 | 29271 | ATCN_3094 | 43330 |
| ATCN_337 | 29272 | CTCN_5514 | 43331 |
| TTCN_472 | 29273 | CTCN_5515 | 43332 |
| CTCN_636 | 29274 | CTCN_5516 | 43333 |
| TTCN_473 | 29275 | CTCN_5517 | 43334 |
| TTCN_474 | 29276 | CTCN_5518 | 43335 |
| TTCN_475 | 29277 | TTCN_4391 | 43336 |
| ATCN_338 | 29278 | GTCN_2876 | 43337 |
| GTCN_372 | 29279 | TTCN_4392 | 43338 |
| TTCN_476 | 29280 | CTCN_5519 | 43339 |
| GTCN_373 | 29281 | CTCN_5520 | 43340 |
| TTCN_477 | 29282 | TTCN_4393 | 43341 |
| TTCN_478 | 29283 | TTCN_4394 | 43342 |
| ATCN_339 | 29284 | CTCN_5521 | 43343 |
| TTCN_479 | 29285 | CTCN_5522 | 43344 |
| GTCN_374 | 29286 | GTCN_2877 | 43345 |
| TTCN_480 | 29287 | ATCN_3095 | 43346 |
| GTCN_375 | 29288 | CTCN_5523 | 43347 |
| TTCN_481 | 29289 | GTCN_2878 | 43348 |
| GTCN_376 | 29290 | ATCN_3096 | 43349 |
| CTCN_637 | 29291 | ATCN_3097 | 43350 |
| CTCN_638 | 29292 | TTCN_4395 | 43351 |
| TTCN_482 | 29293 | CTCN_5524 | 43352 |
| ATCN_340 | 29294 | TTCN_4396 | 43353 |
| CTCN_639 | 29295 | TTCN_4397 | 43354 |
| ATCN_341 | 29296 | TTCN_4398 | 43355 |
| CTCN_640 | 29297 | CTCN_5525 | 43356 |
| ATCN_342 | 29298 | TTCN_4399 | 43357 |
| ATCN_343 | 29299 | ATCN_3098 | 43358 |

| | | | |
|---|---|---|---|
| CTCN_641 | 29300 | TTCN_4400 | 43359 |
| CTCN_642 | 29301 | TTCN_4401 | 43360 |
| TTCN_483 | 29302 | ATCN_3099 | 43361 |
| CTCN_643 | 29303 | CTCN_5526 | 43362 |
| GTCN_377 | 29304 | CTCN_5527 | 43363 |
| GTCN_378 | 29305 | TTCN_4402 | 43364 |
| CTCN_644 | 29306 | CTCN_5528 | 43365 |
| CTCN_645 | 29307 | TTCN_4403 | 43366 |
| GTCN_379 | 29308 | TTCN_4404 | 43367 |
| GTCN_380 | 29309 | GTCN_2879 | 43368 |
| ATCN_344 | 29310 | CTCN_5529 | 43369 |
| CTCN_646 | 29311 | GTCN_2880 | 43370 |
| CTCN_647 | 29312 | TTCN_4405 | 43371 |
| CTCN_648 | 29313 | TTCN_4406 | 43372 |
| TTCN_484 | 29314 | ATCN_3100 | 43373 |
| ATCN_345 | 29315 | CTCN_5530 | 43374 |
| TTCN_485 | 29316 | TTCN_4407 | 43375 |
| CTCN_649 | 29317 | CTCN_5531 | 43376 |
| CTCN_650 | 29318 | CTCN_5532 | 43377 |
| CTCN_651 | 29319 | GTCN_2881 | 43378 |
| CTCN_652 | 29320 | CTCN_5533 | 43379 |
| CTCN_653 | 29321 | GTCN_2882 | 43380 |
| CTCN_654 | 29322 | ATCN_3101 | 43381 |
| CTCN_655 | 29323 | CTCN_5534 | 43382 |
| GTCN_381 | 29324 | GTCN_2883 | 43383 |
| CTCN_656 | 29325 | CTCN_5535 | 43384 |
| ATCN_346 | 29326 | GTCN_2884 | 43385 |
| CTCN_657 | 29327 | TTCN_4408 | 43386 |
| TTCN_486 | 29328 | CTCN_5536 | 43387 |
| GTCN_382 | 29329 | GTCN_2885 | 43388 |
| CTCN_658 | 29330 | TTCN_4409 | 43389 |
| TTCN_487 | 29331 | GTCN_2886 | 43390 |
| TTCN_488 | 29332 | GTCN_2887 | 43391 |
| ATCN_347 | 29333 | TTCN_4410 | 43392 |
| TTCN_489 | 29334 | CTCN_5537 | 43393 |
| GTCN_383 | 29335 | CTCN_5538 | 43394 |
| GTCN_384 | 29336 | GTCN_2888 | 43395 |
| CTCN_659 | 29337 | CTCN_5539 | 43396 |
| GTCN_385 | 29338 | CTCN_5540 | 43397 |
| GTCN_386 | 29339 | CTCN_5541 | 43398 |
| ATCN_348 | 29340 | CTCN_5542 | 43399 |
| TTCN_490 | 29341 | CTCN_5543 | 43400 |
| TTCN_491 | 29342 | GTCN_2889 | 43401 |

FIG. 37 (continued)

| | | | |
|---|---|---|---|
| CTCN_660 | 29343 | GTCN_2890 | 43402 |
| CTCN_661 | 29344 | GTCN_2891 | 43403 |
| CTCN_662 | 29345 | CTCN_5544 | 43404 |
| CTCN_663 | 29346 | ATCN_3102 | 43405 |
| CTCN_664 | 29347 | GTCN_2892 | 43406 |
| CTCN_665 | 29348 | TTCN_4411 | 43407 |
| ATCN_349 | 29349 | TTCN_4412 | 43408 |
| TTCN_492 | 29350 | ATCN_3103 | 43409 |
| TTCN_493 | 29351 | GTCN_2893 | 43410 |
| CTCN_666 | 29352 | ATCN_3104 | 43411 |
| TTCN_494 | 29353 | ATCN_3105 | 43412 |
| TTCN_495 | 29354 | CTCN_5545 | 43413 |
| ATCN_350 | 29355 | CTCN_5546 | 43414 |
| CTCN_667 | 29356 | ATCN_3106 | 43415 |
| CTCN_668 | 29357 | GTCN_2894 | 43416 |
| ATCN_351 | 29358 | GTCN_2895 | 43417 |
| CTCN_669 | 29359 | TTCN_4413 | 43418 |
| CTCN_670 | 29360 | TTCN_4414 | 43419 |
| CTCN_671 | 29361 | GTCN_2896 | 43420 |
| CTCN_672 | 29362 | CTCN_5547 | 43421 |
| TTCN_496 | 29363 | GTCN_2897 | 43422 |
| CTCN_673 | 29364 | TTCN_4415 | 43423 |
| TTCN_497 | 29365 | ATCN_3107 | 43424 |
| GTCN_387 | 29366 | ATCN_3108 | 43425 |
| CTCN_674 | 29367 | CTCN_5548 | 43426 |
| GTCN_388 | 29368 | GTCN_2898 | 43427 |
| CTCN_675 | 29369 | TTCN_4416 | 43428 |
| CTCN_676 | 29370 | CTCN_5549 | 43429 |
| CTCN_677 | 29371 | TTCN_4417 | 43430 |
| ATCN_352 | 29372 | CTCN_5550 | 43431 |
| ATCN_353 | 29373 | ATCN_3109 | 43432 |
| CTCN_678 | 29374 | TTCN_4418 | 43433 |
| CTCN_679 | 29375 | TTCN_4419 | 43434 |
| ATCN_354 | 29376 | ATCN_3110 | 43435 |
| CTCN_680 | 29377 | TTCN_4420 | 43436 |
| ATCN_355 | 29378 | ATCN_3111 | 43437 |
| ATCN_356 | 29379 | GTCN_2899 | 43438 |
| CTCN_681 | 29380 | ATCN_3112 | 43439 |
| GTCN_389 | 29381 | ATCN_3113 | 43440 |
| CTCN_682 | 29382 | CTCN_5551 | 43441 |
| CTCN_683 | 29383 | CTCN_5552 | 43442 |
| ATCN_357 | 29384 | ATCN_3114 | 43443 |
| ATCN_358 | 29385 | CTCN_5553 | 43444 |

| | | | |
|---|---|---|---|
| GTCN_390 | 29386 | GTCN_2900 | 43445 |
| CTCN_684 | 29387 | GTCN_2901 | 43446 |
| ATCN_359 | 29388 | CTCN_5554 | 43447 |
| GTCN_391 | 29389 | TTCN_4421 | 43448 |
| GTCN_392 | 29390 | CTCN_5555 | 43449 |
| CTCN_685 | 29391 | GTCN_2902 | 43450 |
| CTCN_686 | 29392 | CTCN_5556 | 43451 |
| CTCN_687 | 29393 | TTCN_4422 | 43452 |
| GTCN_393 | 29394 | CTCN_5557 | 43453 |
| CTCN_688 | 29395 | CTCN_5558 | 43454 |
| GTCN_394 | 29396 | CTCN_5559 | 43455 |
| GTCN_395 | 29397 | TTCN_4423 | 43456 |
| CTCN_689 | 29398 | TTCN_4424 | 43457 |
| CTCN_690 | 29399 | TTCN_4425 | 43458 |
| GTCN_396 | 29400 | GTCN_2903 | 43459 |
| TTCN_498 | 29401 | TTCN_4426 | 43460 |
| GTCN_397 | 29402 | ATCN_3115 | 43461 |
| GTCN_398 | 29403 | CTCN_5560 | 43462 |
| TTCN_499 | 29404 | CTCN_5561 | 43463 |
| GTCN_399 | 29405 | TTCN_4427 | 43464 |
| GTCN_400 | 29406 | GTCN_2904 | 43465 |
| CTCN_691 | 29407 | TTCN_4428 | 43466 |
| ATCN_360 | 29408 | GTCN_2905 | 43467 |
| ATCN_361 | 29409 | CTCN_5562 | 43468 |
| CTCN_692 | 29410 | CTCN_5563 | 43469 |
| CTCN_693 | 29411 | CTCN_5564 | 43470 |
| CTCN_694 | 29412 | TTCN_4429 | 43471 |
| ATCN_362 | 29413 | CTCN_5565 | 43472 |
| ATCN_363 | 29414 | TTCN_4430 | 43473 |
| CTCN_695 | 29415 | CTCN_5566 | 43474 |
| CTCN_696 | 29416 | CTCN_5567 | 43475 |
| GTCN_401 | 29417 | CTCN_5568 | 43476 |
| TTCN_500 | 29418 | ATCN_3116 | 43477 |
| GTCN_402 | 29419 | TTCN_4431 | 43478 |
| CTCN_697 | 29420 | TTCN_4432 | 43479 |
| GTCN_403 | 29421 | CTCN_5569 | 43480 |
| CTCN_698 | 29422 | CTCN_5570 | 43481 |
| TTCN_501 | 29423 | TTCN_4433 | 43482 |
| CTCN_699 | 29424 | CTCN_5571 | 43483 |
| GTCN_404 | 29425 | ATCN_3117 | 43484 |
| CTCN_700 | 29426 | TTCN_4434 | 43485 |
| ATCN_364 | 29427 | GTCN_2906 | 43486 |
| ATCN_365 | 29428 | TTCN_4435 | 43487 |

FIG. 37 (continued)

| | | | |
|---|---|---|---|
| CTCN_701 | 29429 | TTCN_4436 | 43488 |
| CTCN_702 | 29430 | CTCN_5572 | 43489 |
| TTCN_502 | 29431 | GTCN_2907 | 43490 |
| CTCN_703 | 29432 | TTCN_4437 | 43491 |
| TTCN_503 | 29433 | CTCN_5573 | 43492 |
| TTCN_504 | 29434 | TTCN_4438 | 43493 |
| CTCN_704 | 29435 | GTCN_2908 | 43494 |
| CTCN_705 | 29436 | CTCN_5574 | 43495 |
| CTCN_706 | 29437 | GTCN_2909 | 43496 |
| CTCN_707 | 29438 | GTCN_2910 | 43497 |
| GTCN_405 | 29439 | CTCN_5575 | 43498 |
| GTCN_406 | 29440 | CTCN_5576 | 43499 |
| CTCN_708 | 29441 | GTCN_2911 | 43500 |
| GTCN_407 | 29442 | CTCN_5577 | 43501 |
| TTCN_505 | 29443 | TTCN_4439 | 43502 |
| ATCN_366 | 29444 | CTCN_5578 | 43503 |
| GTCN_408 | 29445 | ATCN_3118 | 43504 |
| CTCN_709 | 29446 | TTCN_4440 | 43505 |
| ATCN_367 | 29447 | CTCN_5579 | 43506 |
| GTCN_409 | 29448 | TTCN_4441 | 43507 |
| GTCN_410 | 29449 | ATCN_3119 | 43508 |
| TTCN_506 | 29450 | GTCN_2912 | 43509 |
| CTCN_710 | 29451 | TTCN_4442 | 43510 |
| TTCN_507 | 29452 | CTCN_5580 | 43511 |
| CTCN_711 | 29453 | ATCN_3120 | 43512 |
| CTCN_712 | 29454 | CTCN_5581 | 43513 |
| TTCN_508 | 29455 | CTCN_5582 | 43514 |
| CTCN_713 | 29456 | ATCN_3121 | 43515 |
| TTCN_509 | 29457 | ATCN_3122 | 43516 |
| CTCN_714 | 29458 | ATCN_3123 | 43517 |
| GTCN_411 | 29459 | CTCN_5583 | 43518 |
| CTCN_715 | 29460 | ATCN_3124 | 43519 |
| TTCN_510 | 29461 | CTCN_5584 | 43520 |
| ATCN_368 | 29462 | CTCN_5585 | 43521 |
| CTCN_716 | 29463 | ATCN_3125 | 43522 |
| CTCN_717 | 29464 | TTCN_4443 | 43523 |
| ATCN_369 | 29465 | TTCN_4444 | 43524 |
| ATCN_370 | 29466 | ATCN_3126 | 43525 |
| ATCN_371 | 29467 | TTCN_4445 | 43526 |
| CTCN_718 | 29468 | TTCN_4446 | 43527 |
| TTCN_511 | 29469 | CTCN_5586 | 43528 |
| CTCN_719 | 29470 | TTCN_4447 | 43529 |
| CTCN_720 | 29471 | CTCN_5587 | 43530 |

| | | | |
|---|---|---|---|
| TTCN_512 | 29472 | GTCN_2913 | 43531 |
| GTCN_412 | 29473 | ATCN_3127 | 43532 |
| TTCN_513 | 29474 | TTCN_4448 | 43533 |
| GTCN_413 | 29475 | CTCN_5588 | 43534 |
| CTCN_721 | 29476 | GTCN_2914 | 43535 |
| CTCN_722 | 29477 | CTCN_5589 | 43536 |
| GTCN_414 | 29478 | CTCN_5590 | 43537 |
| CTCN_723 | 29479 | CTCN_5591 | 43538 |
| ATCN_372 | 29480 | CTCN_5592 | 43539 |
| ATCN_373 | 29481 | TTCN_4449 | 43540 |
| TTCN_514 | 29482 | TTCN_4450 | 43541 |
| TTCN_515 | 29483 | GTCN_2915 | 43542 |
| GTCN_415 | 29484 | CTCN_5593 | 43543 |
| ATCN_374 | 29485 | TTCN_4451 | 43544 |
| TTCN_516 | 29486 | CTCN_5594 | 43545 |
| CTCN_724 | 29487 | CTCN_5595 | 43546 |
| ATCN_375 | 29488 | TTCN_4452 | 43547 |
| GTCN_416 | 29489 | ATCN_3128 | 43548 |
| CTCN_725 | 29490 | CTCN_5596 | 43549 |
| CTCN_726 | 29491 | ATCN_3129 | 43550 |
| CTCN_727 | 29492 | TTCN_4453 | 43551 |
| GTCN_417 | 29493 | ATCN_3130 | 43552 |
| TTCN_517 | 29494 | GTCN_2916 | 43553 |
| ATCN_376 | 29495 | CTCN_5597 | 43554 |
| ATCN_377 | 29496 | GTCN_2917 | 43555 |
| CTCN_728 | 29497 | TTCN_4454 | 43556 |
| CTCN_729 | 29498 | ATCN_3131 | 43557 |
| CTCN_730 | 29499 | TTCN_4455 | 43558 |
| TTCN_518 | 29500 | GTCN_2918 | 43559 |
| ATCN_378 | 29501 | CTCN_5598 | 43560 |
| TTCN_519 | 29502 | TTCN_4456 | 43561 |
| CTCN_731 | 29503 | CTCN_5599 | 43562 |
| CTCN_732 | 29504 | TTCN_4457 | 43563 |
| CTCN_733 | 29505 | CTCN_5600 | 43564 |
| CTCN_734 | 29506 | GTCN_2919 | 43565 |
| ATCN_379 | 29507 | GTCN_2920 | 43566 |
| ATCN_380 | 29508 | TTCN_4458 | 43567 |
| GTCN_418 | 29509 | TTCN_4459 | 43568 |
| GTCN_419 | 29510 | CTCN_5601 | 43569 |
| CTCN_735 | 29511 | ATCN_3132 | 43570 |
| CTCN_736 | 29512 | CTCN_5602 | 43571 |
| GTCN_420 | 29513 | CTCN_5603 | 43572 |
| CTCN_737 | 29514 | GTCN_2921 | 43573 |

FIG. 37 (continued)

| | | | |
|---|---|---|---|
| ATCN_381 | 29515 | ATCN_3133 | 43574 |
| TTCN_520 | 29516 | ATCN_3134 | 43575 |
| CTCN_738 | 29517 | ATCN_3135 | 43576 |
| ATCN_382 | 29518 | CTCN_5604 | 43577 |
| ATCN_383 | 29519 | GTCN_2922 | 43578 |
| CTCN_739 | 29520 | TTCN_4460 | 43579 |
| CTCN_740 | 29521 | TTCN_4461 | 43580 |
| GTCN_421 | 29522 | CTCN_5605 | 43581 |
| TTCN_521 | 29523 | CTCN_5606 | 43582 |
| TTCN_522 | 29524 | TTCN_4462 | 43583 |
| ATCN_384 | 29525 | CTCN_5607 | 43584 |
| TTCN_523 | 29526 | TTCN_4463 | 43585 |
| TTCN_524 | 29527 | CTCN_5608 | 43586 |
| CTCN_741 | 29528 | CTCN_5609 | 43587 |
| TTCN_525 | 29529 | ATCN_3136 | 43588 |
| TTCN_526 | 29530 | CTCN_5610 | 43589 |
| TTCN_527 | 29531 | CTCN_5611 | 43590 |
| GTCN_422 | 29532 | CTCN_5612 | 43591 |
| TTCN_528 | 29533 | TTCN_4464 | 43592 |
| TTCN_529 | 29534 | TTCN_4465 | 43593 |
| ATCN_385 | 29535 | TTCN_4466 | 43594 |
| TTCN_530 | 29536 | CTCN_5613 | 43595 |
| TTCN_531 | 29537 | CTCN_5614 | 43596 |
| ATCN_386 | 29538 | TTCN_4467 | 43597 |
| CTCN_742 | 29539 | GTCN_2923 | 43598 |
| GTCN_423 | 29540 | GTCN_2924 | 43599 |
| TTCN_532 | 29541 | CTCN_5615 | 43600 |
| TTCN_533 | 29542 | CTCN_5616 | 43601 |
| TTCN_534 | 29543 | GTCN_2925 | 43602 |
| CTCN_743 | 29544 | CTCN_5617 | 43603 |
| GTCN_424 | 29545 | CTCN_5618 | 43604 |
| GTCN_425 | 29546 | ATCN_3137 | 43605 |
| CTCN_744 | 29547 | TTCN_4468 | 43606 |
| CTCN_745 | 29548 | TTCN_4469 | 43607 |
| CTCN_746 | 29549 | GTCN_2926 | 43608 |
| ATCN_387 | 29550 | TTCN_4470 | 43609 |
| CTCN_747 | 29551 | ATCN_3138 | 43610 |
| TTCN_535 | 29552 | TTCN_4471 | 43611 |
| CTCN_748 | 29553 | TTCN_4472 | 43612 |
| ATCN_388 | 29554 | TTCN_4473 | 43613 |
| CTCN_749 | 29555 | TTCN_4474 | 43614 |
| ATCN_389 | 29556 | TTCN_4475 | 43615 |
| GTCN_426 | 29557 | TTCN_4476 | 43616 |

| | | | |
|---|---|---|---|
| CTCN_750 | 29558 | TTCN_4477 | 43617 |
| TTCN_536 | 29559 | ATCN_3139 | 43618 |
| CTCN_751 | 29560 | CTCN_5619 | 43619 |
| CTCN_752 | 29561 | ATCN_3140 | 43620 |
| CTCN_753 | 29562 | GTCN_2927 | 43621 |
| ATCN_390 | 29563 | TTCN_4478 | 43622 |
| TTCN_537 | 29564 | CTCN_5620 | 43623 |
| CTCN_754 | 29565 | TTCN_4479 | 43624 |
| ATCN_391 | 29566 | GTCN_2928 | 43625 |
| TTCN_538 | 29567 | CTCN_5621 | 43626 |
| ATCN_392 | 29568 | GTCN_2929 | 43627 |
| CTCN_755 | 29569 | ATCN_3141 | 43628 |
| ATCN_393 | 29570 | ATCN_3142 | 43629 |
| ATCN_394 | 29571 | ATCN_3143 | 43630 |
| ATCN_395 | 29572 | ATCN_3144 | 43631 |
| ATCN_396 | 29573 | TTCN_4480 | 43632 |
| CTCN_756 | 29574 | CTCN_5622 | 43633 |
| GTCN_427 | 29575 | GTCN_2930 | 43634 |
| ATCN_397 | 29576 | GTCN_2931 | 43635 |
| TTCN_539 | 29577 | TTCN_4481 | 43636 |
| GTCN_428 | 29578 | CTCN_5623 | 43637 |
| ATCN_398 | 29579 | CTCN_5624 | 43638 |
| ATCN_399 | 29580 | GTCN_2932 | 43639 |
| TTCN_540 | 29581 | CTCN_5625 | 43640 |
| TTCN_541 | 29582 | ATCN_3145 | 43641 |
| ATCN_400 | 29583 | ATCN_3146 | 43642 |
| ATCN_401 | 29584 | CTCN_5626 | 43643 |
| ATCN_402 | 29585 | ATCN_3147 | 43644 |
| CTCN_757 | 29586 | TTCN_4482 | 43645 |
| TTCN_542 | 29587 | ATCN_3148 | 43646 |
| ATCN_403 | 29588 | TTCN_4483 | 43647 |
| TTCN_543 | 29589 | TTCN_4484 | 43648 |
| TTCN_544 | 29590 | CTCN_5627 | 43649 |
| TTCN_545 | 29591 | CTCN_5628 | 43650 |
| TTCN_546 | 29592 | TTCN_4485 | 43651 |
| CTCN_758 | 29593 | CTCN_5629 | 43652 |
| CTCN_759 | 29594 | GTCN_2933 | 43653 |
| GTCN_429 | 29595 | TTCN_4486 | 43654 |
| TTCN_547 | 29596 | TTCN_4487 | 43655 |
| TTCN_548 | 29597 | CTCN_5630 | 43656 |
| GTCN_430 | 29598 | ATCN_3149 | 43657 |
| TTCN_549 | 29599 | TTCN_4488 | 43658 |
| CTCN_760 | 29600 | CTCN_5631 | 43659 |

FIG. 37 (continued)

| | | | | | | | |
|---|---|---|---|---|---|---|---|
| CTCN_761 | 29601 | CTCN_5632 | 43660 | ATCN_412 | 29644 | TTCN_4500 | 43703 |
| TTCN_550 | 29602 | ATCN_3150 | 43661 | ATCN_413 | 29645 | CTCN_5651 | 43704 |
| ATCN_404 | 29603 | CTCN_5633 | 43662 | CTCN_781 | 29646 | GTCN_2942 | 43705 |
| ATCN_405 | 29604 | GTCN_2934 | 43663 | TTCN_558 | 29647 | TTCN_4501 | 43706 |
| CTCN_762 | 29605 | CTCN_5634 | 43664 | TTCN_559 | 29648 | CTCN_5652 | 43707 |
| GTCN_431 | 29606 | GTCN_2935 | 43665 | TTCN_560 | 29649 | ATCN_3155 | 43708 |
| GTCN_432 | 29607 | ATCN_3151 | 43666 | ATCN_414 | 29650 | ATCN_3156 | 43709 |
| CTCN_763 | 29608 | CTCN_5635 | 43667 | CTCN_782 | 29651 | TTCN_4502 | 43710 |
| GTCN_433 | 29609 | TTCN_4489 | 43668 | TTCN_561 | 29652 | ATCN_3157 | 43711 |
| CTCN_764 | 29610 | CTCN_5636 | 43669 | CTCN_783 | 29653 | CTCN_5653 | 43712 |
| ATCN_406 | 29611 | CTCN_5637 | 43670 | GTCN_438 | 29654 | CTCN_5654 | 43713 |
| ATCN_407 | 29612 | CTCN_5638 | 43671 | CTCN_784 | 29655 | ATCN_3158 | 43714 |
| CTCN_765 | 29613 | TTCN_4490 | 43672 | TTCN_562 | 29656 | ATCN_3159 | 43715 |
| TTCN_551 | 29614 | GTCN_2936 | 43673 | TTCN_563 | 29657 | CTCN_5655 | 43716 |
| CTCN_766 | 29615 | CTCN_5639 | 43674 | TTCN_564 | 29658 | CTCN_5656 | 43717 |
| CTCN_767 | 29616 | GTCN_2937 | 43675 | ATCN_415 | 29659 | CTCN_5657 | 43718 |
| TTCN_552 | 29617 | TTCN_4491 | 43676 | ATCN_416 | 29660 | TTCN_4503 | 43719 |
| ATCN_408 | 29618 | ATCN_3152 | 43677 | CTCN_785 | 29661 | CTCN_5658 | 43720 |
| TTCN_553 | 29619 | GTCN_2938 | 43678 | TTCN_565 | 29662 | GTCN_2943 | 43721 |
| CTCN_768 | 29620 | ATCN_3153 | 43679 | ATCN_417 | 29663 | CTCN_5659 | 43722 |
| CTCN_769 | 29621 | CTCN_5640 | 43680 | TTCN_566 | 29664 | ATCN_3160 | 43723 |
| CTCN_770 | 29622 | TTCN_4492 | 43681 | ATCN_418 | 29665 | CTCN_5660 | 43724 |
| CTCN_771 | 29623 | TTCN_4493 | 43682 | ATCN_419 | 29666 | ATCN_3161 | 43725 |
| TTCN_554 | 29624 | TTCN_4494 | 43683 | TTCN_567 | 29667 | TTCN_4504 | 43726 |
| CTCN_772 | 29625 | CTCN_5641 | 43684 | ATCN_420 | 29668 | TTCN_4505 | 43727 |
| GTCN_434 | 29626 | TTCN_4495 | 43685 | TTCN_568 | 29669 | TTCN_4506 | 43728 |
| TTCN_555 | 29627 | GTCN_2939 | 43686 | CTCN_786 | 29670 | CTCN_5661 | 43729 |
| GTCN_435 | 29628 | CTCN_5642 | 43687 | GTCN_439 | 29671 | GTCN_2944 | 43730 |
| CTCN_773 | 29629 | CTCN_5643 | 43688 | TTCN_569 | 29672 | CTCN_5662 | 43731 |
| CTCN_774 | 29630 | CTCN_5644 | 43689 | TTCN_570 | 29673 | GTCN_2945 | 43732 |
| CTCN_775 | 29631 | GTCN_2940 | 43690 | CTCN_787 | 29674 | GTCN_2946 | 43733 |
| ATCN_409 | 29632 | TTCN_4496 | 43691 | TTCN_571 | 29675 | CTCN_5663 | 43734 |
| ATCN_410 | 29633 | TTCN_4497 | 43692 | GTCN_440 | 29676 | CTCN_5664 | 43735 |
| CTCN_776 | 29634 | CTCN_5645 | 43693 | GTCN_441 | 29677 | GTCN_2947 | 43736 |
| CTCN_777 | 29635 | CTCN_5646 | 43694 | CTCN_788 | 29678 | TTCN_4507 | 43737 |
| ATCN_411 | 29636 | TTCN_4498 | 43695 | CTCN_789 | 29679 | TTCN_4508 | 43738 |
| CTCN_778 | 29637 | CTCN_5647 | 43696 | GTCN_442 | 29680 | CTCN_5665 | 43739 |
| GTCN_436 | 29638 | CTCN_5648 | 43697 | CTCN_790 | 29681 | GTCN_2948 | 43740 |
| CTCN_779 | 29639 | CTCN_5649 | 43698 | TTCN_572 | 29682 | TTCN_4509 | 43741 |
| GTCN_437 | 29640 | CTCN_5650 | 43699 | ATCN_421 | 29683 | TTCN_4510 | 43742 |
| TTCN_556 | 29641 | TTCN_4499 | 43700 | TTCN_573 | 29684 | TTCN_4511 | 43743 |
| CTCN_780 | 29642 | GTCN_2941 | 43701 | ATCN_422 | 29685 | TTCN_4512 | 43744 |
| TTCN_557 | 29643 | ATCN_3154 | 43702 | TTCN_574 | 29686 | ATCN_3162 | 43745 |

FIG. 37 (continued)

| | | | |
|---|---|---|---|
| TTCN_575 | 29687 | ATCN_3163 | 43746 |
| GTCN_443 | 29688 | TTCN_4513 | 43747 |
| CTCN_791 | 29689 | CTCN_5666 | 43748 |
| CTCN_792 | 29690 | TTCN_4514 | 43749 |
| CTCN_793 | 29691 | GTCN_2949 | 43750 |
| CTCN_794 | 29692 | TTCN_4515 | 43751 |
| TTCN_576 | 29693 | CTCN_5667 | 43752 |
| CTCN_795 | 29694 | GTCN_2950 | 43753 |
| CTCN_796 | 29695 | GTCN_2951 | 43754 |
| CTCN_797 | 29696 | TTCN_4516 | 43755 |
| TTCN_577 | 29697 | TTCN_4517 | 43756 |
| CTCN_798 | 29698 | ATCN_3164 | 43757 |
| GTCN_444 | 29699 | TTCN_4518 | 43758 |
| CTCN_799 | 29700 | TTCN_4519 | 43759 |
| GTCN_445 | 29701 | TTCN_4520 | 43760 |
| CTCN_800 | 29702 | TTCN_4521 | 43761 |
| GTCN_446 | 29703 | GTCN_2952 | 43762 |
| ATCN_423 | 29704 | ATCN_3165 | 43763 |
| CTCN_801 | 29705 | ATCN_3166 | 43764 |
| GTCN_447 | 29706 | CTCN_5668 | 43765 |
| TTCN_578 | 29707 | CTCN_5669 | 43766 |
| CTCN_802 | 29708 | CTCN_5670 | 43767 |
| TTCN_579 | 29709 | TTCN_4522 | 43768 |
| TTCN_580 | 29710 | CTCN_5671 | 43769 |
| TTCN_581 | 29711 | ATCN_3167 | 43770 |
| ATCN_424 | 29712 | CTCN_5672 | 43771 |
| GTCN_448 | 29713 | CTCN_5673 | 43772 |
| ATCN_425 | 29714 | TTCN_4523 | 43773 |
| TTCN_582 | 29715 | TTCN_4524 | 43774 |
| CTCN_803 | 29716 | TTCN_4525 | 43775 |
| TTCN_583 | 29717 | TTCN_4526 | 43776 |
| GTCN_449 | 29718 | ATCN_3168 | 43777 |
| TTCN_584 | 29719 | CTCN_5674 | 43778 |
| GTCN_450 | 29720 | TTCN_4527 | 43779 |
| GTCN_451 | 29721 | CTCN_5675 | 43780 |
| CTCN_804 | 29722 | CTCN_5676 | 43781 |
| CTCN_805 | 29723 | CTCN_5677 | 43782 |
| GTCN_452 | 29724 | GTCN_2953 | 43783 |
| CTCN_806 | 29725 | GTCN_2954 | 43784 |
| TTCN_585 | 29726 | ATCN_3169 | 43785 |
| GTCN_453 | 29727 | GTCN_2955 | 43786 |
| CTCN_807 | 29728 | CTCN_5678 | 43787 |
| GTCN_454 | 29729 | GTCN_2956 | 43788 |

| | | | |
|---|---|---|---|
| ATCN_426 | 29730 | CTCN_5679 | 43789 |
| CTCN_808 | 29731 | CTCN_5680 | 43790 |
| CTCN_809 | 29732 | TTCN_4528 | 43791 |
| TTCN_586 | 29733 | TTCN_4529 | 43792 |
| TTCN_587 | 29734 | CTCN_5681 | 43793 |
| GTCN_455 | 29735 | ATCN_3170 | 43794 |
| TTCN_588 | 29736 | ATCN_3171 | 43795 |
| GTCN_456 | 29737 | ATCN_3172 | 43796 |
| TTCN_589 | 29738 | CTCN_5682 | 43797 |
| CTCN_810 | 29739 | ATCN_3173 | 43798 |
| CTCN_811 | 29740 | GTCN_2957 | 43799 |
| CTCN_812 | 29741 | TTCN_4530 | 43800 |
| TTCN_590 | 29742 | CTCN_5683 | 43801 |
| TTCN_591 | 29743 | TTCN_4531 | 43802 |
| CTCN_813 | 29744 | ATCN_3174 | 43803 |
| GTCN_457 | 29745 | TTCN_4532 | 43804 |
| TTCN_592 | 29746 | CTCN_5684 | 43805 |
| CTCN_814 | 29747 | ATCN_3175 | 43806 |
| GTCN_458 | 29748 | GTCN_2958 | 43807 |
| ATCN_427 | 29749 | TTCN_4533 | 43808 |
| GTCN_459 | 29750 | GTCN_2959 | 43809 |
| GTCN_460 | 29751 | TTCN_4534 | 43810 |
| GTCN_461 | 29752 | GTCN_2960 | 43811 |
| TTCN_593 | 29753 | CTCN_5685 | 43812 |
| CTCN_815 | 29754 | GTCN_2961 | 43813 |
| TTCN_594 | 29755 | CTCN_5686 | 43814 |
| TTCN_595 | 29756 | CTCN_5687 | 43815 |
| TTCN_596 | 29757 | GTCN_2962 | 43816 |
| ATCN_428 | 29758 | CTCN_5688 | 43817 |
| TTCN_597 | 29759 | TTCN_4535 | 43818 |
| GTCN_462 | 29760 | GTCN_2963 | 43819 |
| CTCN_816 | 29761 | TTCN_4536 | 43820 |
| ATCN_429 | 29762 | CTCN_5689 | 43821 |
| CTCN_817 | 29763 | ATCN_3176 | 43822 |
| TTCN_598 | 29764 | CTCN_5690 | 43823 |
| TTCN_599 | 29765 | ATCN_3177 | 43824 |
| GTCN_463 | 29766 | CTCN_5691 | 43825 |
| ATCN_430 | 29767 | TTCN_4537 | 43826 |
| TTCN_600 | 29768 | GTCN_2964 | 43827 |
| TTCN_601 | 29769 | GTCN_2965 | 43828 |
| GTCN_464 | 29770 | CTCN_5692 | 43829 |
| GTCN_465 | 29771 | GTCN_2966 | 43830 |
| TTCN_602 | 29772 | GTCN_2967 | 43831 |

FIG. 37 (continued)

| | | | | | | | |
|---|---|---|---|---|---|---|---|
| CTCN_818 | 29773 | CTCN_5693 | 43832 | TTCN_616 | 29816 | CTCN_5711 | 43875 |
| ATCN_431 | 29774 | CTCN_5694 | 43833 | TTCN_617 | 29817 | GTCN_2983 | 43876 |
| GTCN_466 | 29775 | TTCN_4538 | 43834 | TTCN_618 | 29818 | CTCN_5712 | 43877 |
| TTCN_603 | 29776 | GTCN_2968 | 43835 | CTCN_834 | 29819 | CTCN_5713 | 43878 |
| TTCN_604 | 29777 | CTCN_5695 | 43836 | CTCN_835 | 29820 | TTCN_4545 | 43879 |
| GTCN_467 | 29778 | GTCN_2969 | 43837 | TTCN_619 | 29821 | TTCN_4546 | 43880 |
| CTCN_819 | 29779 | GTCN_2970 | 43838 | ATCN_437 | 29822 | CTCN_5714 | 43881 |
| CTCN_820 | 29780 | GTCN_2971 | 43839 | CTCN_836 | 29823 | TTCN_4547 | 43882 |
| CTCN_821 | 29781 | CTCN_5696 | 43840 | ATCN_438 | 29824 | CTCN_5715 | 43883 |
| GTCN_468 | 29782 | TTCN_4539 | 43841 | ATCN_439 | 29825 | TTCN_4548 | 43884 |
| CTCN_822 | 29783 | CTCN_5697 | 43842 | TTCN_620 | 29826 | ATCN_3181 | 43885 |
| TTCN_605 | 29784 | CTCN_5698 | 43843 | ATCN_440 | 29827 | CTCN_5716 | 43886 |
| GTCN_469 | 29785 | CTCN_5699 | 43844 | CTCN_837 | 29828 | TTCN_4549 | 43887 |
| TTCN_606 | 29786 | GTCN_2972 | 43845 | TTCN_621 | 29829 | GTCN_2984 | 43888 |
| TTCN_607 | 29787 | CTCN_5700 | 43846 | TTCN_622 | 29830 | CTCN_5717 | 43889 |
| CTCN_823 | 29788 | CTCN_5701 | 43847 | ATCN_441 | 29831 | TTCN_4550 | 43890 |
| CTCN_824 | 29789 | TTCN_4540 | 43848 | ATCN_442 | 29832 | TTCN_4551 | 43891 |
| TTCN_608 | 29790 | GTCN_2973 | 43849 | GTCN_474 | 29833 | ATCN_3182 | 43892 |
| CTCN_825 | 29791 | GTCN_2974 | 43850 | CTCN_838 | 29834 | TTCN_4552 | 43893 |
| CTCN_826 | 29792 | GTCN_2975 | 43851 | CTCN_839 | 29835 | CTCN_5718 | 43894 |
| TTCN_609 | 29793 | CTCN_5702 | 43852 | TTCN_623 | 29836 | CTCN_5719 | 43895 |
| ATCN_432 | 29794 | TTCN_4541 | 43853 | ATCN_443 | 29837 | CTCN_5720 | 43896 |
| TTCN_610 | 29795 | GTCN_2976 | 43854 | ATCN_444 | 29838 | CTCN_5721 | 43897 |
| CTCN_827 | 29796 | TTCN_4542 | 43855 | CTCN_840 | 29839 | ATCN_3183 | 43898 |
| CTCN_828 | 29797 | TTCN_4543 | 43856 | TTCN_624 | 29840 | ATCN_3184 | 43899 |
| CTCN_829 | 29798 | CTCN_5703 | 43857 | TTCN_625 | 29841 | TTCN_4553 | 43900 |
| ATCN_433 | 29799 | CTCN_5704 | 43858 | TTCN_626 | 29842 | CTCN_5722 | 43901 |
| ATCN_434 | 29800 | ATCN_3178 | 43859 | GTCN_475 | 29843 | GTCN_2985 | 43902 |
| CTCN_830 | 29801 | ATCN_3179 | 43860 | CTCN_841 | 29844 | TTCN_4554 | 43903 |
| TTCN_611 | 29802 | CTCN_5705 | 43861 | TTCN_627 | 29845 | GTCN_2986 | 43904 |
| GTCN_470 | 29803 | CTCN_5706 | 43862 | TTCN_628 | 29846 | ATCN_3185 | 43905 |
| GTCN_471 | 29804 | GTCN_2977 | 43863 | TTCN_629 | 29847 | ATCN_3186 | 43906 |
| CTCN_831 | 29805 | GTCN_2978 | 43864 | TTCN_630 | 29848 | TTCN_4555 | 43907 |
| CTCN_832 | 29806 | GTCN_2979 | 43865 | GTCN_476 | 29849 | GTCN_2987 | 43908 |
| TTCN_612 | 29807 | GTCN_2980 | 43866 | ATCN_445 | 29850 | CTCN_5723 | 43909 |
| TTCN_613 | 29808 | ATCN_3180 | 43867 | CTCN_842 | 29851 | TTCN_4556 | 43910 |
| CTCN_833 | 29809 | CTCN_5707 | 43868 | GTCN_477 | 29852 | ATCN_3187 | 43911 |
| ATCN_435 | 29810 | GTCN_2981 | 43869 | GTCN_478 | 29853 | GTCN_2988 | 43912 |
| ATCN_436 | 29811 | TTCN_4544 | 43870 | CTCN_843 | 29854 | ATCN_3188 | 43913 |
| GTCN_472 | 29812 | CTCN_5708 | 43871 | ATCN_446 | 29855 | ATCN_3189 | 43914 |
| TTCN_614 | 29813 | CTCN_5709 | 43872 | TTCN_631 | 29856 | ATCN_3190 | 43915 |
| GTCN_473 | 29814 | GTCN_2982 | 43873 | CTCN_844 | 29857 | CTCN_5724 | 43916 |
| TTCN_615 | 29815 | CTCN_5710 | 43874 | TTCN_632 | 29858 | GTCN_2989 | 43917 |

FIG. 37 (continued)

| | | | |
|---|---|---|---|
| GTCN_479 | 29859 | CTCN_5725 | 43918 |
| TTCN_633 | 29860 | CTCN_5726 | 43919 |
| ATCN_447 | 29861 | CTCN_5727 | 43920 |
| GTCN_480 | 29862 | GTCN_2990 | 43921 |
| TTCN_634 | 29863 | CTCN_5728 | 43922 |
| ATCN_448 | 29864 | CTCN_5729 | 43923 |
| ATCN_449 | 29865 | ATCN_3191 | 43924 |
| ATCN_450 | 29866 | CTCN_5730 | 43925 |
| ATCN_451 | 29867 | TTCN_4557 | 43926 |
| TTCN_635 | 29868 | TTCN_4558 | 43927 |
| TTCN_636 | 29869 | GTCN_2991 | 43928 |
| CTCN_845 | 29870 | CTCN_5731 | 43929 |
| TTCN_637 | 29871 | GTCN_2992 | 43930 |
| TTCN_638 | 29872 | CTCN_5732 | 43931 |
| ATCN_452 | 29873 | GTCN_2993 | 43932 |
| GTCN_481 | 29874 | CTCN_5733 | 43933 |
| CTCN_846 | 29875 | TTCN_4559 | 43934 |
| GTCN_482 | 29876 | TTCN_4560 | 43935 |
| CTCN_847 | 29877 | GTCN_2994 | 43936 |
| ATCN_453 | 29878 | CTCN_5734 | 43937 |
| GTCN_483 | 29879 | TTCN_4561 | 43938 |
| CTCN_848 | 29880 | TTCN_4562 | 43939 |
| TTCN_639 | 29881 | TTCN_4563 | 43940 |
| ATCN_454 | 29882 | CTCN_5735 | 43941 |
| CTCN_849 | 29883 | CTCN_5736 | 43942 |
| GTCN_484 | 29884 | GTCN_2995 | 43943 |
| ATCN_455 | 29885 | TTCN_4564 | 43944 |
| CTCN_850 | 29886 | ATCN_3192 | 43945 |
| CTCN_851 | 29887 | GTCN_2996 | 43946 |
| ATCN_456 | 29888 | CTCN_5737 | 43947 |
| ATCN_457 | 29889 | CTCN_5738 | 43948 |
| TTCN_640 | 29890 | TTCN_4565 | 43949 |
| GTCN_485 | 29891 | CTCN_5739 | 43950 |
| CTCN_852 | 29892 | CTCN_5740 | 43951 |
| TTCN_641 | 29893 | TTCN_4566 | 43952 |
| CTCN_853 | 29894 | CTCN_5741 | 43953 |
| CTCN_854 | 29895 | CTCN_5742 | 43954 |
| GTCN_486 | 29896 | ATCN_3193 | 43955 |
| TTCN_642 | 29897 | TTCN_4567 | 43956 |
| TTCN_643 | 29898 | TTCN_4568 | 43957 |
| TTCN_644 | 29899 | CTCN_5743 | 43958 |
| ATCN_458 | 29900 | CTCN_5744 | 43959 |
| TTCN_645 | 29901 | CTCN_5745 | 43960 |

| | | | |
|---|---|---|---|
| TTCN_646 | 29902 | CTCN_5746 | 43961 |
| TTCN_647 | 29903 | ATCN_3194 | 43962 |
| CTCN_855 | 29904 | TTCN_4569 | 43963 |
| CTCN_856 | 29905 | CTCN_5747 | 43964 |
| TTCN_648 | 29906 | CTCN_5748 | 43965 |
| TTCN_649 | 29907 | CTCN_5749 | 43966 |
| ATCN_459 | 29908 | CTCN_5750 | 43967 |
| TTCN_650 | 29909 | CTCN_5751 | 43968 |
| ATCN_460 | 29910 | GTCN_2997 | 43969 |
| ATCN_461 | 29911 | CTCN_5752 | 43970 |
| ATCN_462 | 29912 | CTCN_5753 | 43971 |
| CTCN_857 | 29913 | TTCN_4570 | 43972 |
| GTCN_487 | 29914 | ATCN_3195 | 43973 |
| TTCN_651 | 29915 | GTCN_2998 | 43974 |
| GTCN_488 | 29916 | ATCN_3196 | 43975 |
| TTCN_652 | 29917 | ATCN_3197 | 43976 |
| CTCN_858 | 29918 | ATCN_3198 | 43977 |
| CTCN_859 | 29919 | GTCN_2999 | 43978 |
| CTCN_860 | 29920 | ATCN_3199 | 43979 |
| ATCN_463 | 29921 | ATCN_3200 | 43980 |
| GTCN_489 | 29922 | TTCN_4571 | 43981 |
| ATCN_464 | 29923 | CTCN_5754 | 43982 |
| ATCN_465 | 29924 | TTCN_4572 | 43983 |
| GTCN_490 | 29925 | GTCN_3000 | 43984 |
| CTCN_861 | 29926 | CTCN_5755 | 43985 |
| ATCN_466 | 29927 | GTCN_3001 | 43986 |
| GTCN_491 | 29928 | CTCN_5756 | 43987 |
| CTCN_862 | 29929 | ATCN_3201 | 43988 |
| GTCN_492 | 29930 | GTCN_3002 | 43989 |
| TTCN_653 | 29931 | GTCN_3003 | 43990 |
| CTCN_863 | 29932 | CTCN_5757 | 43991 |
| CTCN_864 | 29933 | CTCN_5758 | 43992 |
| CTCN_865 | 29934 | CTCN_5759 | 43993 |
| TTCN_654 | 29935 | GTCN_3004 | 43994 |
| CTCN_866 | 29936 | ATCN_3202 | 43995 |
| TTCN_655 | 29937 | CTCN_5760 | 43996 |
| CTCN_867 | 29938 | GTCN_3005 | 43997 |
| GTCN_493 | 29939 | CTCN_5761 | 43998 |
| CTCN_868 | 29940 | CTCN_5762 | 43999 |
| TTCN_656 | 29941 | CTCN_5763 | 44000 |
| CTCN_869 | 29942 | GTCN_3006 | 44001 |
| TTCN_657 | 29943 | CTCN_5764 | 44002 |
| TTCN_658 | 29944 | GTCN_3007 | 44003 |

FIG. 37 (continued)

| | | | |
|---|---|---|---|
| CTCN_870 | 29945 | GTCN_3008 | 44004 |
| GTCN_494 | 29946 | CTCN_5765 | 44005 |
| TTCN_659 | 29947 | TTCN_4573 | 44006 |
| CTCN_871 | 29948 | GTCN_3009 | 44007 |
| CTCN_872 | 29949 | CTCN_5766 | 44008 |
| CTCN_873 | 29950 | CTCN_5767 | 44009 |
| CTCN_874 | 29951 | GTCN_3010 | 44010 |
| GTCN_495 | 29952 | ATCN_3203 | 44011 |
| GTCN_496 | 29953 | CTCN_5768 | 44012 |
| ATCN_467 | 29954 | CTCN_5769 | 44013 |
| ATCN_468 | 29955 | TTCN_4574 | 44014 |
| CTCN_875 | 29956 | ATCN_3204 | 44015 |
| GTCN_497 | 29957 | ATCN_3205 | 44016 |
| CTCN_876 | 29958 | GTCN_3011 | 44017 |
| CTCN_877 | 29959 | TTCN_4575 | 44018 |
| TTCN_660 | 29960 | TTCN_4576 | 44019 |
| ATCN_469 | 29961 | TTCN_4577 | 44020 |
| TTCN_661 | 29962 | CTCN_5770 | 44021 |
| CTCN_878 | 29963 | GTCN_3012 | 44022 |
| TTCN_662 | 29964 | GTCN_3013 | 44023 |
| ATCN_470 | 29965 | GTCN_3014 | 44024 |
| TTCN_663 | 29966 | CTCN_5771 | 44025 |
| ATCN_471 | 29967 | ATCN_3206 | 44026 |
| TTCN_664 | 29968 | ATCN_3207 | 44027 |
| GTCN_498 | 29969 | TTCN_4578 | 44028 |
| CTCN_879 | 29970 | CTCN_5772 | 44029 |
| CTCN_880 | 29971 | CTCN_5773 | 44030 |
| CTCN_881 | 29972 | ATCN_3208 | 44031 |
| CTCN_882 | 29973 | CTCN_5774 | 44032 |
| TTCN_665 | 29974 | GTCN_3015 | 44033 |
| TTCN_666 | 29975 | TTCN_4579 | 44034 |
| ATCN_472 | 29976 | CTCN_5775 | 44035 |
| CTCN_883 | 29977 | ATCN_3209 | 44036 |
| ATCN_473 | 29978 | GTCN_3016 | 44037 |
| ATCN_474 | 29979 | GTCN_3017 | 44038 |
| TTCN_667 | 29980 | TTCN_4580 | 44039 |
| ATCN_475 | 29981 | GTCN_3018 | 44040 |
| ATCN_476 | 29982 | CTCN_5776 | 44041 |
| GTCN_499 | 29983 | ATCN_3210 | 44042 |
| TTCN_668 | 29984 | ATCN_3211 | 44043 |
| GTCN_500 | 29985 | ATCN_3212 | 44044 |
| ATCN_477 | 29986 | CTCN_5777 | 44045 |
| TTCN_669 | 29987 | CTCN_5778 | 44046 |

| | | | |
|---|---|---|---|
| ATCN_478 | 29988 | GTCN_3019 | 44047 |
| CTCN_884 | 29989 | CTCN_5779 | 44048 |
| GTCN_501 | 29990 | TTCN_4581 | 44049 |
| GTCN_502 | 29991 | CTCN_5780 | 44050 |
| CTCN_885 | 29992 | CTCN_5781 | 44051 |
| TTCN_670 | 29993 | CTCN_5782 | 44052 |
| TTCN_671 | 29994 | CTCN_5783 | 44053 |
| CTCN_886 | 29995 | CTCN_5784 | 44054 |
| TTCN_672 | 29996 | CTCN_5785 | 44055 |
| CTCN_887 | 29997 | ATCN_3213 | 44056 |
| CTCN_888 | 29998 | ATCN_3214 | 44057 |
| ATCN_479 | 29999 | CTCN_5786 | 44058 |
| ATCN_480 | 30000 | GTCN_3020 | 44059 |
| GTCN_503 | 30001 | GTCN_3021 | 44060 |
| CTCN_889 | 30002 | TTCN_4582 | 44061 |
| GTCN_504 | 30003 | CTCN_5787 | 44062 |
| CTCN_890 | 30004 | CTCN_5788 | 44063 |
| GTCN_505 | 30005 | GTCN_3022 | 44064 |
| ATCN_481 | 30006 | CTCN_5789 | 44065 |
| ATCN_482 | 30007 | CTCN_5790 | 44066 |
| TTCN_673 | 30008 | CTCN_5791 | 44067 |
| GTCN_506 | 30009 | CTCN_5792 | 44068 |
| TTCN_674 | 30010 | CTCN_5793 | 44069 |
| TTCN_675 | 30011 | CTCN_5794 | 44070 |
| TTCN_676 | 30012 | CTCN_5795 | 44071 |
| ATCN_483 | 30013 | CTCN_5796 | 44072 |
| TTCN_677 | 30014 | CTCN_5797 | 44073 |
| CTCN_891 | 30015 | CTCN_5798 | 44074 |
| ATCN_484 | 30016 | ATCN_3215 | 44075 |
| ATCN_485 | 30017 | CTCN_5799 | 44076 |
| ATCN_486 | 30018 | TTCN_4583 | 44077 |
| TTCN_678 | 30019 | CTCN_5800 | 44078 |
| GTCN_507 | 30020 | CTCN_5801 | 44079 |
| TTCN_679 | 30021 | GTCN_3023 | 44080 |
| TTCN_680 | 30022 | CTCN_5802 | 44081 |
| CTCN_892 | 30023 | TTCN_4584 | 44082 |
| TTCN_681 | 30024 | TTCN_4585 | 44083 |
| TTCN_682 | 30025 | GTCN_3024 | 44084 |
| TTCN_683 | 30026 | CTCN_5803 | 44085 |
| TTCN_684 | 30027 | ATCN_3216 | 44086 |
| TTCN_685 | 30028 | ATCN_3217 | 44087 |
| ATCN_487 | 30029 | CTCN_5804 | 44088 |
| TTCN_686 | 30030 | ATCN_3218 | 44089 |

FIG. 37 (continued)

| | | | |
|---|---|---|---|
| ATCN_488 | 30031 | TTCN_4586 | 44090 |
| TTCN_687 | 30032 | TTCN_4587 | 44091 |
| ATCN_489 | 30033 | CTCN_5805 | 44092 |
| GTCN_508 | 30034 | ATCN_3219 | 44093 |
| GTCN_509 | 30035 | TTCN_4588 | 44094 |
| ATCN_490 | 30036 | CTCN_5806 | 44095 |
| CTCN_893 | 30037 | CTCN_5807 | 44096 |
| GTCN_510 | 30038 | GTCN_3025 | 44097 |
| ATCN_491 | 30039 | TTCN_4589 | 44098 |
| TTCN_688 | 30040 | TTCN_4590 | 44099 |
| TTCN_689 | 30041 | GTCN_3026 | 44100 |
| TTCN_690 | 30042 | TTCN_4591 | 44101 |
| TTCN_691 | 30043 | TTCN_4592 | 44102 |
| GTCN_511 | 30044 | CTCN_5808 | 44103 |
| TTCN_692 | 30045 | GTCN_3027 | 44104 |
| TTCN_693 | 30046 | CTCN_5809 | 44105 |
| TTCN_694 | 30047 | TTCN_4593 | 44106 |
| CTCN_894 | 30048 | CTCN_5810 | 44107 |
| CTCN_895 | 30049 | CTCN_5811 | 44108 |
| TTCN_695 | 30050 | GTCN_3028 | 44109 |
| CTCN_896 | 30051 | CTCN_5812 | 44110 |
| ATCN_492 | 30052 | GTCN_3029 | 44111 |
| ATCN_493 | 30053 | GTCN_3030 | 44112 |
| CTCN_897 | 30054 | TTCN_4594 | 44113 |
| TTCN_696 | 30055 | GTCN_3031 | 44114 |
| CTCN_898 | 30056 | TTCN_4595 | 44115 |
| ATCN_494 | 30057 | TTCN_4596 | 44116 |
| CTCN_899 | 30058 | CTCN_5813 | 44117 |
| GTCN_512 | 30059 | ATCN_3220 | 44118 |
| ATCN_495 | 30060 | ATCN_3221 | 44119 |
| ATCN_496 | 30061 | GTCN_3032 | 44120 |
| TTCN_697 | 30062 | TTCN_4597 | 44121 |
| ATCN_497 | 30063 | TTCN_4598 | 44122 |
| ATCN_498 | 30064 | CTCN_5814 | 44123 |
| TTCN_698 | 30065 | CTCN_5815 | 44124 |
| ATCN_499 | 30066 | TTCN_4599 | 44125 |
| CTCN_900 | 30067 | GTCN_3033 | 44126 |
| CTCN_901 | 30068 | TTCN_4600 | 44127 |
| ATCN_500 | 30069 | ATCN_3222 | 44128 |
| ATCN_501 | 30070 | CTCN_5816 | 44129 |
| CTCN_902 | 30071 | TTCN_4601 | 44130 |
| GTCN_513 | 30072 | TTCN_4602 | 44131 |
| ATCN_502 | 30073 | CTCN_5817 | 44132 |

| | | | |
|---|---|---|---|
| TTCN_699 | 30074 | ATCN_3223 | 44133 |
| ATCN_503 | 30075 | TTCN_4603 | 44134 |
| TTCN_700 | 30076 | CTCN_5818 | 44135 |
| CTCN_903 | 30077 | TTCN_4604 | 44136 |
| GTCN_514 | 30078 | ATCN_3224 | 44137 |
| CTCN_904 | 30079 | ATCN_3225 | 44138 |
| TTCN_701 | 30080 | TTCN_4605 | 44139 |
| TTCN_702 | 30081 | ATCN_3226 | 44140 |
| TTCN_703 | 30082 | TTCN_4606 | 44141 |
| TTCN_704 | 30083 | TTCN_4607 | 44142 |
| TTCN_705 | 30084 | ATCN_3227 | 44143 |
| TTCN_706 | 30085 | TTCN_4608 | 44144 |
| GTCN_515 | 30086 | TTCN_4609 | 44145 |
| CTCN_905 | 30087 | TTCN_4610 | 44146 |
| TTCN_707 | 30088 | CTCN_5819 | 44147 |
| CTCN_906 | 30089 | GTCN_3034 | 44148 |
| ATCN_504 | 30090 | CTCN_5820 | 44149 |
| CTCN_907 | 30091 | CTCN_5821 | 44150 |
| TTCN_708 | 30092 | TTCN_4611 | 44151 |
| TTCN_709 | 30093 | CTCN_5822 | 44152 |
| TTCN_710 | 30094 | GTCN_3035 | 44153 |
| TTCN_711 | 30095 | TTCN_4612 | 44154 |
| TTCN_712 | 30096 | TTCN_4613 | 44155 |
| ATCN_505 | 30097 | ATCN_3228 | 44156 |
| TTCN_713 | 30098 | ATCN_3229 | 44157 |
| TTCN_714 | 30099 | CTCN_5823 | 44158 |
| CTCN_908 | 30100 | CTCN_5824 | 44159 |
| ATCN_506 | 30101 | TTCN_4614 | 44160 |
| GTCN_516 | 30102 | TTCN_4615 | 44161 |
| GTCN_517 | 30103 | TTCN_4616 | 44162 |
| TTCN_715 | 30104 | ATCN_3230 | 44163 |
| TTCN_716 | 30105 | CTCN_5825 | 44164 |
| TTCN_717 | 30106 | CTCN_5826 | 44165 |
| CTCN_909 | 30107 | CTCN_5827 | 44166 |
| ATCN_507 | 30108 | ATCN_3231 | 44167 |
| CTCN_910 | 30109 | ATCN_3232 | 44168 |
| TTCN_718 | 30110 | CTCN_5828 | 44169 |
| TTCN_719 | 30111 | ATCN_3233 | 44170 |
| GTCN_518 | 30112 | TTCN_4617 | 44171 |
| CTCN_911 | 30113 | CTCN_5829 | 44172 |
| TTCN_720 | 30114 | ATCN_3234 | 44173 |
| TTCN_721 | 30115 | ATCN_3235 | 44174 |
| TTCN_722 | 30116 | TTCN_4618 | 44175 |

FIG. 37 (continued)

| | | | |
|---|---|---|---|
| TTCN_723 | 30117 | CTCN_5830 | 44176 |
| CTCN_912 | 30118 | TTCN_4619 | 44177 |
| TTCN_724 | 30119 | CTCN_5831 | 44178 |
| CTCN_913 | 30120 | ATCN_3236 | 44179 |
| TTCN_725 | 30121 | ATCN_3237 | 44180 |
| TTCN_726 | 30122 | TTCN_4620 | 44181 |
| TTCN_727 | 30123 | CTCN_5832 | 44182 |
| CTCN_914 | 30124 | GTCN_3036 | 44183 |
| GTCN_519 | 30125 | GTCN_3037 | 44184 |
| CTCN_915 | 30126 | CTCN_5833 | 44185 |
| CTCN_916 | 30127 | TTCN_4621 | 44186 |
| ATCN_508 | 30128 | GTCN_3038 | 44187 |
| TTCN_728 | 30129 | CTCN_5834 | 44188 |
| TTCN_729 | 30130 | CTCN_5835 | 44189 |
| CTCN_917 | 30131 | CTCN_5836 | 44190 |
| CTCN_918 | 30132 | ATCN_3238 | 44191 |
| TTCN_730 | 30133 | TTCN_4622 | 44192 |
| CTCN_919 | 30134 | CTCN_5837 | 44193 |
| ATCN_509 | 30135 | TTCN_4623 | 44194 |
| GTCN_520 | 30136 | TTCN_4624 | 44195 |
| CTCN_920 | 30137 | CTCN_5838 | 44196 |
| CTCN_921 | 30138 | TTCN_4625 | 44197 |
| TTCN_731 | 30139 | CTCN_5839 | 44198 |
| CTCN_922 | 30140 | CTCN_5840 | 44199 |
| TTCN_732 | 30141 | TTCN_4626 | 44200 |
| CTCN_923 | 30142 | CTCN_5841 | 44201 |
| GTCN_521 | 30143 | TTCN_4627 | 44202 |
| GTCN_522 | 30144 | TTCN_4628 | 44203 |
| TTCN_733 | 30145 | CTCN_5842 | 44204 |
| ATCN_510 | 30146 | CTCN_5843 | 44205 |
| CTCN_924 | 30147 | GTCN_3039 | 44206 |
| CTCN_925 | 30148 | GTCN_3040 | 44207 |
| CTCN_926 | 30149 | ATCN_3239 | 44208 |
| TTCN_734 | 30150 | TTCN_4629 | 44209 |
| ATCN_511 | 30151 | GTCN_3041 | 44210 |
| CTCN_927 | 30152 | TTCN_4630 | 44211 |
| GTCN_523 | 30153 | TTCN_4631 | 44212 |
| TTCN_735 | 30154 | TTCN_4632 | 44213 |
| TTCN_736 | 30155 | ATCN_3240 | 44214 |
| TTCN_737 | 30156 | CTCN_5844 | 44215 |
| GTCN_524 | 30157 | TTCN_4633 | 44216 |
| CTCN_928 | 30158 | GTCN_3042 | 44217 |
| GTCN_525 | 30159 | TTCN_4634 | 44218 |

| | | | |
|---|---|---|---|
| TTCN_738 | 30160 | TTCN_4635 | 44219 |
| CTCN_929 | 30161 | ATCN_3241 | 44220 |
| GTCN_526 | 30162 | TTCN_4636 | 44221 |
| ATCN_512 | 30163 | ATCN_3242 | 44222 |
| GTCN_527 | 30164 | TTCN_4637 | 44223 |
| CTCN_930 | 30165 | CTCN_5845 | 44224 |
| CTCN_931 | 30166 | TTCN_4638 | 44225 |
| GTCN_528 | 30167 | TTCN_4639 | 44226 |
| TTCN_739 | 30168 | TTCN_4640 | 44227 |
| ATCN_513 | 30169 | TTCN_4641 | 44228 |
| GTCN_529 | 30170 | ATCN_3243 | 44229 |
| CTCN_932 | 30171 | TTCN_4642 | 44230 |
| CTCN_933 | 30172 | TTCN_4643 | 44231 |
| GTCN_530 | 30173 | GTCN_3043 | 44232 |
| CTCN_934 | 30174 | CTCN_5846 | 44233 |
| CTCN_935 | 30175 | TTCN_4644 | 44234 |
| ATCN_514 | 30176 | ATCN_3244 | 44235 |
| GTCN_531 | 30177 | CTCN_5847 | 44236 |
| TTCN_740 | 30178 | TTCN_4645 | 44237 |
| CTCN_936 | 30179 | TTCN_4646 | 44238 |
| CTCN_937 | 30180 | ATCN_3245 | 44239 |
| CTCN_938 | 30181 | TTCN_4647 | 44240 |
| CTCN_939 | 30182 | TTCN_4648 | 44241 |
| GTCN_532 | 30183 | TTCN_4649 | 44242 |
| GTCN_533 | 30184 | TTCN_4650 | 44243 |
| TTCN_741 | 30185 | GTCN_3044 | 44244 |
| TTCN_742 | 30186 | GTCN_3045 | 44245 |
| GTCN_534 | 30187 | ATCN_3246 | 44246 |
| CTCN_940 | 30188 | TTCN_4651 | 44247 |
| TTCN_743 | 30189 | TTCN_4652 | 44248 |
| ATCN_515 | 30190 | TTCN_4653 | 44249 |
| GTCN_535 | 30191 | ATCN_3247 | 44250 |
| TTCN_744 | 30192 | ATCN_3248 | 44251 |
| TTCN_745 | 30193 | GTCN_3046 | 44252 |
| TTCN_746 | 30194 | CTCN_5848 | 44253 |
| CTCN_941 | 30195 | CTCN_5849 | 44254 |
| TTCN_747 | 30196 | GTCN_3047 | 44255 |
| ATCN_516 | 30197 | CTCN_5850 | 44256 |
| TTCN_748 | 30198 | TTCN_4654 | 44257 |
| TTCN_749 | 30199 | ATCN_3249 | 44258 |
| ATCN_517 | 30200 | ATCN_3250 | 44259 |
| GTCN_536 | 30201 | TTCN_4655 | 44260 |
| TTCN_750 | 30202 | ATCN_3251 | 44261 |

FIG. 37 (continued)

| | | | |
|---|---|---|---|
| TTCN_751 | 30203 | TTCN_4656 | 44262 |
| ATCN_518 | 30204 | ATCN_3252 | 44263 |
| TTCN_752 | 30205 | TTCN_4657 | 44264 |
| ATCN_519 | 30206 | ATCN_3253 | 44265 |
| CTCN_942 | 30207 | ATCN_3254 | 44266 |
| TTCN_753 | 30208 | TTCN_4658 | 44267 |
| GTCN_537 | 30209 | TTCN_4659 | 44268 |
| ATCN_520 | 30210 | ATCN_3255 | 44269 |
| CTCN_943 | 30211 | GTCN_3048 | 44270 |
| GTCN_538 | 30212 | TTCN_4660 | 44271 |
| TTCN_754 | 30213 | GTCN_3049 | 44272 |
| CTCN_944 | 30214 | ATCN_3256 | 44273 |
| ATCN_521 | 30215 | ATCN_3257 | 44274 |
| CTCN_945 | 30216 | TTCN_4661 | 44275 |
| ATCN_522 | 30217 | CTCN_5851 | 44276 |
| ATCN_523 | 30218 | CTCN_5852 | 44277 |
| GTCN_539 | 30219 | GTCN_3050 | 44278 |
| TTCN_755 | 30220 | TTCN_4662 | 44279 |
| CTCN_946 | 30221 | TTCN_4663 | 44280 |
| CTCN_947 | 30222 | CTCN_5853 | 44281 |
| CTCN_948 | 30223 | ATCN_3258 | 44282 |
| CTCN_949 | 30224 | TTCN_4664 | 44283 |
| TTCN_756 | 30225 | GTCN_3051 | 44284 |
| ATCN_524 | 30226 | CTCN_5854 | 44285 |
| GTCN_540 | 30227 | CTCN_5855 | 44286 |
| CTCN_950 | 30228 | CTCN_5856 | 44287 |
| TTCN_757 | 30229 | CTCN_5857 | 44288 |
| ATCN_525 | 30230 | ATCN_3259 | 44289 |
| TTCN_758 | 30231 | ATCN_3260 | 44290 |
| ATCN_526 | 30232 | GTCN_3052 | 44291 |
| GTCN_541 | 30233 | TTCN_4665 | 44292 |
| CTCN_951 | 30234 | CTCN_5858 | 44293 |
| CTCN_952 | 30235 | GTCN_3053 | 44294 |
| GTCN_542 | 30236 | TTCN_4666 | 44295 |
| ATCN_527 | 30237 | TTCN_4667 | 44296 |
| CTCN_953 | 30238 | TTCN_4668 | 44297 |
| TTCN_759 | 30239 | GTCN_3054 | 44298 |
| CTCN_954 | 30240 | TTCN_4669 | 44299 |
| GTCN_543 | 30241 | TTCN_4670 | 44300 |
| CTCN_955 | 30242 | TTCN_4671 | 44301 |
| TTCN_760 | 30243 | GTCN_3055 | 44302 |
| GTCN_544 | 30244 | CTCN_5859 | 44303 |
| CTCN_956 | 30245 | TTCN_4672 | 44304 |

| | | | |
|---|---|---|---|
| GTCN_545 | 30246 | CTCN_5860 | 44305 |
| GTCN_546 | 30247 | TTCN_4673 | 44306 |
| ATCN_528 | 30248 | CTCN_5861 | 44307 |
| CTCN_957 | 30249 | CTCN_5862 | 44308 |
| ATCN_529 | 30250 | ATCN_3261 | 44309 |
| TTCN_761 | 30251 | CTCN_5863 | 44310 |
| ATCN_530 | 30252 | CTCN_5864 | 44311 |
| GTCN_547 | 30253 | GTCN_3056 | 44312 |
| GTCN_548 | 30254 | CTCN_5865 | 44313 |
| TTCN_762 | 30255 | GTCN_3057 | 44314 |
| ATCN_531 | 30256 | CTCN_5866 | 44315 |
| TTCN_763 | 30257 | GTCN_3058 | 44316 |
| ATCN_532 | 30258 | CTCN_5867 | 44317 |
| TTCN_764 | 30259 | CTCN_5868 | 44318 |
| ATCN_533 | 30260 | GTCN_3059 | 44319 |
| GTCN_549 | 30261 | GTCN_3060 | 44320 |
| TTCN_765 | 30262 | GTCN_3061 | 44321 |
| TTCN_766 | 30263 | CTCN_5869 | 44322 |
| TTCN_767 | 30264 | CTCN_5870 | 44323 |
| CTCN_958 | 30265 | GTCN_3062 | 44324 |
| TTCN_768 | 30266 | TTCN_4674 | 44325 |
| ATCN_534 | 30267 | ATCN_3262 | 44326 |
| CTCN_959 | 30268 | CTCN_5871 | 44327 |
| TTCN_769 | 30269 | GTCN_3063 | 44328 |
| TTCN_770 | 30270 | CTCN_5872 | 44329 |
| ATCN_535 | 30271 | CTCN_5873 | 44330 |
| CTCN_960 | 30272 | CTCN_5874 | 44331 |
| TTCN_771 | 30273 | CTCN_5875 | 44332 |
| TTCN_772 | 30274 | GTCN_3064 | 44333 |
| GTCN_550 | 30275 | GTCN_3065 | 44334 |
| TTCN_773 | 30276 | CTCN_5876 | 44335 |
| ATCN_536 | 30277 | CTCN_5877 | 44336 |
| TTCN_774 | 30278 | GTCN_3066 | 44337 |
| TTCN_775 | 30279 | CTCN_5878 | 44338 |
| ATCN_537 | 30280 | CTCN_5879 | 44339 |
| GTCN_551 | 30281 | CTCN_5880 | 44340 |
| TTCN_776 | 30282 | CTCN_5881 | 44341 |
| ATCN_538 | 30283 | TTCN_4675 | 44342 |
| CTCN_961 | 30284 | TTCN_4676 | 44343 |
| ATCN_539 | 30285 | CTCN_5882 | 44344 |
| GTCN_552 | 30286 | CTCN_5883 | 44345 |
| GTCN_553 | 30287 | CTCN_5884 | 44346 |
| TTCN_777 | 30288 | CTCN_5885 | 44347 |

FIG. 37 (continued)

| | | | |
|---|---|---|---|
| TTCN_778 | 30289 | GTCN_3067 | 44348 |
| ATCN_540 | 30290 | TTCN_4677 | 44349 |
| CTCN_962 | 30291 | TTCN_4678 | 44350 |
| CTCN_963 | 30292 | GTCN_3068 | 44351 |
| GTCN_554 | 30293 | GTCN_3069 | 44352 |
| TTCN_779 | 30294 | CTCN_5886 | 44353 |
| TTCN_780 | 30295 | GTCN_3070 | 44354 |
| GTCN_555 | 30296 | GTCN_3071 | 44355 |
| CTCN_964 | 30297 | GTCN_3072 | 44356 |
| GTCN_556 | 30298 | TTCN_4679 | 44357 |
| CTCN_965 | 30299 | CTCN_5887 | 44358 |
| GTCN_557 | 30300 | CTCN_5888 | 44359 |
| ATCN_541 | 30301 | GTCN_3073 | 44360 |
| ATCN_542 | 30302 | CTCN_5889 | 44361 |
| TTCN_781 | 30303 | ATCN_3263 | 44362 |
| ATCN_543 | 30304 | CTCN_5890 | 44363 |
| TTCN_782 | 30305 | CTCN_5891 | 44364 |
| TTCN_783 | 30306 | ATCN_3264 | 44365 |
| TTCN_784 | 30307 | ATCN_3265 | 44366 |
| GTCN_558 | 30308 | TTCN_4680 | 44367 |
| GTCN_559 | 30309 | GTCN_3074 | 44368 |
| TTCN_785 | 30310 | GTCN_3075 | 44369 |
| ATCN_544 | 30311 | TTCN_4681 | 44370 |
| TTCN_786 | 30312 | GTCN_3076 | 44371 |
| TTCN_787 | 30313 | GTCN_3077 | 44372 |
| CTCN_966 | 30314 | TTCN_4682 | 44373 |
| TTCN_788 | 30315 | TTCN_4683 | 44374 |
| ATCN_545 | 30316 | TTCN_4684 | 44375 |
| ATCN_546 | 30317 | CTCN_5892 | 44376 |
| ATCN_547 | 30318 | GTCN_3078 | 44377 |
| TTCN_789 | 30319 | GTCN_3079 | 44378 |
| TTCN_790 | 30320 | CTCN_5893 | 44379 |
| TTCN_791 | 30321 | GTCN_3080 | 44380 |
| ATCN_548 | 30322 | ATCN_3266 | 44381 |
| CTCN_967 | 30323 | ATCN_3267 | 44382 |
| CTCN_968 | 30324 | GTCN_3081 | 44383 |
| ATCN_549 | 30325 | TTCN_4685 | 44384 |
| TTCN_792 | 30326 | ATCN_3268 | 44385 |
| CTCN_969 | 30327 | ATCN_3269 | 44386 |
| CTCN_970 | 30328 | TTCN_4686 | 44387 |
| CTCN_971 | 30329 | CTCN_5894 | 44388 |
| TTCN_793 | 30330 | TTCN_4687 | 44389 |
| ATCN_550 | 30331 | CTCN_5895 | 44390 |

| | | | |
|---|---|---|---|
| TTCN_794 | 30332 | CTCN_5896 | 44391 |
| CTCN_972 | 30333 | GTCN_3082 | 44392 |
| TTCN_795 | 30334 | TTCN_4688 | 44393 |
| TTCN_796 | 30335 | CTCN_5897 | 44394 |
| CTCN_973 | 30336 | CTCN_5898 | 44395 |
| GTCN_560 | 30337 | ATCN_3270 | 44396 |
| TTCN_797 | 30338 | CTCN_5899 | 44397 |
| GTCN_561 | 30339 | TTCN_4689 | 44398 |
| TTCN_798 | 30340 | TTCN_4690 | 44399 |
| CTCN_974 | 30341 | CTCN_5900 | 44400 |
| CTCN_975 | 30342 | TTCN_4691 | 44401 |
| GTCN_562 | 30343 | CTCN_5901 | 44402 |
| CTCN_976 | 30344 | TTCN_4692 | 44403 |
| CTCN_977 | 30345 | ATCN_3271 | 44404 |
| ATCN_551 | 30346 | TTCN_4693 | 44405 |
| ATCN_552 | 30347 | CTCN_5902 | 44406 |
| GTCN_563 | 30348 | CTCN_5903 | 44407 |
| CTCN_978 | 30349 | GTCN_3083 | 44408 |
| GTCN_564 | 30350 | CTCN_5904 | 44409 |
| GTCN_565 | 30351 | GTCN_3084 | 44410 |
| ATCN_553 | 30352 | ATCN_3272 | 44411 |
| CTCN_979 | 30353 | ATCN_3273 | 44412 |
| GTCN_566 | 30354 | CTCN_5905 | 44413 |
| ATCN_554 | 30355 | ATCN_3274 | 44414 |
| ATCN_555 | 30356 | ATCN_3275 | 44415 |
| TTCN_799 | 30357 | TTCN_4694 | 44416 |
| CTCN_980 | 30358 | CTCN_5906 | 44417 |
| TTCN_800 | 30359 | GTCN_3085 | 44418 |
| CTCN_981 | 30360 | CTCN_5907 | 44419 |
| TTCN_801 | 30361 | CTCN_5908 | 44420 |
| ATCN_556 | 30362 | CTCN_5909 | 44421 |
| TTCN_802 | 30363 | TTCN_4695 | 44422 |
| TTCN_803 | 30364 | GTCN_3086 | 44423 |
| ATCN_557 | 30365 | CTCN_5910 | 44424 |
| TTCN_804 | 30366 | CTCN_5911 | 44425 |
| ATCN_558 | 30367 | CTCN_5912 | 44426 |
| TTCN_805 | 30368 | GTCN_3087 | 44427 |
| TTCN_806 | 30369 | ATCN_3276 | 44428 |
| TTCN_807 | 30370 | GTCN_3088 | 44429 |
| ATCN_559 | 30371 | GTCN_3089 | 44430 |
| TTCN_808 | 30372 | CTCN_5913 | 44431 |
| GTCN_567 | 30373 | TTCN_4696 | 44432 |
| TTCN_809 | 30374 | CTCN_5914 | 44433 |

FIG. 37 (continued)

| | | | |
|---|---|---|---|
| ATCN_560 | 30375 | TTCN_4697 | 44434 |
| ATCN_561 | 30376 | ATCN_3277 | 44435 |
| ATCN_562 | 30377 | TTCN_4698 | 44436 |
| TTCN_810 | 30378 | GTCN_3090 | 44437 |
| CTCN_982 | 30379 | TTCN_4699 | 44438 |
| TTCN_811 | 30380 | CTCN_5915 | 44439 |
| ATCN_563 | 30381 | CTCN_5916 | 44440 |
| GTCN_568 | 30382 | CTCN_5917 | 44441 |
| ATCN_564 | 30383 | CTCN_5918 | 44442 |
| CTCN_983 | 30384 | ATCN_3278 | 44443 |
| ATCN_565 | 30385 | TTCN_4700 | 44444 |
| TTCN_812 | 30386 | ATCN_3279 | 44445 |
| TTCN_813 | 30387 | ATCN_3280 | 44446 |
| GTCN_569 | 30388 | TTCN_4701 | 44447 |
| GTCN_570 | 30389 | TTCN_4702 | 44448 |
| TTCN_814 | 30390 | TTCN_4703 | 44449 |
| CTCN_984 | 30391 | GTCN_3091 | 44450 |
| CTCN_985 | 30392 | GTCN_3092 | 44451 |
| CTCN_986 | 30393 | ATCN_3281 | 44452 |
| ATCN_566 | 30394 | CTCN_5919 | 44453 |
| TTCN_815 | 30395 | CTCN_5920 | 44454 |
| GTCN_571 | 30396 | TTCN_4704 | 44455 |
| CTCN_987 | 30397 | GTCN_3093 | 44456 |
| ATCN_567 | 30398 | CTCN_5921 | 44457 |
| ATCN_568 | 30399 | ATCN_3282 | 44458 |
| ATCN_569 | 30400 | TTCN_4705 | 44459 |
| TTCN_816 | 30401 | ATCN_3283 | 44460 |
| CTCN_988 | 30402 | ATCN_3284 | 44461 |
| CTCN_989 | 30403 | ATCN_3285 | 44462 |
| CTCN_990 | 30404 | TTCN_4706 | 44463 |
| TTCN_817 | 30405 | CTCN_5922 | 44464 |
| GTCN_572 | 30406 | TTCN_4707 | 44465 |
| GTCN_573 | 30407 | CTCN_5923 | 44466 |
| ATCN_570 | 30408 | TTCN_4708 | 44467 |
| CTCN_991 | 30409 | CTCN_5924 | 44468 |
| ATCN_571 | 30410 | CTCN_5925 | 44469 |
| GTCN_574 | 30411 | CTCN_5926 | 44470 |
| CTCN_992 | 30412 | ATCN_3286 | 44471 |
| CTCN_993 | 30413 | TTCN_4709 | 44472 |
| CTCN_994 | 30414 | TTCN_4710 | 44473 |
| CTCN_995 | 30415 | GTCN_3094 | 44474 |
| ATCN_572 | 30416 | TTCN_4711 | 44475 |
| CTCN_996 | 30417 | TTCN_4712 | 44476 |

| | | | |
|---|---|---|---|
| TTCN_818 | 30418 | CTCN_5927 | 44477 |
| ATCN_573 | 30419 | GTCN_3095 | 44478 |
| CTCN_997 | 30420 | TTCN_4713 | 44479 |
| CTCN_998 | 30421 | TTCN_4714 | 44480 |
| CTCN_999 | 30422 | ATCN_3287 | 44481 |
| TTCN_819 | 30423 | GTCN_3096 | 44482 |
| CTCN_1000 | 30424 | CTCN_5928 | 44483 |
| CTCN_1001 | 30425 | CTCN_5929 | 44484 |
| GTCN_575 | 30426 | CTCN_5930 | 44485 |
| CTCN_1002 | 30427 | TTCN_4715 | 44486 |
| CTCN_1003 | 30428 | TTCN_4716 | 44487 |
| CTCN_1004 | 30429 | ATCN_3288 | 44488 |
| GTCN_576 | 30430 | TTCN_4717 | 44489 |
| CTCN_1005 | 30431 | CTCN_5931 | 44490 |
| CTCN_1006 | 30432 | CTCN_5932 | 44491 |
| TTCN_820 | 30433 | ATCN_3289 | 44492 |
| GTCN_577 | 30434 | TTCN_4718 | 44493 |
| TTCN_821 | 30435 | CTCN_5933 | 44494 |
| TTCN_822 | 30436 | GTCN_3097 | 44495 |
| TTCN_823 | 30437 | ATCN_3290 | 44496 |
| GTCN_578 | 30438 | CTCN_5934 | 44497 |
| TTCN_824 | 30439 | ATCN_3291 | 44498 |
| CTCN_1007 | 30440 | ATCN_3292 | 44499 |
| TTCN_825 | 30441 | TTCN_4719 | 44500 |
| TTCN_826 | 30442 | CTCN_5935 | 44501 |
| GTCN_579 | 30443 | ATCN_3293 | 44502 |
| CTCN_1008 | 30444 | ATCN_3294 | 44503 |
| GTCN_580 | 30445 | TTCN_4720 | 44504 |
| TTCN_827 | 30446 | TTCN_4721 | 44505 |
| GTCN_581 | 30447 | CTCN_5936 | 44506 |
| GTCN_582 | 30448 | TTCN_4722 | 44507 |
| CTCN_1009 | 30449 | ATCN_3295 | 44508 |
| CTCN_1010 | 30450 | TTCN_4723 | 44509 |
| CTCN_1011 | 30451 | CTCN_5937 | 44510 |
| CTCN_1012 | 30452 | CTCN_5938 | 44511 |
| CTCN_1013 | 30453 | GTCN_3098 | 44512 |
| CTCN_1014 | 30454 | ATCN_3296 | 44513 |
| GTCN_583 | 30455 | TTCN_4724 | 44514 |
| ATCN_574 | 30456 | GTCN_3099 | 44515 |
| ATCN_575 | 30457 | TTCN_4725 | 44516 |
| GTCN_584 | 30458 | TTCN_4726 | 44517 |
| CTCN_1015 | 30459 | TTCN_4727 | 44518 |
| CTCN_1016 | 30460 | CTCN_5939 | 44519 |

FIG. 37 (continued)

| | | | |
|---|---|---|---|
| ATCN_576 | 30461 | ATCN_3297 | 44520 |
| CTCN_1017 | 30462 | ATCN_3298 | 44521 |
| ATCN_577 | 30463 | CTCN_5940 | 44522 |
| GTCN_585 | 30464 | GTCN_3100 | 44523 |
| CTCN_1018 | 30465 | TTCN_4728 | 44524 |
| GTCN_586 | 30466 | CTCN_5941 | 44525 |
| GTCN_587 | 30467 | TTCN_4729 | 44526 |
| GTCN_588 | 30468 | ATCN_3299 | 44527 |
| CTCN_1019 | 30469 | ATCN_3300 | 44528 |
| CTCN_1020 | 30470 | TTCN_4730 | 44529 |
| GTCN_589 | 30471 | TTCN_4731 | 44530 |
| TTCN_828 | 30472 | CTCN_5942 | 44531 |
| GTCN_590 | 30473 | GTCN_3101 | 44532 |
| CTCN_1021 | 30474 | TTCN_4732 | 44533 |
| CTCN_1022 | 30475 | ATCN_3301 | 44534 |
| CTCN_1023 | 30476 | CTCN_5943 | 44535 |
| CTCN_1024 | 30477 | TTCN_4733 | 44536 |
| GTCN_591 | 30478 | ATCN_3302 | 44537 |
| CTCN_1025 | 30479 | GTCN_3102 | 44538 |
| ATCN_578 | 30480 | TTCN_4734 | 44539 |
| CTCN_1026 | 30481 | CTCN_5944 | 44540 |
| ATCN_579 | 30482 | GTCN_3103 | 44541 |
| ATCN_580 | 30483 | CTCN_5945 | 44542 |
| TTCN_829 | 30484 | TTCN_4735 | 44543 |
| TTCN_830 | 30485 | CTCN_5946 | 44544 |
| GTCN_592 | 30486 | GTCN_3104 | 44545 |
| CTCN_1027 | 30487 | TTCN_4736 | 44546 |
| TTCN_831 | 30488 | CTCN_5947 | 44547 |
| GTCN_593 | 30489 | CTCN_5948 | 44548 |
| CTCN_1028 | 30490 | GTCN_3105 | 44549 |
| TTCN_832 | 30491 | TTCN_4737 | 44550 |
| TTCN_833 | 30492 | CTCN_5949 | 44551 |
| CTCN_1029 | 30493 | CTCN_5950 | 44552 |
| TTCN_834 | 30494 | CTCN_5951 | 44553 |
| CTCN_1030 | 30495 | TTCN_4738 | 44554 |
| CTCN_1031 | 30496 | CTCN_5952 | 44555 |
| ATCN_581 | 30497 | CTCN_5953 | 44556 |
| CTCN_1032 | 30498 | CTCN_5954 | 44557 |
| TTCN_835 | 30499 | CTCN_5955 | 44558 |
| CTCN_1033 | 30500 | CTCN_5956 | 44559 |
| GTCN_594 | 30501 | TTCN_4739 | 44560 |
| CTCN_1034 | 30502 | GTCN_3106 | 44561 |
| ATCN_582 | 30503 | CTCN_5957 | 44562 |

| | | | |
|---|---|---|---|
| ATCN_583 | 30504 | TTCN_4740 | 44563 |
| CTCN_1035 | 30505 | CTCN_5958 | 44564 |
| CTCN_1036 | 30506 | GTCN_3107 | 44565 |
| CTCN_1037 | 30507 | GTCN_3108 | 44566 |
| TTCN_836 | 30508 | CTCN_5959 | 44567 |
| TTCN_837 | 30509 | ATCN_3303 | 44568 |
| CTCN_1038 | 30510 | ATCN_3304 | 44569 |
| CTCN_1039 | 30511 | ATCN_3305 | 44570 |
| CTCN_1040 | 30512 | CTCN_5960 | 44571 |
| GTCN_595 | 30513 | TTCN_4741 | 44572 |
| ATCN_584 | 30514 | CTCN_5961 | 44573 |
| CTCN_1041 | 30515 | TTCN_4742 | 44574 |
| CTCN_1042 | 30516 | ATCN_3306 | 44575 |
| TTCN_838 | 30517 | TTCN_4743 | 44576 |
| GTCN_596 | 30518 | TTCN_4744 | 44577 |
| CTCN_1043 | 30519 | ATCN_3307 | 44578 |
| CTCN_1044 | 30520 | CTCN_5962 | 44579 |
| GTCN_597 | 30521 | CTCN_5963 | 44580 |
| ATCN_585 | 30522 | CTCN_5964 | 44581 |
| ATCN_586 | 30523 | CTCN_5965 | 44582 |
| CTCN_1045 | 30524 | CTCN_5966 | 44583 |
| CTCN_1046 | 30525 | CTCN_5967 | 44584 |
| ATCN_587 | 30526 | ATCN_3308 | 44585 |
| TTCN_839 | 30527 | CTCN_5968 | 44586 |
| CTCN_1047 | 30528 | CTCN_5969 | 44587 |
| ATCN_588 | 30529 | CTCN_5970 | 44588 |
| ATCN_589 | 30530 | ATCN_3309 | 44589 |
| TTCN_840 | 30531 | CTCN_5971 | 44590 |
| TTCN_841 | 30532 | TTCN_4745 | 44591 |
| ATCN_590 | 30533 | CTCN_5972 | 44592 |
| CTCN_1048 | 30534 | CTCN_5973 | 44593 |
| ATCN_591 | 30535 | CTCN_5974 | 44594 |
| ATCN_592 | 30536 | ATCN_3310 | 44595 |
| TTCN_842 | 30537 | TTCN_4746 | 44596 |
| GTCN_598 | 30538 | TTCN_4747 | 44597 |
| ATCN_593 | 30539 | GTCN_3109 | 44598 |
| GTCN_599 | 30540 | TTCN_4748 | 44599 |
| ATCN_594 | 30541 | GTCN_3110 | 44600 |
| CTCN_1049 | 30542 | CTCN_5975 | 44601 |
| CTCN_1050 | 30543 | GTCN_3111 | 44602 |
| ATCN_595 | 30544 | CTCN_5976 | 44603 |
| GTCN_600 | 30545 | TTCN_4749 | 44604 |
| CTCN_1051 | 30546 | TTCN_4750 | 44605 |

FIG. 37 (continued)

| | | | |
|---|---|---|---|
| TTCN_843 | 30547 | TTCN_4751 | 44606 |
| ATCN_596 | 30548 | TTCN_4752 | 44607 |
| CTCN_1052 | 30549 | TTCN_4753 | 44608 |
| TTCN_844 | 30550 | TTCN_4754 | 44609 |
| GTCN_601 | 30551 | GTCN_3112 | 44610 |
| CTCN_1053 | 30552 | GTCN_3113 | 44611 |
| ATCN_597 | 30553 | TTCN_4755 | 44612 |
| TTCN_845 | 30554 | CTCN_5977 | 44613 |
| ATCN_598 | 30555 | ATCN_3311 | 44614 |
| CTCN_1054 | 30556 | GTCN_3114 | 44615 |
| TTCN_846 | 30557 | CTCN_5978 | 44616 |
| ATCN_599 | 30558 | CTCN_5979 | 44617 |
| GTCN_602 | 30559 | CTCN_5980 | 44618 |
| CTCN_1055 | 30560 | GTCN_3115 | 44619 |
| TTCN_847 | 30561 | TTCN_4756 | 44620 |
| GTCN_603 | 30562 | TTCN_4757 | 44621 |
| GTCN_604 | 30563 | TTCN_4758 | 44622 |
| CTCN_1056 | 30564 | GTCN_3116 | 44623 |
| ATCN_600 | 30565 | CTCN_5981 | 44624 |
| TTCN_848 | 30566 | TTCN_4759 | 44625 |
| TTCN_849 | 30567 | GTCN_3117 | 44626 |
| TTCN_850 | 30568 | CTCN_5982 | 44627 |
| TTCN_851 | 30569 | GTCN_3118 | 44628 |
| TTCN_852 | 30570 | CTCN_5983 | 44629 |
| TTCN_853 | 30571 | ATCN_3312 | 44630 |
| TTCN_854 | 30572 | ATCN_3313 | 44631 |
| TTCN_855 | 30573 | TTCN_4760 | 44632 |
| TTCN_856 | 30574 | GTCN_3119 | 44633 |
| CTCN_1057 | 30575 | CTCN_5984 | 44634 |
| TTCN_857 | 30576 | TTCN_4761 | 44635 |
| TTCN_858 | 30577 | ATCN_3314 | 44636 |
| TTCN_859 | 30578 | TTCN_4762 | 44637 |
| TTCN_860 | 30579 | TTCN_4763 | 44638 |
| TTCN_861 | 30580 | ATCN_3315 | 44639 |
| TTCN_862 | 30581 | ATCN_3316 | 44640 |
| CTCN_1058 | 30582 | GTCN_3120 | 44641 |
| ATCN_601 | 30583 | ATCN_3317 | 44642 |
| CTCN_1059 | 30584 | ATCN_3318 | 44643 |
| GTCN_605 | 30585 | TTCN_4764 | 44644 |
| ATCN_602 | 30586 | TTCN_4765 | 44645 |
| ATCN_603 | 30587 | TTCN_4766 | 44646 |
| CTCN_1060 | 30588 | ATCN_3319 | 44647 |
| CTCN_1061 | 30589 | ATCN_3320 | 44648 |

| | | | |
|---|---|---|---|
| CTCN_1062 | 30590 | ATCN_3321 | 44649 |
| CTCN_1063 | 30591 | ATCN_3322 | 44650 |
| TTCN_863 | 30592 | TTCN_4767 | 44651 |
| ATCN_604 | 30593 | CTCN_5985 | 44652 |
| TTCN_864 | 30594 | ATCN_3323 | 44653 |
| CTCN_1064 | 30595 | TTCN_4768 | 44654 |
| GTCN_606 | 30596 | ATCN_3324 | 44655 |
| TTCN_865 | 30597 | ATCN_3325 | 44656 |
| CTCN_1065 | 30598 | GTCN_3121 | 44657 |
| GTCN_607 | 30599 | TTCN_4769 | 44658 |
| TTCN_866 | 30600 | CTCN_5986 | 44659 |
| GTCN_608 | 30601 | CTCN_5987 | 44660 |
| CTCN_1066 | 30602 | CTCN_5988 | 44661 |
| TTCN_867 | 30603 | ATCN_3326 | 44662 |
| CTCN_1067 | 30604 | GTCN_3122 | 44663 |
| GTCN_609 | 30605 | TTCN_4770 | 44664 |
| CTCN_1068 | 30606 | CTCN_5989 | 44665 |
| ATCN_605 | 30607 | TTCN_4771 | 44666 |
| ATCN_606 | 30608 | CTCN_5990 | 44667 |
| TTCN_868 | 30609 | CTCN_5991 | 44668 |
| CTCN_1069 | 30610 | CTCN_5992 | 44669 |
| TTCN_869 | 30611 | GTCN_3123 | 44670 |
| CTCN_1070 | 30612 | CTCN_5993 | 44671 |
| ATCN_607 | 30613 | GTCN_3124 | 44672 |
| CTCN_1071 | 30614 | ATCN_3327 | 44673 |
| ATCN_608 | 30615 | CTCN_5994 | 44674 |
| ATCN_609 | 30616 | ATCN_3328 | 44675 |
| TTCN_870 | 30617 | ATCN_3329 | 44676 |
| CTCN_1072 | 30618 | GTCN_3125 | 44677 |
| CTCN_1073 | 30619 | TTCN_4772 | 44678 |
| CTCN_1074 | 30620 | TTCN_4773 | 44679 |
| TTCN_871 | 30621 | CTCN_5995 | 44680 |
| ATCN_610 | 30622 | TTCN_4774 | 44681 |
| CTCN_1075 | 30623 | CTCN_5996 | 44682 |
| GTCN_610 | 30624 | CTCN_5997 | 44683 |
| TTCN_872 | 30625 | GTCN_3126 | 44684 |
| ATCN_611 | 30626 | TTCN_4775 | 44685 |
| ATCN_612 | 30627 | CTCN_5998 | 44686 |
| TTCN_873 | 30628 | TTCN_4776 | 44687 |
| TTCN_874 | 30629 | TTCN_4777 | 44688 |
| CTCN_1076 | 30630 | TTCN_4778 | 44689 |
| CTCN_1077 | 30631 | CTCN_5999 | 44690 |
| TTCN_875 | 30632 | CTCN_6000 | 44691 |

FIG. 37 (continued)

| | | | |
|---|---|---|---|
| TTCN_876 | 30633 | GTCN_3127 | 44692 |
| TTCN_877 | 30634 | GTCN_3128 | 44693 |
| CTCN_1078 | 30635 | GTCN_3129 | 44694 |
| CTCN_1079 | 30636 | ATCN_3330 | 44695 |
| CTCN_1080 | 30637 | TTCN_4779 | 44696 |
| TTCN_878 | 30638 | TTCN_4780 | 44697 |
| ATCN_613 | 30639 | TTCN_4781 | 44698 |
| CTCN_1081 | 30640 | ATCN_3331 | 44699 |
| TTCN_879 | 30641 | ATCN_3332 | 44700 |
| CTCN_1082 | 30642 | GTCN_3130 | 44701 |
| CTCN_1083 | 30643 | TTCN_4782 | 44702 |
| CTCN_1084 | 30644 | GTCN_3131 | 44703 |
| TTCN_880 | 30645 | GTCN_3132 | 44704 |
| TTCN_881 | 30646 | CTCN_6001 | 44705 |
| TTCN_882 | 30647 | TTCN_4783 | 44706 |
| TTCN_883 | 30648 | ATCN_3333 | 44707 |
| CTCN_1085 | 30649 | GTCN_3133 | 44708 |
| GTCN_611 | 30650 | TTCN_4784 | 44709 |
| TTCN_884 | 30651 | TTCN_4785 | 44710 |
| ATCN_614 | 30652 | GTCN_3134 | 44711 |
| GTCN_612 | 30653 | GTCN_3135 | 44712 |
| CTCN_1086 | 30654 | GTCN_3136 | 44713 |
| TTCN_885 | 30655 | GTCN_3137 | 44714 |
| CTCN_1087 | 30656 | GTCN_3138 | 44715 |
| GTCN_613 | 30657 | TTCN_4786 | 44716 |
| TTCN_886 | 30658 | CTCN_6002 | 44717 |
| TTCN_887 | 30659 | GTCN_3139 | 44718 |
| ATCN_615 | 30660 | CTCN_6003 | 44719 |
| GTCN_614 | 30661 | ATCN_3334 | 44720 |
| GTCN_615 | 30662 | CTCN_6004 | 44721 |
| GTCN_616 | 30663 | CTCN_6005 | 44722 |
| TTCN_888 | 30664 | TTCN_4787 | 44723 |
| CTCN_1088 | 30665 | ATCN_3335 | 44724 |
| CTCN_1089 | 30666 | TTCN_4788 | 44725 |
| TTCN_889 | 30667 | ATCN_3336 | 44726 |
| CTCN_1090 | 30668 | TTCN_4789 | 44727 |
| TTCN_890 | 30669 | CTCN_6006 | 44728 |
| ATCN_616 | 30670 | TTCN_4790 | 44729 |
| CTCN_1091 | 30671 | CTCN_6007 | 44730 |
| CTCN_1092 | 30672 | ATCN_3337 | 44731 |
| ATCN_617 | 30673 | CTCN_6008 | 44732 |
| CTCN_1093 | 30674 | GTCN_3140 | 44733 |
| CTCN_1094 | 30675 | CTCN_6009 | 44734 |

| | | | |
|---|---|---|---|
| GTCN_617 | 30676 | CTCN_6010 | 44735 |
| TTCN_891 | 30677 | ATCN_3338 | 44736 |
| ATCN_618 | 30678 | ATCN_3339 | 44737 |
| CTCN_1095 | 30679 | CTCN_6011 | 44738 |
| GTCN_618 | 30680 | CTCN_6012 | 44739 |
| GTCN_619 | 30681 | CTCN_6013 | 44740 |
| CTCN_1096 | 30682 | TTCN_4791 | 44741 |
| CTCN_1097 | 30683 | TTCN_4792 | 44742 |
| ATCN_619 | 30684 | CTCN_6014 | 44743 |
| ATCN_620 | 30685 | CTCN_6015 | 44744 |
| TTCN_892 | 30686 | CTCN_6016 | 44745 |
| TTCN_893 | 30687 | CTCN_6017 | 44746 |
| CTCN_1098 | 30688 | GTCN_3141 | 44747 |
| TTCN_894 | 30689 | CTCN_6018 | 44748 |
| TTCN_895 | 30690 | GTCN_3142 | 44749 |
| CTCN_1099 | 30691 | TTCN_4793 | 44750 |
| CTCN_1100 | 30692 | ATCN_3340 | 44751 |
| GTCN_620 | 30693 | GTCN_3143 | 44752 |
| CTCN_1101 | 30694 | CTCN_6019 | 44753 |
| GTCN_621 | 30695 | ATCN_3341 | 44754 |
| TTCN_896 | 30696 | ATCN_3342 | 44755 |
| TTCN_897 | 30697 | CTCN_6020 | 44756 |
| ATCN_621 | 30698 | GTCN_3144 | 44757 |
| CTCN_1102 | 30699 | ATCN_3343 | 44758 |
| CTCN_1103 | 30700 | ATCN_3344 | 44759 |
| CTCN_1104 | 30701 | CTCN_6021 | 44760 |
| CTCN_1105 | 30702 | GTCN_3145 | 44761 |
| TTCN_898 | 30703 | CTCN_6022 | 44762 |
| CTCN_1106 | 30704 | ATCN_3345 | 44763 |
| ATCN_622 | 30705 | CTCN_6023 | 44764 |
| CTCN_1107 | 30706 | GTCN_3146 | 44765 |
| GTCN_622 | 30707 | TTCN_4794 | 44766 |
| TTCN_899 | 30708 | CTCN_6024 | 44767 |
| ATCN_623 | 30709 | ATCN_3346 | 44768 |
| CTCN_1108 | 30710 | TTCN_4795 | 44769 |
| ATCN_624 | 30711 | CTCN_6025 | 44770 |
| CTCN_1109 | 30712 | TTCN_4796 | 44771 |
| CTCN_1110 | 30713 | ATCN_3347 | 44772 |
| ATCN_625 | 30714 | CTCN_6026 | 44773 |
| ATCN_626 | 30715 | CTCN_6027 | 44774 |
| TTCN_900 | 30716 | TTCN_4797 | 44775 |
| GTCN_623 | 30717 | TTCN_4798 | 44776 |
| CTCN_1111 | 30718 | TTCN_4799 | 44777 |

FIG. 37 (continued)

| | | | |
|---|---|---|---|
| CTCN_1112 | 30719 | CTCN_6028 | 44778 |
| ATCN_627 | 30720 | TTCN_4800 | 44779 |
| ATCN_628 | 30721 | TTCN_4801 | 44780 |
| TTCN_901 | 30722 | TTCN_4802 | 44781 |
| ATCN_629 | 30723 | TTCN_4803 | 44782 |
| CTCN_1113 | 30724 | TTCN_4804 | 44783 |
| CTCN_1114 | 30725 | GTCN_3147 | 44784 |
| ATCN_630 | 30726 | CTCN_6029 | 44785 |
| CTCN_1115 | 30727 | GTCN_3148 | 44786 |
| CTCN_1116 | 30728 | TTCN_4805 | 44787 |
| CTCN_1117 | 30729 | CTCN_6030 | 44788 |
| CTCN_1118 | 30730 | ATCN_3348 | 44789 |
| CTCN_1119 | 30731 | CTCN_6031 | 44790 |
| TTCN_902 | 30732 | ATCN_3349 | 44791 |
| ATCN_631 | 30733 | TTCN_4806 | 44792 |
| TTCN_903 | 30734 | GTCN_3149 | 44793 |
| TTCN_904 | 30735 | CTCN_6032 | 44794 |
| CTCN_1120 | 30736 | GTCN_3150 | 44795 |
| CTCN_1121 | 30737 | ATCN_3350 | 44796 |
| ATCN_632 | 30738 | GTCN_3151 | 44797 |
| CTCN_1122 | 30739 | GTCN_3152 | 44798 |
| CTCN_1123 | 30740 | GTCN_3153 | 44799 |
| ATCN_633 | 30741 | GTCN_3154 | 44800 |
| TTCN_905 | 30742 | TTCN_4807 | 44801 |
| GTCN_624 | 30743 | CTCN_6033 | 44802 |
| CTCN_1124 | 30744 | ATCN_3351 | 44803 |
| TTCN_906 | 30745 | TTCN_4808 | 44804 |
| ATCN_634 | 30746 | ATCN_3352 | 44805 |
| ATCN_635 | 30747 | ATCN_3353 | 44806 |
| ATCN_636 | 30748 | TTCN_4809 | 44807 |
| CTCN_1125 | 30749 | ATCN_3354 | 44808 |
| CTCN_1126 | 30750 | ATCN_3355 | 44809 |
| TTCN_907 | 30751 | GTCN_3155 | 44810 |
| TTCN_908 | 30752 | GTCN_3156 | 44811 |
| CTCN_1127 | 30753 | TTCN_4810 | 44812 |
| CTCN_1128 | 30754 | GTCN_3157 | 44813 |
| ATCN_637 | 30755 | TTCN_4811 | 44814 |
| ATCN_638 | 30756 | TTCN_4812 | 44815 |
| CTCN_1129 | 30757 | GTCN_3158 | 44816 |
| CTCN_1130 | 30758 | GTCN_3159 | 44817 |
| CTCN_1131 | 30759 | ATCN_3356 | 44818 |
| TTCN_909 | 30760 | TTCN_4813 | 44819 |
| GTCN_625 | 30761 | GTCN_3160 | 44820 |

| | | | |
|---|---|---|---|
| TTCN_910 | 30762 | TTCN_4814 | 44821 |
| CTCN_1132 | 30763 | TTCN_4815 | 44822 |
| CTCN_1133 | 30764 | CTCN_6034 | 44823 |
| CTCN_1134 | 30765 | ATCN_3357 | 44824 |
| GTCN_626 | 30766 | TTCN_4816 | 44825 |
| TTCN_911 | 30767 | CTCN_6035 | 44826 |
| ATCN_639 | 30768 | GTCN_3161 | 44827 |
| CTCN_1135 | 30769 | TTCN_4817 | 44828 |
| GTCN_627 | 30770 | GTCN_3162 | 44829 |
| CTCN_1136 | 30771 | GTCN_3163 | 44830 |
| TTCN_912 | 30772 | TTCN_4818 | 44831 |
| ATCN_640 | 30773 | ATCN_3358 | 44832 |
| CTCN_1137 | 30774 | CTCN_6036 | 44833 |
| ATCN_641 | 30775 | GTCN_3164 | 44834 |
| ATCN_642 | 30776 | TTCN_4819 | 44835 |
| GTCN_628 | 30777 | ATCN_3359 | 44836 |
| TTCN_913 | 30778 | TTCN_4820 | 44837 |
| TTCN_914 | 30779 | TTCN_4821 | 44838 |
| TTCN_915 | 30780 | CTCN_6037 | 44839 |
| CTCN_1138 | 30781 | TTCN_4822 | 44840 |
| GTCN_629 | 30782 | GTCN_3165 | 44841 |
| CTCN_1139 | 30783 | TTCN_4823 | 44842 |
| CTCN_1140 | 30784 | ATCN_3360 | 44843 |
| GTCN_630 | 30785 | ATCN_3361 | 44844 |
| CTCN_1141 | 30786 | TTCN_4824 | 44845 |
| GTCN_631 | 30787 | CTCN_6038 | 44846 |
| ATCN_643 | 30788 | TTCN_4825 | 44847 |
| CTCN_1142 | 30789 | CTCN_6039 | 44848 |
| GTCN_632 | 30790 | CTCN_6040 | 44849 |
| ATCN_644 | 30791 | TTCN_4826 | 44850 |
| ATCN_645 | 30792 | TTCN_4827 | 44851 |
| TTCN_916 | 30793 | CTCN_6041 | 44852 |
| TTCN_917 | 30794 | TTCN_4828 | 44853 |
| ATCN_646 | 30795 | GTCN_3166 | 44854 |
| TTCN_918 | 30796 | TTCN_4829 | 44855 |
| GTCN_633 | 30797 | CTCN_6042 | 44856 |
| CTCN_1143 | 30798 | ATCN_3362 | 44857 |
| ATCN_647 | 30799 | CTCN_6043 | 44858 |
| ATCN_648 | 30800 | ATCN_3363 | 44859 |
| GTCN_634 | 30801 | GTCN_3167 | 44860 |
| CTCN_1144 | 30802 | GTCN_3168 | 44861 |
| ATCN_649 | 30803 | CTCN_6044 | 44862 |
| TTCN_919 | 30804 | TTCN_4830 | 44863 |

FIG. 37 (continued)

| | | | | | | | |
|---|---|---|---|---|---|---|---|
| TTCN_920 | 30805 | GTCN_3169 | 44864 | GTCN_645 | 30848 | GTCN_3175 | 44907 |
| GTCN_635 | 30806 | CTCN_6045 | 44865 | TTCN_930 | 30849 | GTCN_3176 | 44908 |
| TTCN_921 | 30807 | ATCN_3364 | 44866 | ATCN_654 | 30850 | TTCN_4844 | 44909 |
| TTCN_922 | 30808 | ATCN_3365 | 44867 | CTCN_1164 | 30851 | TTCN_4845 | 44910 |
| TTCN_923 | 30809 | ATCN_3366 | 44868 | CTCN_1165 | 30852 | TTCN_4846 | 44911 |
| TTCN_924 | 30810 | TTCN_4831 | 44869 | CTCN_1166 | 30853 | ATCN_3373 | 44912 |
| CTCN_1145 | 30811 | CTCN_6046 | 44870 | TTCN_931 | 30854 | CTCN_6060 | 44913 |
| CTCN_1146 | 30812 | CTCN_6047 | 44871 | ATCN_655 | 30855 | CTCN_6061 | 44914 |
| GTCN_636 | 30813 | TTCN_4832 | 44872 | ATCN_656 | 30856 | TTCN_4847 | 44915 |
| TTCN_925 | 30814 | TTCN_4833 | 44873 | GTCN_646 | 30857 | ATCN_3374 | 44916 |
| CTCN_1147 | 30815 | CTCN_6048 | 44874 | CTCN_1167 | 30858 | GTCN_3177 | 44917 |
| GTCN_637 | 30816 | CTCN_6049 | 44875 | ATCN_657 | 30859 | CTCN_6062 | 44918 |
| TTCN_926 | 30817 | ATCN_3367 | 44876 | ATCN_658 | 30860 | GTCN_3178 | 44919 |
| CTCN_1148 | 30818 | CTCN_6050 | 44877 | CTCN_1168 | 30861 | CTCN_6063 | 44920 |
| ATCN_650 | 30819 | CTCN_6051 | 44878 | TTCN_932 | 30862 | GTCN_3179 | 44921 |
| ATCN_651 | 30820 | TTCN_4834 | 44879 | GTCN_647 | 30863 | GTCN_3180 | 44922 |
| CTCN_1149 | 30821 | TTCN_4835 | 44880 | CTCN_1169 | 30864 | TTCN_4848 | 44923 |
| GTCN_638 | 30822 | CTCN_6052 | 44881 | GTCN_648 | 30865 | TTCN_4849 | 44924 |
| TTCN_927 | 30823 | CTCN_6053 | 44882 | ATCN_659 | 30866 | ATCN_3375 | 44925 |
| CTCN_1150 | 30824 | TTCN_4836 | 44883 | TTCN_933 | 30867 | TTCN_4850 | 44926 |
| GTCN_639 | 30825 | CTCN_6054 | 44884 | CTCN_1170 | 30868 | CTCN_6064 | 44927 |
| CTCN_1151 | 30826 | TTCN_4837 | 44885 | TTCN_934 | 30869 | TTCN_4851 | 44928 |
| GTCN_640 | 30827 | CTCN_6055 | 44886 | TTCN_935 | 30870 | CTCN_6065 | 44929 |
| GTCN_641 | 30828 | TTCN_4838 | 44887 | TTCN_936 | 30871 | TTCN_4852 | 44930 |
| CTCN_1152 | 30829 | ATCN_3368 | 44888 | ATCN_660 | 30872 | CTCN_6066 | 44931 |
| CTCN_1153 | 30830 | TTCN_4839 | 44889 | ATCN_661 | 30873 | TTCN_4853 | 44932 |
| CTCN_1154 | 30831 | CTCN_6056 | 44890 | CTCN_1171 | 30874 | CTCN_6067 | 44933 |
| CTCN_1155 | 30832 | TTCN_4840 | 44891 | CTCN_1172 | 30875 | TTCN_4854 | 44934 |
| CTCN_1156 | 30833 | ATCN_3369 | 44892 | CTCN_1173 | 30876 | CTCN_6068 | 44935 |
| CTCN_1157 | 30834 | ATCN_3370 | 44893 | GTCN_649 | 30877 | TTCN_4855 | 44936 |
| ATCN_652 | 30835 | GTCN_3170 | 44894 | CTCN_1174 | 30878 | TTCN_4856 | 44937 |
| ATCN_653 | 30836 | GTCN_3171 | 44895 | TTCN_937 | 30879 | CTCN_6069 | 44938 |
| CTCN_1158 | 30837 | CTCN_6057 | 44896 | TTCN_938 | 30880 | TTCN_4857 | 44939 |
| CTCN_1159 | 30838 | TTCN_4841 | 44897 | GTCN_650 | 30881 | CTCN_6070 | 44940 |
| CTCN_1160 | 30839 | GTCN_3172 | 44898 | CTCN_1175 | 30882 | GTCN_3181 | 44941 |
| GTCN_642 | 30840 | CTCN_6058 | 44899 | CTCN_1176 | 30883 | CTCN_6071 | 44942 |
| CTCN_1161 | 30841 | ATCN_3371 | 44900 | TTCN_939 | 30884 | CTCN_6072 | 44943 |
| GTCN_643 | 30842 | TTCN_4842 | 44901 | CTCN_1177 | 30885 | GTCN_3182 | 44944 |
| GTCN_644 | 30843 | ATCN_3372 | 44902 | ATCN_662 | 30886 | CTCN_6073 | 44945 |
| CTCN_1162 | 30844 | GTCN_3173 | 44903 | ATCN_663 | 30887 | CTCN_6074 | 44946 |
| TTCN_928 | 30845 | TTCN_4843 | 44904 | GTCN_651 | 30888 | GTCN_3183 | 44947 |
| TTCN_929 | 30846 | GTCN_3174 | 44905 | CTCN_1178 | 30889 | ATCN_3376 | 44948 |
| CTCN_1163 | 30847 | CTCN_6059 | 44906 | TTCN_940 | 30890 | TTCN_4858 | 44949 |

FIG. 37 (continued)

| | | | |
|---|---|---|---|
| CTCN_1179 | 30891 | TTCN_4859 | 44950 |
| GTCN_652 | 30892 | GTCN_3184 | 44951 |
| ATCN_664 | 30893 | CTCN_6075 | 44952 |
| TTCN_941 | 30894 | CTCN_6076 | 44953 |
| GTCN_653 | 30895 | TTCN_4860 | 44954 |
| CTCN_1180 | 30896 | CTCN_6077 | 44955 |
| ATCN_665 | 30897 | TTCN_4861 | 44956 |
| CTCN_1181 | 30898 | TTCN_4862 | 44957 |
| CTCN_1182 | 30899 | GTCN_3185 | 44958 |
| GTCN_654 | 30900 | TTCN_4863 | 44959 |
| CTCN_1183 | 30901 | TTCN_4864 | 44960 |
| TTCN_942 | 30902 | ATCN_3377 | 44961 |
| ATCN_666 | 30903 | ATCN_3378 | 44962 |
| TTCN_943 | 30904 | CTCN_6078 | 44963 |
| CTCN_1184 | 30905 | GTCN_3186 | 44964 |
| CTCN_1185 | 30906 | CTCN_6079 | 44965 |
| CTCN_1186 | 30907 | CTCN_6080 | 44966 |
| CTCN_1187 | 30908 | CTCN_6081 | 44967 |
| ATCN_667 | 30909 | CTCN_6082 | 44968 |
| ATCN_668 | 30910 | GTCN_3187 | 44969 |
| CTCN_1188 | 30911 | CTCN_6083 | 44970 |
| CTCN_1189 | 30912 | GTCN_3188 | 44971 |
| CTCN_1190 | 30913 | ATCN_3379 | 44972 |
| GTCN_655 | 30914 | ATCN_3380 | 44973 |
| CTCN_1191 | 30915 | CTCN_6084 | 44974 |
| GTCN_656 | 30916 | GTCN_3189 | 44975 |
| CTCN_1192 | 30917 | CTCN_6085 | 44976 |
| TTCN_944 | 30918 | CTCN_6086 | 44977 |
| CTCN_1193 | 30919 | CTCN_6087 | 44978 |
| GTCN_657 | 30920 | GTCN_3190 | 44979 |
| CTCN_1194 | 30921 | CTCN_6088 | 44980 |
| GTCN_658 | 30922 | TTCN_4865 | 44981 |
| ATCN_669 | 30923 | CTCN_6089 | 44982 |
| CTCN_1195 | 30924 | ATCN_3381 | 44983 |
| GTCN_659 | 30925 | ATCN_3382 | 44984 |
| CTCN_1196 | 30926 | CTCN_6090 | 44985 |
| TTCN_945 | 30927 | ATCN_3383 | 44986 |
| ATCN_670 | 30928 | TTCN_4866 | 44987 |
| TTCN_946 | 30929 | TTCN_4867 | 44988 |
| GTCN_660 | 30930 | TTCN_4868 | 44989 |
| GTCN_661 | 30931 | GTCN_3191 | 44990 |
| ATCN_671 | 30932 | TTCN_4869 | 44991 |
| GTCN_662 | 30933 | CTCN_6091 | 44992 |

| | | | |
|---|---|---|---|
| TTCN_947 | 30934 | GTCN_3192 | 44993 |
| GTCN_663 | 30935 | TTCN_4870 | 44994 |
| TTCN_948 | 30936 | CTCN_6092 | 44995 |
| CTCN_1197 | 30937 | TTCN_4871 | 44996 |
| GTCN_664 | 30938 | TTCN_4872 | 44997 |
| ATCN_672 | 30939 | TTCN_4873 | 44998 |
| CTCN_1198 | 30940 | GTCN_3193 | 44999 |
| CTCN_1199 | 30941 | TTCN_4874 | 45000 |
| CTCN_1200 | 30942 | CTCN_6093 | 45001 |
| GTCN_665 | 30943 | ATCN_3384 | 45002 |
| GTCN_666 | 30944 | CTCN_6094 | 45003 |
| TTCN_949 | 30945 | GTCN_3194 | 45004 |
| CTCN_1201 | 30946 | CTCN_6095 | 45005 |
| TTCN_950 | 30947 | TTCN_4875 | 45006 |
| GTCN_667 | 30948 | TTCN_4876 | 45007 |
| CTCN_1202 | 30949 | ATCN_3385 | 45008 |
| ATCN_673 | 30950 | CTCN_6096 | 45009 |
| ATCN_674 | 30951 | CTCN_6097 | 45010 |
| CTCN_1203 | 30952 | GTCN_3195 | 45011 |
| GTCN_668 | 30953 | CTCN_6098 | 45012 |
| CTCN_1204 | 30954 | TTCN_4877 | 45013 |
| GTCN_669 | 30955 | TTCN_4878 | 45014 |
| CTCN_1205 | 30956 | GTCN_3196 | 45015 |
| GTCN_670 | 30957 | ATCN_3386 | 45016 |
| CTCN_1206 | 30958 | GTCN_3197 | 45017 |
| ATCN_675 | 30959 | GTCN_3198 | 45018 |
| CTCN_1207 | 30960 | TTCN_4879 | 45019 |
| ATCN_676 | 30961 | ATCN_3387 | 45020 |
| ATCN_677 | 30962 | TTCN_4880 | 45021 |
| CTCN_1208 | 30963 | CTCN_6099 | 45022 |
| CTCN_1209 | 30964 | TTCN_4881 | 45023 |
| CTCN_1210 | 30965 | TTCN_4882 | 45024 |
| GTCN_671 | 30966 | ATCN_3388 | 45025 |
| CTCN_1211 | 30967 | TTCN_4883 | 45026 |
| ATCN_678 | 30968 | TTCN_4884 | 45027 |
| CTCN_1212 | 30969 | GTCN_3199 | 45028 |
| GTCN_672 | 30970 | ATCN_3389 | 45029 |
| CTCN_1213 | 30971 | ATCN_3390 | 45030 |
| GTCN_673 | 30972 | GTCN_3200 | 45031 |
| CTCN_1214 | 30973 | ATCN_3391 | 45032 |
| GTCN_674 | 30974 | TTCN_4885 | 45033 |
| CTCN_1215 | 30975 | CTCN_6100 | 45034 |
| ATCN_679 | 30976 | CTCN_6101 | 45035 |

FIG. 37 (continued)

| | | | |
|---|---|---|---|
| CTCN_1216 | 30977 | GTCN_3201 | 45036 |
| CTCN_1217 | 30978 | CTCN_6102 | 45037 |
| ATCN_680 | 30979 | TTCN_4886 | 45038 |
| CTCN_1218 | 30980 | TTCN_4887 | 45039 |
| CTCN_1219 | 30981 | GTCN_3202 | 45040 |
| TTCN_951 | 30982 | TTCN_4888 | 45041 |
| TTCN_952 | 30983 | TTCN_4889 | 45042 |
| CTCN_1220 | 30984 | CTCN_6103 | 45043 |
| CTCN_1221 | 30985 | GTCN_3203 | 45044 |
| CTCN_1222 | 30986 | GTCN_3204 | 45045 |
| ATCN_681 | 30987 | TTCN_4890 | 45046 |
| CTCN_1223 | 30988 | CTCN_6104 | 45047 |
| ATCN_682 | 30989 | TTCN_4891 | 45048 |
| TTCN_953 | 30990 | ATCN_3392 | 45049 |
| GTCN_675 | 30991 | CTCN_6105 | 45050 |
| TTCN_954 | 30992 | GTCN_3205 | 45051 |
| CTCN_1224 | 30993 | ATCN_3393 | 45052 |
| GTCN_676 | 30994 | ATCN_3394 | 45053 |
| CTCN_1225 | 30995 | ATCN_3395 | 45054 |
| ATCN_683 | 30996 | TTCN_4892 | 45055 |
| ATCN_684 | 30997 | TTCN_4893 | 45056 |
| CTCN_1226 | 30998 | TTCN_4894 | 45057 |
| GTCN_677 | 30999 | TTCN_4895 | 45058 |
| CTCN_1227 | 31000 | CTCN_6106 | 45059 |
| CTCN_1228 | 31001 | ATCN_3396 | 45060 |
| ATCN_685 | 31002 | CTCN_6107 | 45061 |
| ATCN_686 | 31003 | ATCN_3397 | 45062 |
| CTCN_1229 | 31004 | TTCN_4896 | 45063 |
| GTCN_678 | 31005 | CTCN_6108 | 45064 |
| ATCN_687 | 31006 | TTCN_4897 | 45065 |
| TTCN_955 | 31007 | TTCN_4898 | 45066 |
| CTCN_1230 | 31008 | CTCN_6109 | 45067 |
| CTCN_1231 | 31009 | GTCN_3206 | 45068 |
| TTCN_956 | 31010 | TTCN_4899 | 45069 |
| TTCN_957 | 31011 | TTCN_4900 | 45070 |
| GTCN_679 | 31012 | GTCN_3207 | 45071 |
| TTCN_958 | 31013 | ATCN_3398 | 45072 |
| GTCN_680 | 31014 | TTCN_4901 | 45073 |
| ATCN_688 | 31015 | CTCN_6110 | 45074 |
| CTCN_1232 | 31016 | GTCN_3208 | 45075 |
| GTCN_681 | 31017 | TTCN_4902 | 45076 |
| GTCN_682 | 31018 | GTCN_3209 | 45077 |
| CTCN_1233 | 31019 | CTCN_6111 | 45078 |

| | | | |
|---|---|---|---|
| TTCN_959 | 31020 | CTCN_6112 | 45079 |
| GTCN_683 | 31021 | TTCN_4903 | 45080 |
| TTCN_960 | 31022 | GTCN_3210 | 45081 |
| CTCN_1234 | 31023 | ATCN_3399 | 45082 |
| GTCN_684 | 31024 | CTCN_6113 | 45083 |
| CTCN_1235 | 31025 | GTCN_3211 | 45084 |
| GTCN_685 | 31026 | CTCN_6114 | 45085 |
| CTCN_1236 | 31027 | ATCN_3400 | 45086 |
| GTCN_686 | 31028 | CTCN_6115 | 45087 |
| TTCN_961 | 31029 | CTCN_6116 | 45088 |
| GTCN_687 | 31030 | GTCN_3212 | 45089 |
| GTCN_688 | 31031 | CTCN_6117 | 45090 |
| TTCN_962 | 31032 | GTCN_3213 | 45091 |
| CTCN_1237 | 31033 | TTCN_4904 | 45092 |
| ATCN_689 | 31034 | GTCN_3214 | 45093 |
| GTCN_689 | 31035 | CTCN_6118 | 45094 |
| GTCN_690 | 31036 | ATCN_3401 | 45095 |
| GTCN_691 | 31037 | TTCN_4905 | 45096 |
| ATCN_690 | 31038 | ATCN_3402 | 45097 |
| GTCN_692 | 31039 | TTCN_4906 | 45098 |
| CTCN_1238 | 31040 | CTCN_6119 | 45099 |
| CTCN_1239 | 31041 | TTCN_4907 | 45100 |
| CTCN_1240 | 31042 | ATCN_3403 | 45101 |
| CTCN_1241 | 31043 | TTCN_4908 | 45102 |
| GTCN_693 | 31044 | CTCN_6120 | 45103 |
| CTCN_1242 | 31045 | CTCN_6121 | 45104 |
| CTCN_1243 | 31046 | ATCN_3404 | 45105 |
| CTCN_1244 | 31047 | CTCN_6122 | 45106 |
| GTCN_694 | 31048 | TTCN_4909 | 45107 |
| GTCN_695 | 31049 | GTCN_3215 | 45108 |
| GTCN_696 | 31050 | TTCN_4910 | 45109 |
| CTCN_1245 | 31051 | TTCN_4911 | 45110 |
| GTCN_697 | 31052 | GTCN_3216 | 45111 |
| TTCN_963 | 31053 | TTCN_4912 | 45112 |
| GTCN_698 | 31054 | GTCN_3217 | 45113 |
| CTCN_1246 | 31055 | CTCN_6123 | 45114 |
| TTCN_964 | 31056 | TTCN_4913 | 45115 |
| GTCN_699 | 31057 | GTCN_3218 | 45116 |
| GTCN_700 | 31058 | TTCN_4914 | 45117 |
| TTCN_965 | 31059 | TTCN_4915 | 45118 |
| ATCN_691 | 31060 | ATCN_3405 | 45119 |
| ATCN_692 | 31061 | TTCN_4916 | 45120 |
| TTCN_966 | 31062 | GTCN_3219 | 45121 |

FIG. 37 (continued)

| | | | | | | | |
|---|---|---|---|---|---|---|---|
| TTCN_967 | 31063 | CTCN_6124 | 45122 | GTCN_709 | 31106 | ATCN_3415 | 45165 |
| CTCN_1247 | 31064 | CTCN_6125 | 45123 | TTCN_980 | 31107 | TTCN_4925 | 45166 |
| CTCN_1248 | 31065 | TTCN_4917 | 45124 | TTCN_981 | 31108 | ATCN_3416 | 45167 |
| ATCN_693 | 31066 | CTCN_6126 | 45125 | TTCN_982 | 31109 | TTCN_4926 | 45168 |
| CTCN_1249 | 31067 | CTCN_6127 | 45126 | ATCN_698 | 31110 | CTCN_6144 | 45169 |
| GTCN_701 | 31068 | ATCN_3406 | 45127 | ATCN_699 | 31111 | TTCN_4927 | 45170 |
| GTCN_702 | 31069 | GTCN_3220 | 45128 | CTCN_1264 | 31112 | TTCN_4928 | 45171 |
| CTCN_1250 | 31070 | GTCN_3221 | 45129 | TTCN_983 | 31113 | TTCN_4929 | 45172 |
| ATCN_694 | 31071 | ATCN_3407 | 45130 | CTCN_1265 | 31114 | GTCN_3226 | 45173 |
| TTCN_968 | 31072 | ATCN_3408 | 45131 | TTCN_984 | 31115 | TTCN_4930 | 45174 |
| TTCN_969 | 31073 | CTCN_6128 | 45132 | ATCN_700 | 31116 | ATCN_3417 | 45175 |
| TTCN_970 | 31074 | CTCN_6129 | 45133 | TTCN_985 | 31117 | GTCN_3227 | 45176 |
| CTCN_1251 | 31075 | TTCN_4918 | 45134 | CTCN_1266 | 31118 | CTCN_6145 | 45177 |
| TTCN_971 | 31076 | CTCN_6130 | 45135 | CTCN_1267 | 31119 | TTCN_4931 | 45178 |
| CTCN_1252 | 31077 | TTCN_4919 | 45136 | GTCN_710 | 31120 | GTCN_3228 | 45179 |
| TTCN_972 | 31078 | CTCN_6131 | 45137 | CTCN_1268 | 31121 | CTCN_6146 | 45180 |
| CTCN_1253 | 31079 | TTCN_4920 | 45138 | GTCN_711 | 31122 | ATCN_3418 | 45181 |
| GTCN_703 | 31080 | CTCN_6132 | 45139 | CTCN_1269 | 31123 | CTCN_6147 | 45182 |
| CTCN_1254 | 31081 | TTCN_4921 | 45140 | TTCN_986 | 31124 | CTCN_6148 | 45183 |
| TTCN_973 | 31082 | CTCN_6133 | 45141 | CTCN_1270 | 31125 | CTCN_6149 | 45184 |
| TTCN_974 | 31083 | ATCN_3409 | 45142 | TTCN_987 | 31126 | ATCN_3419 | 45185 |
| CTCN_1255 | 31084 | GTCN_3222 | 45143 | CTCN_1271 | 31127 | ATCN_3420 | 45186 |
| CTCN_1256 | 31085 | CTCN_6134 | 45144 | CTCN_1272 | 31128 | GTCN_3229 | 45187 |
| ATCN_695 | 31086 | CTCN_6135 | 45145 | TTCN_988 | 31129 | ATCN_3421 | 45188 |
| TTCN_975 | 31087 | CTCN_6136 | 45146 | ATCN_701 | 31130 | TTCN_4932 | 45189 |
| CTCN_1257 | 31088 | ATCN_3410 | 45147 | CTCN_1273 | 31131 | ATCN_3422 | 45190 |
| TTCN_976 | 31089 | CTCN_6137 | 45148 | GTCN_712 | 31132 | TTCN_4933 | 45191 |
| CTCN_1258 | 31090 | GTCN_3223 | 45149 | CTCN_1274 | 31133 | CTCN_6150 | 45192 |
| GTCN_704 | 31091 | ATCN_3411 | 45150 | TTCN_989 | 31134 | GTCN_3230 | 45193 |
| CTCN_1259 | 31092 | CTCN_6138 | 45151 | TTCN_990 | 31135 | CTCN_6151 | 45194 |
| TTCN_977 | 31093 | CTCN_6139 | 45152 | ATCN_702 | 31136 | GTCN_3231 | 45195 |
| TTCN_978 | 31094 | ATCN_3412 | 45153 | CTCN_1275 | 31137 | TTCN_4934 | 45196 |
| CTCN_1260 | 31095 | CTCN_6140 | 45154 | CTCN_1276 | 31138 | TTCN_4935 | 45197 |
| GTCN_705 | 31096 | TTCN_4922 | 45155 | GTCN_713 | 31139 | ATCN_3423 | 45198 |
| TTCN_979 | 31097 | CTCN_6141 | 45156 | ATCN_703 | 31140 | CTCN_6152 | 45199 |
| CTCN_1261 | 31098 | TTCN_4923 | 45157 | CTCN_1277 | 31141 | CTCN_6153 | 45200 |
| GTCN_706 | 31099 | GTCN_3224 | 45158 | GTCN_714 | 31142 | TTCN_4936 | 45201 |
| CTCN_1262 | 31100 | CTCN_6142 | 45159 | TTCN_991 | 31143 | GTCN_3232 | 45202 |
| CTCN_1263 | 31101 | CTCN_6143 | 45160 | GTCN_715 | 31144 | TTCN_4937 | 45203 |
| GTCN_707 | 31102 | GTCN_3225 | 45161 | CTCN_1278 | 31145 | ATCN_3424 | 45204 |
| ATCN_696 | 31103 | TTCN_4924 | 45162 | GTCN_716 | 31146 | CTCN_6154 | 45205 |
| ATCN_697 | 31104 | ATCN_3413 | 45163 | ATCN_704 | 31147 | TTCN_4938 | 45206 |
| GTCN_708 | 31105 | ATCN_3414 | 45164 | CTCN_1279 | 31148 | TTCN_4939 | 45207 |

FIG. 37 (continued)

| | | | |
|---|---|---|---|
| CTCN_1280 | 31149 | GTCN_3233 | 45208 |
| GTCN_717 | 31150 | TTCN_4940 | 45209 |
| GTCN_718 | 31151 | TTCN_4941 | 45210 |
| CTCN_1281 | 31152 | CTCN_6155 | 45211 |
| ATCN_705 | 31153 | ATCN_3425 | 45212 |
| TTCN_992 | 31154 | GTCN_3234 | 45213 |
| CTCN_1282 | 31155 | TTCN_4942 | 45214 |
| CTCN_1283 | 31156 | ATCN_3426 | 45215 |
| TTCN_993 | 31157 | GTCN_3235 | 45216 |
| TTCN_994 | 31158 | ATCN_3427 | 45217 |
| GTCN_719 | 31159 | CTCN_6156 | 45218 |
| ATCN_706 | 31160 | TTCN_4943 | 45219 |
| CTCN_1284 | 31161 | ATCN_3428 | 45220 |
| GTCN_720 | 31162 | TTCN_4944 | 45221 |
| CTCN_1285 | 31163 | CTCN_6157 | 45222 |
| GTCN_721 | 31164 | GTCN_3236 | 45223 |
| CTCN_1286 | 31165 | TTCN_4945 | 45224 |
| CTCN_1287 | 31166 | GTCN_3237 | 45225 |
| CTCN_1288 | 31167 | ATCN_3429 | 45226 |
| CTCN_1289 | 31168 | GTCN_3238 | 45227 |
| CTCN_1290 | 31169 | CTCN_6158 | 45228 |
| GTCN_722 | 31170 | TTCN_4946 | 45229 |
| ATCN_707 | 31171 | ATCN_3430 | 45230 |
| GTCN_723 | 31172 | TTCN_4947 | 45231 |
| ATCN_708 | 31173 | ATCN_3431 | 45232 |
| CTCN_1291 | 31174 | GTCN_3239 | 45233 |
| CTCN_1292 | 31175 | CTCN_6159 | 45234 |
| CTCN_1293 | 31176 | ATCN_3432 | 45235 |
| CTCN_1294 | 31177 | TTCN_4948 | 45236 |
| GTCN_724 | 31178 | GTCN_3240 | 45237 |
| CTCN_1295 | 31179 | CTCN_6160 | 45238 |
| TTCN_995 | 31180 | TTCN_4949 | 45239 |
| CTCN_1296 | 31181 | ATCN_3433 | 45240 |
| CTCN_1297 | 31182 | CTCN_6161 | 45241 |
| CTCN_1298 | 31183 | GTCN_3241 | 45242 |
| TTCN_996 | 31184 | ATCN_3434 | 45243 |
| CTCN_1299 | 31185 | CTCN_6162 | 45244 |
| GTCN_725 | 31186 | TTCN_4950 | 45245 |
| GTCN_726 | 31187 | CTCN_6163 | 45246 |
| GTCN_727 | 31188 | TTCN_4951 | 45247 |
| TTCN_997 | 31189 | GTCN_3242 | 45248 |
| GTCN_728 | 31190 | TTCN_4952 | 45249 |
| CTCN_1300 | 31191 | TTCN_4953 | 45250 |

| | | | |
|---|---|---|---|
| TTCN_998 | 31192 | CTCN_6164 | 45251 |
| CTCN_1301 | 31193 | TTCN_4954 | 45252 |
| GTCN_729 | 31194 | ATCN_3435 | 45253 |
| GTCN_730 | 31195 | TTCN_4955 | 45254 |
| CTCN_1302 | 31196 | CTCN_6165 | 45255 |
| GTCN_731 | 31197 | CTCN_6166 | 45256 |
| CTCN_1303 | 31198 | ATCN_3436 | 45257 |
| GTCN_732 | 31199 | TTCN_4956 | 45258 |
| ATCN_709 | 31200 | CTCN_6167 | 45259 |
| CTCN_1304 | 31201 | ATCN_3437 | 45260 |
| CTCN_1305 | 31202 | ATCN_3438 | 45261 |
| CTCN_1306 | 31203 | CTCN_6168 | 45262 |
| TTCN_999 | 31204 | GTCN_3243 | 45263 |
| ATCN_710 | 31205 | CTCN_6169 | 45264 |
| GTCN_733 | 31206 | TTCN_4957 | 45265 |
| CTCN_1307 | 31207 | GTCN_3244 | 45266 |
| GTCN_734 | 31208 | ATCN_3439 | 45267 |
| GTCN_735 | 31209 | CTCN_6170 | 45268 |
| TTCN_1000 | 31210 | CTCN_6171 | 45269 |
| CTCN_1308 | 31211 | TTCN_4958 | 45270 |
| CTCN_1309 | 31212 | ATCN_3440 | 45271 |
| CTCN_1310 | 31213 | CTCN_6172 | 45272 |
| ATCN_711 | 31214 | CTCN_6173 | 45273 |
| TTCN_1001 | 31215 | TTCN_4959 | 45274 |
| GTCN_736 | 31216 | ATCN_3441 | 45275 |
| CTCN_1311 | 31217 | TTCN_4960 | 45276 |
| CTCN_1312 | 31218 | CTCN_6174 | 45277 |
| TTCN_1002 | 31219 | CTCN_6175 | 45278 |
| CTCN_1313 | 31220 | CTCN_6176 | 45279 |
| TTCN_1003 | 31221 | ATCN_3442 | 45280 |
| TTCN_1004 | 31222 | ATCN_3443 | 45281 |
| TTCN_1005 | 31223 | CTCN_6177 | 45282 |
| CTCN_1314 | 31224 | ATCN_3444 | 45283 |
| TTCN_1006 | 31225 | GTCN_3245 | 45284 |
| ATCN_712 | 31226 | CTCN_6178 | 45285 |
| GTCN_737 | 31227 | GTCN_3246 | 45286 |
| TTCN_1007 | 31228 | CTCN_6179 | 45287 |
| CTCN_1315 | 31229 | ATCN_3445 | 45288 |
| TTCN_1008 | 31230 | CTCN_6180 | 45289 |
| GTCN_738 | 31231 | TTCN_4961 | 45290 |
| ATCN_713 | 31232 | GTCN_3247 | 45291 |
| GTCN_739 | 31233 | ATCN_3446 | 45292 |
| CTCN_1316 | 31234 | CTCN_6181 | 45293 |

FIG. 37 (continued)

| | | | |
|---|---|---|---|
| GTCN_740 | 31235 | CTCN_6182 | 45294 |
| CTCN_1317 | 31236 | TTCN_4962 | 45295 |
| TTCN_1009 | 31237 | ATCN_3447 | 45296 |
| TTCN_1010 | 31238 | TTCN_4963 | 45297 |
| GTCN_741 | 31239 | TTCN_4964 | 45298 |
| CTCN_1318 | 31240 | ATCN_3448 | 45299 |
| GTCN_742 | 31241 | ATCN_3449 | 45300 |
| CTCN_1319 | 31242 | ATCN_3450 | 45301 |
| TTCN_1011 | 31243 | TTCN_4965 | 45302 |
| GTCN_743 | 31244 | TTCN_4966 | 45303 |
| CTCN_1320 | 31245 | TTCN_4967 | 45304 |
| GTCN_744 | 31246 | CTCN_6183 | 45305 |
| GTCN_745 | 31247 | ATCN_3451 | 45306 |
| CTCN_1321 | 31248 | CTCN_6184 | 45307 |
| CTCN_1322 | 31249 | TTCN_4968 | 45308 |
| TTCN_1012 | 31250 | GTCN_3248 | 45309 |
| CTCN_1323 | 31251 | TTCN_4969 | 45310 |
| ATCN_714 | 31252 | GTCN_3249 | 45311 |
| ATCN_715 | 31253 | CTCN_6185 | 45312 |
| ATCN_716 | 31254 | TTCN_4970 | 45313 |
| TTCN_1013 | 31255 | CTCN_6186 | 45314 |
| TTCN_1014 | 31256 | CTCN_6187 | 45315 |
| TTCN_1015 | 31257 | CTCN_6188 | 45316 |
| CTCN_1324 | 31258 | GTCN_3250 | 45317 |
| ATCN_717 | 31259 | CTCN_6189 | 45318 |
| CTCN_1325 | 31260 | TTCN_4971 | 45319 |
| TTCN_1016 | 31261 | GTCN_3251 | 45320 |
| ATCN_718 | 31262 | TTCN_4972 | 45321 |
| ATCN_719 | 31263 | TTCN_4973 | 45322 |
| CTCN_1326 | 31264 | TTCN_4974 | 45323 |
| TTCN_1017 | 31265 | ATCN_3452 | 45324 |
| ATCN_720 | 31266 | GTCN_3252 | 45325 |
| GTCN_746 | 31267 | GTCN_3253 | 45326 |
| TTCN_1018 | 31268 | CTCN_6190 | 45327 |
| TTCN_1019 | 31269 | ATCN_3453 | 45328 |
| TTCN_1020 | 31270 | ATCN_3454 | 45329 |
| GTCN_747 | 31271 | ATCN_3455 | 45330 |
| GTCN_748 | 31272 | TTCN_4975 | 45331 |
| ATCN_721 | 31273 | GTCN_3254 | 45332 |
| TTCN_1021 | 31274 | CTCN_6191 | 45333 |
| CTCN_1327 | 31275 | TTCN_4976 | 45334 |
| CTCN_1328 | 31276 | ATCN_3456 | 45335 |
| ATCN_722 | 31277 | TTCN_4977 | 45336 |

| | | | |
|---|---|---|---|
| CTCN_1329 | 31278 | GTCN_3255 | 45337 |
| CTCN_1330 | 31279 | TTCN_4978 | 45338 |
| TTCN_1022 | 31280 | CTCN_6192 | 45339 |
| GTCN_749 | 31281 | CTCN_6193 | 45340 |
| CTCN_1331 | 31282 | ATCN_3457 | 45341 |
| CTCN_1332 | 31283 | GTCN_3256 | 45342 |
| TTCN_1023 | 31284 | TTCN_4979 | 45343 |
| CTCN_1333 | 31285 | TTCN_4980 | 45344 |
| CTCN_1334 | 31286 | TTCN_4981 | 45345 |
| ATCN_723 | 31287 | TTCN_4982 | 45346 |
| CTCN_1335 | 31288 | ATCN_3458 | 45347 |
| TTCN_1024 | 31289 | TTCN_4983 | 45348 |
| TTCN_1025 | 31290 | CTCN_6194 | 45349 |
| ATCN_724 | 31291 | ATCN_3459 | 45350 |
| CTCN_1336 | 31292 | TTCN_4984 | 45351 |
| GTCN_750 | 31293 | TTCN_4985 | 45352 |
| TTCN_1026 | 31294 | TTCN_4986 | 45353 |
| TTCN_1027 | 31295 | TTCN_4987 | 45354 |
| CTCN_1337 | 31296 | TTCN_4988 | 45355 |
| GTCN_751 | 31297 | TTCN_4989 | 45356 |
| TTCN_1028 | 31298 | GTCN_3257 | 45357 |
| CTCN_1338 | 31299 | ATCN_3460 | 45358 |
| ATCN_725 | 31300 | ATCN_3461 | 45359 |
| CTCN_1339 | 31301 | GTCN_3258 | 45360 |
| CTCN_1340 | 31302 | GTCN_3259 | 45361 |
| TTCN_1029 | 31303 | ATCN_3462 | 45362 |
| CTCN_1341 | 31304 | ATCN_3463 | 45363 |
| CTCN_1342 | 31305 | GTCN_3260 | 45364 |
| GTCN_752 | 31306 | ATCN_3464 | 45365 |
| CTCN_1343 | 31307 | ATCN_3465 | 45366 |
| GTCN_753 | 31308 | TTCN_4990 | 45367 |
| GTCN_754 | 31309 | CTCN_6195 | 45368 |
| GTCN_755 | 31310 | ATCN_3466 | 45369 |
| GTCN_756 | 31311 | TTCN_4991 | 45370 |
| GTCN_757 | 31312 | CTCN_6196 | 45371 |
| TTCN_1030 | 31313 | GTCN_3261 | 45372 |
| CTCN_1344 | 31314 | GTCN_3262 | 45373 |
| ATCN_726 | 31315 | ATCN_3467 | 45374 |
| CTCN_1345 | 31316 | GTCN_3263 | 45375 |
| GTCN_758 | 31317 | CTCN_6197 | 45376 |
| TTCN_1031 | 31318 | CTCN_6198 | 45377 |
| GTCN_759 | 31319 | TTCN_4992 | 45378 |
| ATCN_727 | 31320 | CTCN_6199 | 45379 |

FIG. 37 (continued)

| | | | |
|---|---|---|---|
| CTCN_1346 | 31321 | TTCN_4993 | 45380 |
| TTCN_1032 | 31322 | GTCN_3264 | 45381 |
| GTCN_760 | 31323 | ATCN_3468 | 45382 |
| TTCN_1033 | 31324 | TTCN_4994 | 45383 |
| CTCN_1347 | 31325 | TTCN_4995 | 45384 |
| GTCN_761 | 31326 | CTCN_6200 | 45385 |
| TTCN_1034 | 31327 | ATCN_3469 | 45386 |
| CTCN_1348 | 31328 | TTCN_4996 | 45387 |
| GTCN_762 | 31329 | ATCN_3470 | 45388 |
| CTCN_1349 | 31330 | TTCN_4997 | 45389 |
| TTCN_1035 | 31331 | ATCN_3471 | 45390 |
| GTCN_763 | 31332 | CTCN_6201 | 45391 |
| ATCN_728 | 31333 | GTCN_3265 | 45392 |
| ATCN_729 | 31334 | TTCN_4998 | 45393 |
| ATCN_730 | 31335 | TTCN_4999 | 45394 |
| TTCN_1036 | 31336 | CTCN_6202 | 45395 |
| CTCN_1350 | 31337 | TTCN_5000 | 45396 |
| CTCN_1351 | 31338 | TTCN_5001 | 45397 |
| GTCN_764 | 31339 | TTCN_5002 | 45398 |
| ATCN_731 | 31340 | CTCN_6203 | 45399 |
| CTCN_1352 | 31341 | ATCN_3472 | 45400 |
| GTCN_765 | 31342 | TTCN_5003 | 45401 |
| TTCN_1037 | 31343 | ATCN_3473 | 45402 |
| CTCN_1353 | 31344 | TTCN_5004 | 45403 |
| GTCN_766 | 31345 | ATCN_3474 | 45404 |
| CTCN_1354 | 31346 | TTCN_5005 | 45405 |
| GTCN_767 | 31347 | TTCN_5006 | 45406 |
| TTCN_1038 | 31348 | CTCN_6204 | 45407 |
| TTCN_1039 | 31349 | CTCN_6205 | 45408 |
| GTCN_768 | 31350 | ATCN_3475 | 45409 |
| GTCN_769 | 31351 | GTCN_3266 | 45410 |
| ATCN_732 | 31352 | TTCN_5007 | 45411 |
| ATCN_733 | 31353 | TTCN_5008 | 45412 |
| CTCN_1355 | 31354 | ATCN_3476 | 45413 |
| CTCN_1356 | 31355 | CTCN_6206 | 45414 |
| TTCN_1040 | 31356 | TTCN_5009 | 45415 |
| TTCN_1041 | 31357 | ATCN_3477 | 45416 |
| ATCN_734 | 31358 | CTCN_6207 | 45417 |
| TTCN_1042 | 31359 | GTCN_3267 | 45418 |
| CTCN_1357 | 31360 | CTCN_6208 | 45419 |
| TTCN_1043 | 31361 | TTCN_5010 | 45420 |
| TTCN_1044 | 31362 | TTCN_5011 | 45421 |
| ATCN_735 | 31363 | CTCN_6209 | 45422 |

| | | | |
|---|---|---|---|
| GTCN_770 | 31364 | ATCN_3478 | 45423 |
| CTCN_1358 | 31365 | CTCN_6210 | 45424 |
| GTCN_771 | 31366 | CTCN_6211 | 45425 |
| CTCN_1359 | 31367 | ATCN_3479 | 45426 |
| ATCN_736 | 31368 | ATCN_3480 | 45427 |
| GTCN_772 | 31369 | CTCN_6212 | 45428 |
| CTCN_1360 | 31370 | GTCN_3268 | 45429 |
| CTCN_1361 | 31371 | CTCN_6213 | 45430 |
| TTCN_1045 | 31372 | ATCN_3481 | 45431 |
| CTCN_1362 | 31373 | ATCN_3482 | 45432 |
| ATCN_737 | 31374 | CTCN_6214 | 45433 |
| CTCN_1363 | 31375 | GTCN_3269 | 45434 |
| CTCN_1364 | 31376 | ATCN_3483 | 45435 |
| GTCN_773 | 31377 | TTCN_5012 | 45436 |
| TTCN_1046 | 31378 | GTCN_3270 | 45437 |
| CTCN_1365 | 31379 | CTCN_6215 | 45438 |
| CTCN_1366 | 31380 | GTCN_3271 | 45439 |
| GTCN_774 | 31381 | TTCN_5013 | 45440 |
| GTCN_775 | 31382 | TTCN_5014 | 45441 |
| GTCN_776 | 31383 | CTCN_6216 | 45442 |
| TTCN_1047 | 31384 | TTCN_5015 | 45443 |
| GTCN_777 | 31385 | TTCN_5016 | 45444 |
| CTCN_1367 | 31386 | CTCN_6217 | 45445 |
| ATCN_738 | 31387 | CTCN_6218 | 45446 |
| ATCN_739 | 31388 | CTCN_6219 | 45447 |
| CTCN_1368 | 31389 | CTCN_6220 | 45448 |
| CTCN_1369 | 31390 | ATCN_3484 | 45449 |
| GTCN_778 | 31391 | ATCN_3485 | 45450 |
| TTCN_1048 | 31392 | CTCN_6221 | 45451 |
| CTCN_1370 | 31393 | GTCN_3272 | 45452 |
| GTCN_779 | 31394 | CTCN_6222 | 45453 |
| CTCN_1371 | 31395 | GTCN_3273 | 45454 |
| TTCN_1049 | 31396 | CTCN_6223 | 45455 |
| TTCN_1050 | 31397 | GTCN_3274 | 45456 |
| CTCN_1372 | 31398 | CTCN_6224 | 45457 |
| CTCN_1373 | 31399 | GTCN_3275 | 45458 |
| ATCN_740 | 31400 | CTCN_6225 | 45459 |
| ATCN_741 | 31401 | TTCN_5017 | 45460 |
| CTCN_1374 | 31402 | ATCN_3486 | 45461 |
| TTCN_1051 | 31403 | TTCN_5018 | 45462 |
| GTCN_780 | 31404 | GTCN_3276 | 45463 |
| TTCN_1052 | 31405 | TTCN_5019 | 45464 |
| ATCN_742 | 31406 | TTCN_5020 | 45465 |

FIG. 37 (continued)

| | | | |
|---|---|---|---|
| TTCN_1053 | 31407 | TTCN_5021 | 45466 |
| CTCN_1375 | 31408 | TTCN_5022 | 45467 |
| CTCN_1376 | 31409 | ATCN_3487 | 45468 |
| GTCN_781 | 31410 | ATCN_3488 | 45469 |
| ATCN_743 | 31411 | GTCN_3277 | 45470 |
| TTCN_1054 | 31412 | TTCN_5023 | 45471 |
| TTCN_1055 | 31413 | CTCN_6226 | 45472 |
| CTCN_1377 | 31414 | CTCN_6227 | 45473 |
| CTCN_1378 | 31415 | TTCN_5024 | 45474 |
| CTCN_1379 | 31416 | CTCN_6228 | 45475 |
| CTCN_1380 | 31417 | TTCN_5025 | 45476 |
| GTCN_782 | 31418 | CTCN_6229 | 45477 |
| TTCN_1056 | 31419 | GTCN_3278 | 45478 |
| TTCN_1057 | 31420 | TTCN_5026 | 45479 |
| CTCN_1381 | 31421 | TTCN_5027 | 45480 |
| TTCN_1058 | 31422 | GTCN_3279 | 45481 |
| TTCN_1059 | 31423 | CTCN_6230 | 45482 |
| CTCN_1382 | 31424 | TTCN_5028 | 45483 |
| TTCN_1060 | 31425 | GTCN_3280 | 45484 |
| CTCN_1383 | 31426 | CTCN_6231 | 45485 |
| TTCN_1061 | 31427 | GTCN_3281 | 45486 |
| GTCN_783 | 31428 | GTCN_3282 | 45487 |
| GTCN_784 | 31429 | ATCN_3489 | 45488 |
| TTCN_1062 | 31430 | TTCN_5029 | 45489 |
| GTCN_785 | 31431 | CTCN_6232 | 45490 |
| CTCN_1384 | 31432 | GTCN_3283 | 45491 |
| TTCN_1063 | 31433 | GTCN_3284 | 45492 |
| CTCN_1385 | 31434 | TTCN_5030 | 45493 |
| GTCN_786 | 31435 | CTCN_6233 | 45494 |
| TTCN_1064 | 31436 | CTCN_6234 | 45495 |
| ATCN_744 | 31437 | TTCN_5031 | 45496 |
| GTCN_787 | 31438 | CTCN_6235 | 45497 |
| TTCN_1065 | 31439 | TTCN_5032 | 45498 |
| CTCN_1386 | 31440 | ATCN_3490 | 45499 |
| CTCN_1387 | 31441 | TTCN_5033 | 45500 |
| GTCN_788 | 31442 | GTCN_3285 | 45501 |
| TTCN_1066 | 31443 | CTCN_6236 | 45502 |
| CTCN_1388 | 31444 | CTCN_6237 | 45503 |
| GTCN_789 | 31445 | TTCN_5034 | 45504 |
| CTCN_1389 | 31446 | GTCN_3286 | 45505 |
| CTCN_1390 | 31447 | TTCN_5035 | 45506 |
| ATCN_745 | 31448 | TTCN_5036 | 45507 |
| TTCN_1067 | 31449 | ATCN_3491 | 45508 |

| | | | |
|---|---|---|---|
| CTCN_1391 | 31450 | ATCN_3492 | 45509 |
| CTCN_1392 | 31451 | ATCN_3493 | 45510 |
| TTCN_1068 | 31452 | CTCN_6238 | 45511 |
| TTCN_1069 | 31453 | ATCN_3494 | 45512 |
| CTCN_1393 | 31454 | TTCN_5037 | 45513 |
| CTCN_1394 | 31455 | CTCN_6239 | 45514 |
| GTCN_790 | 31456 | GTCN_3287 | 45515 |
| GTCN_791 | 31457 | CTCN_6240 | 45516 |
| ATCN_746 | 31458 | CTCN_6241 | 45517 |
| TTCN_1070 | 31459 | TTCN_5038 | 45518 |
| TTCN_1071 | 31460 | CTCN_6242 | 45519 |
| TTCN_1072 | 31461 | ATCN_3495 | 45520 |
| GTCN_792 | 31462 | ATCN_3496 | 45521 |
| CTCN_1395 | 31463 | ATCN_3497 | 45522 |
| CTCN_1396 | 31464 | CTCN_6243 | 45523 |
| ATCN_747 | 31465 | CTCN_6244 | 45524 |
| GTCN_793 | 31466 | GTCN_3288 | 45525 |
| TTCN_1073 | 31467 | TTCN_5039 | 45526 |
| TTCN_1074 | 31468 | GTCN_3289 | 45527 |
| TTCN_1075 | 31469 | ATCN_3498 | 45528 |
| ATCN_748 | 31470 | TTCN_5040 | 45529 |
| CTCN_1397 | 31471 | CTCN_6245 | 45530 |
| CTCN_1398 | 31472 | CTCN_6246 | 45531 |
| TTCN_1076 | 31473 | CTCN_6247 | 45532 |
| CTCN_1399 | 31474 | TTCN_5041 | 45533 |
| TTCN_1077 | 31475 | GTCN_3290 | 45534 |
| CTCN_1400 | 31476 | TTCN_5042 | 45535 |
| CTCN_1401 | 31477 | CTCN_6248 | 45536 |
| CTCN_1402 | 31478 | TTCN_5043 | 45537 |
| ATCN_749 | 31479 | CTCN_6249 | 45538 |
| GTCN_794 | 31480 | TTCN_5044 | 45539 |
| GTCN_795 | 31481 | TTCN_5045 | 45540 |
| CTCN_1403 | 31482 | TTCN_5046 | 45541 |
| GTCN_796 | 31483 | ATCN_3499 | 45542 |
| GTCN_797 | 31484 | GTCN_3291 | 45543 |
| ATCN_750 | 31485 | CTCN_6250 | 45544 |
| CTCN_1404 | 31486 | TTCN_5047 | 45545 |
| CTCN_1405 | 31487 | CTCN_6251 | 45546 |
| TTCN_1078 | 31488 | TTCN_5048 | 45547 |
| TTCN_1079 | 31489 | TTCN_5049 | 45548 |
| CTCN_1406 | 31490 | ATCN_3500 | 45549 |
| TTCN_1080 | 31491 | ATCN_3501 | 45550 |
| ATCN_751 | 31492 | ATCN_3502 | 45551 |

FIG. 37 (continued)

| | | | |
|---|---|---|---|
| CTCN_1407 | 31493 | CTCN_6252 | 45552 |
| TTCN_1081 | 31494 | TTCN_5050 | 45553 |
| TTCN_1082 | 31495 | TTCN_5051 | 45554 |
| GTCN_798 | 31496 | TTCN_5052 | 45555 |
| ATCN_752 | 31497 | TTCN_5053 | 45556 |
| TTCN_1083 | 31498 | ATCN_3503 | 45557 |
| ATCN_753 | 31499 | TTCN_5054 | 45558 |
| GTCN_799 | 31500 | GTCN_3292 | 45559 |
| CTCN_1408 | 31501 | ATCN_3504 | 45560 |
| ATCN_754 | 31502 | ATCN_3505 | 45561 |
| GTCN_800 | 31503 | TTCN_5055 | 45562 |
| TTCN_1084 | 31504 | CTCN_6253 | 45563 |
| CTCN_1409 | 31505 | CTCN_6254 | 45564 |
| TTCN_1085 | 31506 | CTCN_6255 | 45565 |
| GTCN_801 | 31507 | TTCN_5056 | 45566 |
| CTCN_1410 | 31508 | GTCN_3293 | 45567 |
| GTCN_802 | 31509 | CTCN_6256 | 45568 |
| CTCN_1411 | 31510 | CTCN_6257 | 45569 |
| TTCN_1086 | 31511 | TTCN_5057 | 45570 |
| CTCN_1412 | 31512 | CTCN_6258 | 45571 |
| CTCN_1413 | 31513 | TTCN_5058 | 45572 |
| ATCN_755 | 31514 | GTCN_3294 | 45573 |
| TTCN_1087 | 31515 | TTCN_5059 | 45574 |
| TTCN_1088 | 31516 | TTCN_5060 | 45575 |
| ATCN_756 | 31517 | ATCN_3506 | 45576 |
| TTCN_1089 | 31518 | CTCN_6259 | 45577 |
| CTCN_1414 | 31519 | CTCN_6260 | 45578 |
| GTCN_803 | 31520 | CTCN_6261 | 45579 |
| TTCN_1090 | 31521 | TTCN_5061 | 45580 |
| CTCN_1415 | 31522 | GTCN_3295 | 45581 |
| CTCN_1416 | 31523 | CTCN_6262 | 45582 |
| CTCN_1417 | 31524 | GTCN_3296 | 45583 |
| ATCN_757 | 31525 | GTCN_3297 | 45584 |
| CTCN_1418 | 31526 | GTCN_3298 | 45585 |
| TTCN_1091 | 31527 | GTCN_3299 | 45586 |
| CTCN_1419 | 31528 | CTCN_6263 | 45587 |
| TTCN_1092 | 31529 | TTCN_5062 | 45588 |
| ATCN_758 | 31530 | GTCN_3300 | 45589 |
| GTCN_804 | 31531 | CTCN_6264 | 45590 |
| CTCN_1420 | 31532 | TTCN_5063 | 45591 |
| CTCN_1421 | 31533 | CTCN_6265 | 45592 |
| ATCN_759 | 31534 | CTCN_6266 | 45593 |
| CTCN_1422 | 31535 | GTCN_3301 | 45594 |

| | | | |
|---|---|---|---|
| TTCN_1093 | 31536 | GTCN_3302 | 45595 |
| CTCN_1423 | 31537 | ATCN_3507 | 45596 |
| TTCN_1094 | 31538 | ATCN_3508 | 45597 |
| CTCN_1424 | 31539 | TTCN_5064 | 45598 |
| ATCN_760 | 31540 | GTCN_3303 | 45599 |
| GTCN_805 | 31541 | ATCN_3509 | 45600 |
| CTCN_1425 | 31542 | ATCN_3510 | 45601 |
| ATCN_761 | 31543 | GTCN_3304 | 45602 |
| CTCN_1426 | 31544 | ATCN_3511 | 45603 |
| CTCN_1427 | 31545 | TTCN_5065 | 45604 |
| TTCN_1095 | 31546 | TTCN_5066 | 45605 |
| CTCN_1428 | 31547 | ATCN_3512 | 45606 |
| CTCN_1429 | 31548 | GTCN_3305 | 45607 |
| CTCN_1430 | 31549 | CTCN_6267 | 45608 |
| ATCN_762 | 31550 | GTCN_3306 | 45609 |
| TTCN_1096 | 31551 | ATCN_3513 | 45610 |
| GTCN_806 | 31552 | ATCN_3514 | 45611 |
| TTCN_1097 | 31553 | ATCN_3515 | 45612 |
| TTCN_1098 | 31554 | GTCN_3307 | 45613 |
| TTCN_1099 | 31555 | CTCN_6268 | 45614 |
| ATCN_763 | 31556 | CTCN_6269 | 45615 |
| ATCN_764 | 31557 | CTCN_6270 | 45616 |
| CTCN_1431 | 31558 | GTCN_3308 | 45617 |
| TTCN_1100 | 31559 | CTCN_6271 | 45618 |
| ATCN_765 | 31560 | ATCN_3516 | 45619 |
| ATCN_766 | 31561 | ATCN_3517 | 45620 |
| CTCN_1432 | 31562 | CTCN_6272 | 45621 |
| ATCN_767 | 31563 | CTCN_6273 | 45622 |
| ATCN_768 | 31564 | CTCN_6274 | 45623 |
| TTCN_1101 | 31565 | CTCN_6275 | 45624 |
| TTCN_1102 | 31566 | TTCN_5067 | 45625 |
| ATCN_769 | 31567 | ATCN_3518 | 45626 |
| ATCN_770 | 31568 | CTCN_6276 | 45627 |
| TTCN_1103 | 31569 | TTCN_5068 | 45628 |
| TTCN_1104 | 31570 | CTCN_6277 | 45629 |
| ATCN_771 | 31571 | ATCN_3519 | 45630 |
| TTCN_1105 | 31572 | CTCN_6278 | 45631 |
| CTCN_1433 | 31573 | TTCN_5069 | 45632 |
| ATCN_772 | 31574 | ATCN_3520 | 45633 |
| ATCN_773 | 31575 | GTCN_3309 | 45634 |
| CTCN_1434 | 31576 | GTCN_3310 | 45635 |
| TTCN_1106 | 31577 | TTCN_5070 | 45636 |
| CTCN_1435 | 31578 | TTCN_5071 | 45637 |

FIG. 37 (continued)

| | | | |
|---|---|---|---|
| TTCN_1107 | 31579 | ATCN_3521 | 45638 |
| GTCN_807 | 31580 | TTCN_5072 | 45639 |
| GTCN_808 | 31581 | GTCN_3311 | 45640 |
| GTCN_809 | 31582 | GTCN_3312 | 45641 |
| CTCN_1436 | 31583 | TTCN_5073 | 45642 |
| TTCN_1108 | 31584 | TTCN_5074 | 45643 |
| TTCN_1109 | 31585 | TTCN_5075 | 45644 |
| TTCN_1110 | 31586 | TTCN_5076 | 45645 |
| TTCN_1111 | 31587 | ATCN_3522 | 45646 |
| TTCN_1112 | 31588 | ATCN_3523 | 45647 |
| ATCN_774 | 31589 | TTCN_5077 | 45648 |
| TTCN_1113 | 31590 | CTCN_6279 | 45649 |
| GTCN_810 | 31591 | GTCN_3313 | 45650 |
| ATCN_775 | 31592 | GTCN_3314 | 45651 |
| TTCN_1114 | 31593 | CTCN_6280 | 45652 |
| GTCN_811 | 31594 | GTCN_3315 | 45653 |
| TTCN_1115 | 31595 | CTCN_6281 | 45654 |
| TTCN_1116 | 31596 | ATCN_3524 | 45655 |
| TTCN_1117 | 31597 | ATCN_3525 | 45656 |
| ATCN_776 | 31598 | ATCN_3526 | 45657 |
| TTCN_1118 | 31599 | TTCN_5078 | 45658 |
| TTCN_1119 | 31600 | CTCN_6282 | 45659 |
| ATCN_777 | 31601 | CTCN_6283 | 45660 |
| ATCN_778 | 31602 | CTCN_6284 | 45661 |
| ATCN_779 | 31603 | CTCN_6285 | 45662 |
| ATCN_780 | 31604 | TTCN_5079 | 45663 |
| TTCN_1120 | 31605 | ATCN_3527 | 45664 |
| ATCN_781 | 31606 | TTCN_5080 | 45665 |
| ATCN_782 | 31607 | CTCN_6286 | 45666 |
| ATCN_783 | 31608 | ATCN_3528 | 45667 |
| TTCN_1121 | 31609 | GTCN_3316 | 45668 |
| ATCN_784 | 31610 | GTCN_3317 | 45669 |
| TTCN_1122 | 31611 | GTCN_3318 | 45670 |
| TTCN_1123 | 31612 | CTCN_6287 | 45671 |
| ATCN_785 | 31613 | CTCN_6288 | 45672 |
| TTCN_1124 | 31614 | GTCN_3319 | 45673 |
| GTCN_812 | 31615 | ATCN_3529 | 45674 |
| CTCN_1437 | 31616 | CTCN_6289 | 45675 |
| ATCN_786 | 31617 | GTCN_3320 | 45676 |
| TTCN_1125 | 31618 | GTCN_3321 | 45677 |
| CTCN_1438 | 31619 | GTCN_3322 | 45678 |
| ATCN_787 | 31620 | TTCN_5081 | 45679 |
| ATCN_788 | 31621 | ATCN_3530 | 45680 |

| | | | |
|---|---|---|---|
| TTCN_1126 | 31622 | GTCN_3323 | 45681 |
| GTCN_813 | 31623 | TTCN_5082 | 45682 |
| TTCN_1127 | 31624 | GTCN_3324 | 45683 |
| TTCN_1128 | 31625 | GTCN_3325 | 45684 |
| TTCN_1129 | 31626 | ATCN_3531 | 45685 |
| ATCN_789 | 31627 | TTCN_5083 | 45686 |
| TTCN_1130 | 31628 | ATCN_3532 | 45687 |
| ATCN_790 | 31629 | ATCN_3533 | 45688 |
| TTCN_1131 | 31630 | TTCN_5084 | 45689 |
| TTCN_1132 | 31631 | TTCN_5085 | 45690 |
| ATCN_791 | 31632 | CTCN_6290 | 45691 |
| TTCN_1133 | 31633 | TTCN_5086 | 45692 |
| ATCN_792 | 31634 | CTCN_6291 | 45693 |
| CTCN_1439 | 31635 | TTCN_5087 | 45694 |
| TTCN_1134 | 31636 | ATCN_3534 | 45695 |
| ATCN_793 | 31637 | CTCN_6292 | 45696 |
| TTCN_1135 | 31638 | ATCN_3535 | 45697 |
| TTCN_1136 | 31639 | TTCN_5088 | 45698 |
| ATCN_794 | 31640 | ATCN_3536 | 45699 |
| TTCN_1137 | 31641 | ATCN_3537 | 45700 |
| TTCN_1138 | 31642 | CTCN_6293 | 45701 |
| GTCN_814 | 31643 | GTCN_3326 | 45702 |
| CTCN_1440 | 31644 | CTCN_6294 | 45703 |
| CTCN_1441 | 31645 | ATCN_3538 | 45704 |
| GTCN_815 | 31646 | TTCN_5089 | 45705 |
| ATCN_795 | 31647 | ATCN_3539 | 45706 |
| ATCN_796 | 31648 | TTCN_5090 | 45707 |
| TTCN_1139 | 31649 | CTCN_6295 | 45708 |
| TTCN_1140 | 31650 | CTCN_6296 | 45709 |
| ATCN_797 | 31651 | TTCN_5091 | 45710 |
| TTCN_1141 | 31652 | CTCN_6297 | 45711 |
| TTCN_1142 | 31653 | ATCN_3540 | 45712 |
| TTCN_1143 | 31654 | CTCN_6298 | 45713 |
| TTCN_1144 | 31655 | ATCN_3541 | 45714 |
| GTCN_816 | 31656 | CTCN_6299 | 45715 |
| CTCN_1442 | 31657 | CTCN_6300 | 45716 |
| TTCN_1145 | 31658 | TTCN_5092 | 45717 |
| CTCN_1443 | 31659 | TTCN_5093 | 45718 |
| GTCN_817 | 31660 | ATCN_3542 | 45719 |
| GTCN_818 | 31661 | GTCN_3327 | 45720 |
| ATCN_798 | 31662 | TTCN_5094 | 45721 |
| TTCN_1146 | 31663 | ATCN_3543 | 45722 |
| ATCN_799 | 31664 | TTCN_5095 | 45723 |

FIG. 37 (continued)

| | | | |
|---|---|---|---|
| CTCN_1444 | 31665 | TTCN_5096 | 45724 |
| TTCN_1147 | 31666 | ATCN_3544 | 45725 |
| GTCN_819 | 31667 | TTCN_5097 | 45726 |
| CTCN_1445 | 31668 | TTCN_5098 | 45727 |
| TTCN_1148 | 31669 | CTCN_6301 | 45728 |
| TTCN_1149 | 31670 | GTCN_3328 | 45729 |
| CTCN_1446 | 31671 | CTCN_6302 | 45730 |
| TTCN_1150 | 31672 | ATCN_3545 | 45731 |
| TTCN_1151 | 31673 | ATCN_3546 | 45732 |
| TTCN_1152 | 31674 | GTCN_3329 | 45733 |
| CTCN_1447 | 31675 | ATCN_3547 | 45734 |
| GTCN_820 | 31676 | ATCN_3548 | 45735 |
| GTCN_821 | 31677 | GTCN_3330 | 45736 |
| TTCN_1153 | 31678 | TTCN_5099 | 45737 |
| TTCN_1154 | 31679 | TTCN_5100 | 45738 |
| TTCN_1155 | 31680 | CTCN_6303 | 45739 |
| TTCN_1156 | 31681 | CTCN_6304 | 45740 |
| TTCN_1157 | 31682 | GTCN_3331 | 45741 |
| GTCN_822 | 31683 | TTCN_5101 | 45742 |
| GTCN_823 | 31684 | TTCN_5102 | 45743 |
| GTCN_824 | 31685 | TTCN_5103 | 45744 |
| GTCN_825 | 31686 | ATCN_3549 | 45745 |
| TTCN_1158 | 31687 | CTCN_6305 | 45746 |
| CTCN_1448 | 31688 | CTCN_6306 | 45747 |
| GTCN_826 | 31689 | CTCN_6307 | 45748 |
| TTCN_1159 | 31690 | TTCN_5104 | 45749 |
| CTCN_1449 | 31691 | CTCN_6308 | 45750 |
| ATCN_800 | 31692 | GTCN_3332 | 45751 |
| ATCN_801 | 31693 | TTCN_5105 | 45752 |
| CTCN_1450 | 31694 | CTCN_6309 | 45753 |
| TTCN_1160 | 31695 | GTCN_3333 | 45754 |
| CTCN_1451 | 31696 | TTCN_5106 | 45755 |
| GTCN_827 | 31697 | TTCN_5107 | 45756 |
| CTCN_1452 | 31698 | CTCN_6310 | 45757 |
| TTCN_1161 | 31699 | CTCN_6311 | 45758 |
| GTCN_828 | 31700 | CTCN_6312 | 45759 |
| CTCN_1453 | 31701 | GTCN_3334 | 45760 |
| ATCN_802 | 31702 | TTCN_5108 | 45761 |
| TTCN_1162 | 31703 | CTCN_6313 | 45762 |
| GTCN_829 | 31704 | TTCN_5109 | 45763 |
| CTCN_1454 | 31705 | ATCN_3550 | 45764 |
| TTCN_1163 | 31706 | CTCN_6314 | 45765 |
| TTCN_1164 | 31707 | ATCN_3551 | 45766 |

| | | | |
|---|---|---|---|
| ATCN_803 | 31708 | TTCN_5110 | 45767 |
| TTCN_1165 | 31709 | GTCN_3335 | 45768 |
| CTCN_1455 | 31710 | CTCN_6315 | 45769 |
| CTCN_1456 | 31711 | GTCN_3336 | 45770 |
| CTCN_1457 | 31712 | CTCN_6316 | 45771 |
| CTCN_1458 | 31713 | ATCN_3552 | 45772 |
| CTCN_1459 | 31714 | TTCN_5111 | 45773 |
| TTCN_1166 | 31715 | GTCN_3337 | 45774 |
| TTCN_1167 | 31716 | CTCN_6317 | 45775 |
| ATCN_804 | 31717 | CTCN_6318 | 45776 |
| TTCN_1168 | 31718 | CTCN_6319 | 45777 |
| ATCN_805 | 31719 | GTCN_3338 | 45778 |
| CTCN_1460 | 31720 | TTCN_5112 | 45779 |
| CTCN_1461 | 31721 | GTCN_3339 | 45780 |
| GTCN_830 | 31722 | GTCN_3340 | 45781 |
| TTCN_1169 | 31723 | CTCN_6320 | 45782 |
| GTCN_831 | 31724 | CTCN_6321 | 45783 |
| TTCN_1170 | 31725 | TTCN_5113 | 45784 |
| ATCN_806 | 31726 | ATCN_3553 | 45785 |
| TTCN_1171 | 31727 | TTCN_5114 | 45786 |
| CTCN_1462 | 31728 | CTCN_6322 | 45787 |
| GTCN_832 | 31729 | GTCN_3341 | 45788 |
| ATCN_807 | 31730 | CTCN_6323 | 45789 |
| CTCN_1463 | 31731 | CTCN_6324 | 45790 |
| GTCN_833 | 31732 | CTCN_6325 | 45791 |
| CTCN_1464 | 31733 | GTCN_3342 | 45792 |
| ATCN_808 | 31734 | CTCN_6326 | 45793 |
| ATCN_809 | 31735 | ATCN_3554 | 45794 |
| TTCN_1172 | 31736 | ATCN_3555 | 45795 |
| TTCN_1173 | 31737 | CTCN_6327 | 45796 |
| ATCN_810 | 31738 | CTCN_6328 | 45797 |
| TTCN_1174 | 31739 | CTCN_6329 | 45798 |
| TTCN_1175 | 31740 | CTCN_6330 | 45799 |
| ATCN_811 | 31741 | TTCN_5115 | 45800 |
| ATCN_812 | 31742 | TTCN_5116 | 45801 |
| CTCN_1465 | 31743 | CTCN_6331 | 45802 |
| GTCN_834 | 31744 | CTCN_6332 | 45803 |
| CTCN_1466 | 31745 | TTCN_5117 | 45804 |
| GTCN_835 | 31746 | CTCN_6333 | 45805 |
| TTCN_1176 | 31747 | ATCN_3556 | 45806 |
| TTCN_1177 | 31748 | GTCN_3343 | 45807 |
| ATCN_813 | 31749 | TTCN_5118 | 45808 |
| TTCN_1178 | 31750 | CTCN_6334 | 45809 |

FIG. 37 (continued)

| | | | | | | | |
|---|---|---|---|---|---|---|---|
| TTCN_1179 | 31751 | GTCN_3344 | 45810 | TTCN_1196 | 31794 | GTCN_3351 | 45853 |
| TTCN_1180 | 31752 | TTCN_5119 | 45811 | GTCN_841 | 31795 | CTCN_6352 | 45854 |
| CTCN_1467 | 31753 | GTCN_3345 | 45812 | TTCN_1197 | 31796 | TTCN_5127 | 45855 |
| TTCN_1181 | 31754 | GTCN_3346 | 45813 | TTCN_1198 | 31797 | ATCN_3568 | 45856 |
| ATCN_814 | 31755 | CTCN_6335 | 45814 | CTCN_1481 | 31798 | ATCN_3569 | 45857 |
| CTCN_1468 | 31756 | CTCN_6336 | 45815 | TTCN_1199 | 31799 | TTCN_5128 | 45858 |
| GTCN_836 | 31757 | GTCN_3347 | 45816 | GTCN_842 | 31800 | TTCN_5129 | 45859 |
| TTCN_1182 | 31758 | CTCN_6337 | 45817 | TTCN_1200 | 31801 | CTCN_6353 | 45860 |
| GTCN_837 | 31759 | ATCN_3557 | 45818 | TTCN_1201 | 31802 | TTCN_5130 | 45861 |
| GTCN_838 | 31760 | ATCN_3558 | 45819 | ATCN_821 | 31803 | CTCN_6354 | 45862 |
| TTCN_1183 | 31761 | CTCN_6338 | 45820 | ATCN_822 | 31804 | CTCN_6355 | 45863 |
| ATCN_815 | 31762 | ATCN_3559 | 45821 | TTCN_1202 | 31805 | GTCN_3352 | 45864 |
| CTCN_1469 | 31763 | CTCN_6339 | 45822 | TTCN_1203 | 31806 | TTCN_5131 | 45865 |
| ATCN_816 | 31764 | CTCN_6340 | 45823 | CTCN_1482 | 31807 | ATCN_3570 | 45866 |
| TTCN_1184 | 31765 | CTCN_6341 | 45824 | GTCN_843 | 31808 | TTCN_5132 | 45867 |
| CTCN_1470 | 31766 | TTCN_5120 | 45825 | GTCN_844 | 31809 | TTCN_5133 | 45868 |
| CTCN_1471 | 31767 | ATCN_3560 | 45826 | CTCN_1483 | 31810 | CTCN_6356 | 45869 |
| TTCN_1185 | 31768 | TTCN_5121 | 45827 | GTCN_845 | 31811 | CTCN_6357 | 45870 |
| ATCN_817 | 31769 | CTCN_6342 | 45828 | CTCN_1484 | 31812 | CTCN_6358 | 45871 |
| ATCN_818 | 31770 | GTCN_3348 | 45829 | CTCN_1485 | 31813 | ATCN_3571 | 45872 |
| CTCN_1472 | 31771 | ATCN_3561 | 45830 | GTCN_846 | 31814 | TTCN_5134 | 45873 |
| TTCN_1186 | 31772 | ATCN_3562 | 45831 | CTCN_1486 | 31815 | TTCN_5135 | 45874 |
| TTCN_1187 | 31773 | CTCN_6343 | 45832 | CTCN_1487 | 31816 | CTCN_6359 | 45875 |
| CTCN_1473 | 31774 | TTCN_5122 | 45833 | GTCN_847 | 31817 | TTCN_5136 | 45876 |
| GTCN_839 | 31775 | ATCN_3563 | 45834 | CTCN_1488 | 31818 | CTCN_6360 | 45877 |
| CTCN_1474 | 31776 | CTCN_6344 | 45835 | GTCN_848 | 31819 | CTCN_6361 | 45878 |
| ATCN_819 | 31777 | CTCN_6345 | 45836 | GTCN_849 | 31820 | CTCN_6362 | 45879 |
| ATCN_820 | 31778 | TTCN_5123 | 45837 | GTCN_850 | 31821 | GTCN_3353 | 45880 |
| TTCN_1188 | 31779 | ATCN_3564 | 45838 | ATCN_823 | 31822 | TTCN_5137 | 45881 |
| CTCN_1475 | 31780 | CTCN_6346 | 45839 | TTCN_1204 | 31823 | GTCN_3354 | 45882 |
| TTCN_1189 | 31781 | TTCN_5124 | 45840 | ATCN_824 | 31824 | ATCN_3572 | 45883 |
| TTCN_1190 | 31782 | TTCN_5125 | 45841 | CTCN_1489 | 31825 | TTCN_5138 | 45884 |
| TTCN_1191 | 31783 | ATCN_3565 | 45842 | ATCN_825 | 31826 | GTCN_3355 | 45885 |
| TTCN_1192 | 31784 | GTCN_3349 | 45843 | GTCN_851 | 31827 | CTCN_6363 | 45886 |
| TTCN_1193 | 31785 | GTCN_3350 | 45844 | CTCN_1490 | 31828 | GTCN_3356 | 45887 |
| CTCN_1476 | 31786 | TTCN_5126 | 45845 | TTCN_1205 | 31829 | GTCN_3357 | 45888 |
| CTCN_1477 | 31787 | CTCN_6347 | 45846 | TTCN_1206 | 31830 | TTCN_5139 | 45889 |
| GTCN_840 | 31788 | ATCN_3566 | 45847 | TTCN_1207 | 31831 | GTCN_3358 | 45890 |
| TTCN_1194 | 31789 | CTCN_6348 | 45848 | TTCN_1208 | 31832 | TTCN_5140 | 45891 |
| CTCN_1478 | 31790 | CTCN_6349 | 45849 | CTCN_1491 | 31833 | CTCN_6364 | 45892 |
| TTCN_1195 | 31791 | CTCN_6350 | 45850 | TTCN_1209 | 31834 | ATCN_3573 | 45893 |
| CTCN_1479 | 31792 | ATCN_3567 | 45851 | CTCN_1492 | 31835 | ATCN_3574 | 45894 |
| CTCN_1480 | 31793 | CTCN_6351 | 45852 | ATCN_826 | 31836 | TTCN_5141 | 45895 |

FIG. 37 (continued)

| | | | |
|---|---|---|---|
| CTCN_1493 | 31837 | TTCN_5142 | 45896 |
| CTCN_1494 | 31838 | TTCN_5143 | 45897 |
| ATCN_827 | 31839 | GTCN_3359 | 45898 |
| ATCN_828 | 31840 | CTCN_6365 | 45899 |
| CTCN_1495 | 31841 | GTCN_3360 | 45900 |
| CTCN_1496 | 31842 | TTCN_5144 | 45901 |
| CTCN_1497 | 31843 | TTCN_5145 | 45902 |
| CTCN_1498 | 31844 | TTCN_5146 | 45903 |
| CTCN_1499 | 31845 | TTCN_5147 | 45904 |
| CTCN_1500 | 31846 | CTCN_6366 | 45905 |
| CTCN_1501 | 31847 | CTCN_6367 | 45906 |
| GTCN_852 | 31848 | TTCN_5148 | 45907 |
| CTCN_1502 | 31849 | CTCN_6368 | 45908 |
| CTCN_1503 | 31850 | CTCN_6369 | 45909 |
| GTCN_853 | 31851 | ATCN_3575 | 45910 |
| CTCN_1504 | 31852 | GTCN_3361 | 45911 |
| CTCN_1505 | 31853 | GTCN_3362 | 45912 |
| TTCN_1210 | 31854 | TTCN_5149 | 45913 |
| TTCN_1211 | 31855 | TTCN_5150 | 45914 |
| TTCN_1212 | 31856 | TTCN_5151 | 45915 |
| CTCN_1506 | 31857 | CTCN_6370 | 45916 |
| ATCN_829 | 31858 | GTCN_3363 | 45917 |
| CTCN_1507 | 31859 | ATCN_3576 | 45918 |
| TTCN_1213 | 31860 | TTCN_5152 | 45919 |
| CTCN_1508 | 31861 | ATCN_3577 | 45920 |
| TTCN_1214 | 31862 | CTCN_6371 | 45921 |
| CTCN_1509 | 31863 | ATCN_3578 | 45922 |
| CTCN_1510 | 31864 | ATCN_3579 | 45923 |
| CTCN_1511 | 31865 | ATCN_3580 | 45924 |
| CTCN_1512 | 31866 | ATCN_3581 | 45925 |
| ATCN_830 | 31867 | CTCN_6372 | 45926 |
| GTCN_854 | 31868 | ATCN_3582 | 45927 |
| TTCN_1215 | 31869 | ATCN_3583 | 45928 |
| CTCN_1513 | 31870 | GTCN_3364 | 45929 |
| TTCN_1216 | 31871 | CTCN_6373 | 45930 |
| CTCN_1514 | 31872 | CTCN_6374 | 45931 |
| ATCN_831 | 31873 | TTCN_5153 | 45932 |
| ATCN_832 | 31874 | ATCN_3584 | 45933 |
| TTCN_1217 | 31875 | TTCN_5154 | 45934 |
| CTCN_1515 | 31876 | ATCN_3585 | 45935 |
| CTCN_1516 | 31877 | TTCN_5155 | 45936 |
| CTCN_1517 | 31878 | TTCN_5156 | 45937 |
| CTCN_1518 | 31879 | TTCN_5157 | 45938 |

| | | | |
|---|---|---|---|
| GTCN_855 | 31880 | TTCN_5158 | 45939 |
| CTCN_1519 | 31881 | CTCN_6375 | 45940 |
| TTCN_1218 | 31882 | GTCN_3365 | 45941 |
| CTCN_1520 | 31883 | TTCN_5159 | 45942 |
| CTCN_1521 | 31884 | ATCN_3586 | 45943 |
| TTCN_1219 | 31885 | ATCN_3587 | 45944 |
| CTCN_1522 | 31886 | GTCN_3366 | 45945 |
| TTCN_1220 | 31887 | ATCN_3588 | 45946 |
| CTCN_1523 | 31888 | GTCN_3367 | 45947 |
| TTCN_1221 | 31889 | ATCN_3589 | 45948 |
| GTCN_856 | 31890 | ATCN_3590 | 45949 |
| TTCN_1222 | 31891 | ATCN_3591 | 45950 |
| CTCN_1524 | 31892 | ATCN_3592 | 45951 |
| GTCN_857 | 31893 | ATCN_3593 | 45952 |
| CTCN_1525 | 31894 | CTCN_6376 | 45953 |
| GTCN_858 | 31895 | GTCN_3368 | 45954 |
| TTCN_1223 | 31896 | TTCN_5160 | 45955 |
| TTCN_1224 | 31897 | TTCN_5161 | 45956 |
| GTCN_859 | 31898 | TTCN_5162 | 45957 |
| TTCN_1225 | 31899 | TTCN_5163 | 45958 |
| ATCN_833 | 31900 | CTCN_6377 | 45959 |
| GTCN_860 | 31901 | GTCN_3369 | 45960 |
| CTCN_1526 | 31902 | CTCN_6378 | 45961 |
| TTCN_1226 | 31903 | TTCN_5164 | 45962 |
| CTCN_1527 | 31904 | TTCN_5165 | 45963 |
| ATCN_834 | 31905 | GTCN_3370 | 45964 |
| GTCN_861 | 31906 | TTCN_5166 | 45965 |
| GTCN_862 | 31907 | TTCN_5167 | 45966 |
| GTCN_863 | 31908 | GTCN_3371 | 45967 |
| ATCN_835 | 31909 | ATCN_3594 | 45968 |
| GTCN_864 | 31910 | TTCN_5168 | 45969 |
| ATCN_836 | 31911 | TTCN_5169 | 45970 |
| TTCN_1227 | 31912 | CTCN_6379 | 45971 |
| CTCN_1528 | 31913 | TTCN_5170 | 45972 |
| CTCN_1529 | 31914 | GTCN_3372 | 45973 |
| GTCN_865 | 31915 | ATCN_3595 | 45974 |
| GTCN_866 | 31916 | GTCN_3373 | 45975 |
| CTCN_1530 | 31917 | TTCN_5171 | 45976 |
| GTCN_867 | 31918 | TTCN_5172 | 45977 |
| TTCN_1228 | 31919 | CTCN_6380 | 45978 |
| TTCN_1229 | 31920 | GTCN_3374 | 45979 |
| CTCN_1531 | 31921 | CTCN_6381 | 45980 |
| TTCN_1230 | 31922 | CTCN_6382 | 45981 |

FIG. 37 (continued)

| | | | |
|---|---|---|---|
| TTCN_1231 | 31923 | ATCN_3596 | 45982 |
| CTCN_1532 | 31924 | GTCN_3375 | 45983 |
| GTCN_868 | 31925 | CTCN_6383 | 45984 |
| TTCN_1232 | 31926 | CTCN_6384 | 45985 |
| TTCN_1233 | 31927 | ATCN_3597 | 45986 |
| GTCN_869 | 31928 | CTCN_6385 | 45987 |
| GTCN_870 | 31929 | ATCN_3598 | 45988 |
| GTCN_871 | 31930 | GTCN_3376 | 45989 |
| CTCN_1533 | 31931 | TTCN_5173 | 45990 |
| ATCN_837 | 31932 | CTCN_6386 | 45991 |
| CTCN_1534 | 31933 | GTCN_3377 | 45992 |
| GTCN_872 | 31934 | CTCN_6387 | 45993 |
| CTCN_1535 | 31935 | GTCN_3378 | 45994 |
| CTCN_1536 | 31936 | TTCN_5174 | 45995 |
| ATCN_838 | 31937 | GTCN_3379 | 45996 |
| ATCN_839 | 31938 | TTCN_5175 | 45997 |
| TTCN_1234 | 31939 | ATCN_3599 | 45998 |
| TTCN_1235 | 31940 | CTCN_6388 | 45999 |
| CTCN_1537 | 31941 | GTCN_3380 | 46000 |
| GTCN_873 | 31942 | CTCN_6389 | 46001 |
| CTCN_1538 | 31943 | TTCN_5176 | 46002 |
| GTCN_874 | 31944 | CTCN_6390 | 46003 |
| ATCN_840 | 31945 | GTCN_3381 | 46004 |
| CTCN_1539 | 31946 | CTCN_6391 | 46005 |
| ATCN_841 | 31947 | CTCN_6392 | 46006 |
| ATCN_842 | 31948 | TTCN_5177 | 46007 |
| TTCN_1236 | 31949 | ATCN_3600 | 46008 |
| GTCN_875 | 31950 | CTCN_6393 | 46009 |
| CTCN_1540 | 31951 | CTCN_6394 | 46010 |
| CTCN_1541 | 31952 | TTCN_5178 | 46011 |
| CTCN_1542 | 31953 | CTCN_6395 | 46012 |
| ATCN_843 | 31954 | CTCN_6396 | 46013 |
| ATCN_844 | 31955 | CTCN_6397 | 46014 |
| CTCN_1543 | 31956 | TTCN_5179 | 46015 |
| CTCN_1544 | 31957 | TTCN_5180 | 46016 |
| ATCN_845 | 31958 | CTCN_6398 | 46017 |
| ATCN_846 | 31959 | GTCN_3382 | 46018 |
| ATCN_847 | 31960 | TTCN_5181 | 46019 |
| TTCN_1237 | 31961 | ATCN_3601 | 46020 |
| GTCN_876 | 31962 | ATCN_3602 | 46021 |
| GTCN_877 | 31963 | GTCN_3383 | 46022 |
| ATCN_848 | 31964 | GTCN_3384 | 46023 |
| GTCN_878 | 31965 | CTCN_6399 | 46024 |

| | | | |
|---|---|---|---|
| ATCN_849 | 31966 | GTCN_3385 | 46025 |
| CTCN_1545 | 31967 | CTCN_6400 | 46026 |
| TTCN_1238 | 31968 | ATCN_3603 | 46027 |
| TTCN_1239 | 31969 | CTCN_6401 | 46028 |
| TTCN_1240 | 31970 | CTCN_6402 | 46029 |
| CTCN_1546 | 31971 | CTCN_6403 | 46030 |
| CTCN_1547 | 31972 | ATCN_3604 | 46031 |
| ATCN_850 | 31973 | ATCN_3605 | 46032 |
| TTCN_1241 | 31974 | CTCN_6404 | 46033 |
| CTCN_1548 | 31975 | CTCN_6405 | 46034 |
| TTCN_1242 | 31976 | CTCN_6406 | 46035 |
| CTCN_1549 | 31977 | GTCN_3386 | 46036 |
| TTCN_1243 | 31978 | CTCN_6407 | 46037 |
| TTCN_1244 | 31979 | GTCN_3387 | 46038 |
| GTCN_879 | 31980 | CTCN_6408 | 46039 |
| ATCN_851 | 31981 | GTCN_3388 | 46040 |
| GTCN_880 | 31982 | CTCN_6409 | 46041 |
| CTCN_1550 | 31983 | GTCN_3389 | 46042 |
| ATCN_852 | 31984 | TTCN_5182 | 46043 |
| CTCN_1551 | 31985 | CTCN_6410 | 46044 |
| GTCN_881 | 31986 | TTCN_5183 | 46045 |
| CTCN_1552 | 31987 | CTCN_6411 | 46046 |
| ATCN_853 | 31988 | CTCN_6412 | 46047 |
| TTCN_1245 | 31989 | ATCN_3606 | 46048 |
| CTCN_1553 | 31990 | CTCN_6413 | 46049 |
| CTCN_1554 | 31991 | CTCN_6414 | 46050 |
| TTCN_1246 | 31992 | GTCN_3390 | 46051 |
| CTCN_1555 | 31993 | CTCN_6415 | 46052 |
| CTCN_1556 | 31994 | ATCN_3607 | 46053 |
| CTCN_1557 | 31995 | ATCN_3608 | 46054 |
| ATCN_854 | 31996 | CTCN_6416 | 46055 |
| ATCN_855 | 31997 | GTCN_3391 | 46056 |
| CTCN_1558 | 31998 | CTCN_6417 | 46057 |
| TTCN_1247 | 31999 | CTCN_6418 | 46058 |
| CTCN_1559 | 32000 | GTCN_3392 | 46059 |
| GTCN_882 | 32001 | GTCN_3393 | 46060 |
| TTCN_1248 | 32002 | CTCN_6419 | 46061 |
| GTCN_883 | 32003 | TTCN_5184 | 46062 |
| CTCN_1560 | 32004 | CTCN_6420 | 46063 |
| CTCN_1561 | 32005 | ATCN_3609 | 46064 |
| GTCN_884 | 32006 | ATCN_3610 | 46065 |
| TTCN_1249 | 32007 | ATCN_3611 | 46066 |
| TTCN_1250 | 32008 | GTCN_3394 | 46067 |

FIG. 37 (continued)

| | | | |
|---|---|---|---|
| CTCN_1562 | 32009 | TTCN_5185 | 46068 |
| ATCN_856 | 32010 | ATCN_3612 | 46069 |
| TTCN_1251 | 32011 | GTCN_3395 | 46070 |
| ATCN_857 | 32012 | GTCN_3396 | 46071 |
| TTCN_1252 | 32013 | CTCN_6421 | 46072 |
| TTCN_1253 | 32014 | CTCN_6422 | 46073 |
| TTCN_1254 | 32015 | TTCN_5186 | 46074 |
| GTCN_885 | 32016 | TTCN_5187 | 46075 |
| GTCN_886 | 32017 | TTCN_5188 | 46076 |
| CTCN_1563 | 32018 | ATCN_3613 | 46077 |
| ATCN_858 | 32019 | ATCN_3614 | 46078 |
| TTCN_1255 | 32020 | TTCN_5189 | 46079 |
| CTCN_1564 | 32021 | TTCN_5190 | 46080 |
| CTCN_1565 | 32022 | ATCN_3615 | 46081 |
| TTCN_1256 | 32023 | TTCN_5191 | 46082 |
| CTCN_1566 | 32024 | ATCN_3616 | 46083 |
| TTCN_1257 | 32025 | TTCN_5192 | 46084 |
| TTCN_1258 | 32026 | GTCN_3397 | 46085 |
| CTCN_1567 | 32027 | TTCN_5193 | 46086 |
| TTCN_1259 | 32028 | CTCN_6423 | 46087 |
| TTCN_1260 | 32029 | TTCN_5194 | 46088 |
| ATCN_859 | 32030 | TTCN_5195 | 46089 |
| TTCN_1261 | 32031 | TTCN_5196 | 46090 |
| TTCN_1262 | 32032 | TTCN_5197 | 46091 |
| TTCN_1263 | 32033 | ATCN_3617 | 46092 |
| TTCN_1264 | 32034 | ATCN_3618 | 46093 |
| TTCN_1265 | 32035 | TTCN_5198 | 46094 |
| TTCN_1266 | 32036 | GTCN_3398 | 46095 |
| CTCN_1568 | 32037 | CTCN_6424 | 46096 |
| ATCN_860 | 32038 | ATCN_3619 | 46097 |
| TTCN_1267 | 32039 | ATCN_3620 | 46098 |
| TTCN_1268 | 32040 | CTCN_6425 | 46099 |
| TTCN_1269 | 32041 | TTCN_5199 | 46100 |
| GTCN_887 | 32042 | CTCN_6426 | 46101 |
| TTCN_1270 | 32043 | GTCN_3399 | 46102 |
| TTCN_1271 | 32044 | TTCN_5200 | 46103 |
| CTCN_1569 | 32045 | GTCN_3400 | 46104 |
| ATCN_861 | 32046 | TTCN_5201 | 46105 |
| CTCN_1570 | 32047 | ATCN_3621 | 46106 |
| ATCN_862 | 32048 | ATCN_3622 | 46107 |
| CTCN_1571 | 32049 | TTCN_5202 | 46108 |
| GTCN_888 | 32050 | CTCN_6427 | 46109 |
| TTCN_1272 | 32051 | ATCN_3623 | 46110 |

| | | | |
|---|---|---|---|
| ATCN_863 | 32052 | CTCN_6428 | 46111 |
| GTCN_889 | 32053 | GTCN_3401 | 46112 |
| TTCN_1273 | 32054 | CTCN_6429 | 46113 |
| CTCN_1572 | 32055 | GTCN_3402 | 46114 |
| GTCN_890 | 32056 | ATCN_3624 | 46115 |
| CTCN_1573 | 32057 | CTCN_6430 | 46116 |
| GTCN_891 | 32058 | ATCN_3625 | 46117 |
| TTCN_1274 | 32059 | ATCN_3626 | 46118 |
| CTCN_1574 | 32060 | CTCN_6431 | 46119 |
| GTCN_892 | 32061 | CTCN_6432 | 46120 |
| TTCN_1275 | 32062 | CTCN_6433 | 46121 |
| TTCN_1276 | 32063 | TTCN_5203 | 46122 |
| GTCN_893 | 32064 | TTCN_5204 | 46123 |
| CTCN_1575 | 32065 | CTCN_6434 | 46124 |
| TTCN_1277 | 32066 | CTCN_6435 | 46125 |
| TTCN_1278 | 32067 | CTCN_6436 | 46126 |
| TTCN_1279 | 32068 | CTCN_6437 | 46127 |
| GTCN_894 | 32069 | ATCN_3627 | 46128 |
| TTCN_1280 | 32070 | CTCN_6438 | 46129 |
| TTCN_1281 | 32071 | ATCN_3628 | 46130 |
| TTCN_1282 | 32072 | TTCN_5205 | 46131 |
| TTCN_1283 | 32073 | GTCN_3403 | 46132 |
| CTCN_1576 | 32074 | CTCN_6439 | 46133 |
| GTCN_895 | 32075 | CTCN_6440 | 46134 |
| ATCN_864 | 32076 | GTCN_3404 | 46135 |
| CTCN_1577 | 32077 | CTCN_6441 | 46136 |
| TTCN_1284 | 32078 | ATCN_3629 | 46137 |
| GTCN_896 | 32079 | ATCN_3630 | 46138 |
| CTCN_1578 | 32080 | CTCN_6442 | 46139 |
| TTCN_1285 | 32081 | TTCN_5206 | 46140 |
| ATCN_865 | 32082 | ATCN_3631 | 46141 |
| ATCN_866 | 32083 | CTCN_6443 | 46142 |
| ATCN_867 | 32084 | TTCN_5207 | 46143 |
| ATCN_868 | 32085 | ATCN_3632 | 46144 |
| CTCN_1579 | 32086 | TTCN_5208 | 46145 |
| CTCN_1580 | 32087 | ATCN_3633 | 46146 |
| TTCN_1286 | 32088 | GTCN_3405 | 46147 |
| GTCN_897 | 32089 | ATCN_3634 | 46148 |
| CTCN_1581 | 32090 | CTCN_6444 | 46149 |
| ATCN_869 | 32091 | TTCN_5209 | 46150 |
| CTCN_1582 | 32092 | GTCN_3406 | 46151 |
| GTCN_898 | 32093 | GTCN_3407 | 46152 |
| CTCN_1583 | 32094 | TTCN_5210 | 46153 |

FIG. 37 (continued)

| | | | |
|---|---|---|---|
| CTCN_1584 | 32095 | GTCN_3408 | 46154 |
| TTCN_1287 | 32096 | CTCN_6445 | 46155 |
| TTCN_1288 | 32097 | GTCN_3409 | 46156 |
| TTCN_1289 | 32098 | GTCN_3410 | 46157 |
| CTCN_1585 | 32099 | GTCN_3411 | 46158 |
| GTCN_899 | 32100 | CTCN_6446 | 46159 |
| CTCN_1586 | 32101 | CTCN_6447 | 46160 |
| CTCN_1587 | 32102 | CTCN_6448 | 46161 |
| CTCN_1588 | 32103 | CTCN_6449 | 46162 |
| TTCN_1290 | 32104 | ATCN_3635 | 46163 |
| CTCN_1589 | 32105 | TTCN_5211 | 46164 |
| TTCN_1291 | 32106 | TTCN_5212 | 46165 |
| ATCN_870 | 32107 | CTCN_6450 | 46166 |
| TTCN_1292 | 32108 | CTCN_6451 | 46167 |
| TTCN_1293 | 32109 | CTCN_6452 | 46168 |
| GTCN_900 | 32110 | ATCN_3636 | 46169 |
| TTCN_1294 | 32111 | CTCN_6453 | 46170 |
| TTCN_1295 | 32112 | TTCN_5213 | 46171 |
| TTCN_1296 | 32113 | GTCN_3412 | 46172 |
| ATCN_871 | 32114 | GTCN_3413 | 46173 |
| CTCN_1590 | 32115 | TTCN_5214 | 46174 |
| TTCN_1297 | 32116 | GTCN_3414 | 46175 |
| TTCN_1298 | 32117 | ATCN_3637 | 46176 |
| ATCN_872 | 32118 | GTCN_3415 | 46177 |
| GTCN_901 | 32119 | GTCN_3416 | 46178 |
| TTCN_1299 | 32120 | ATCN_3638 | 46179 |
| CTCN_1591 | 32121 | GTCN_3417 | 46180 |
| TTCN_1300 | 32122 | ATCN_3639 | 46181 |
| ATCN_873 | 32123 | TTCN_5215 | 46182 |
| TTCN_1301 | 32124 | CTCN_6454 | 46183 |
| CTCN_1592 | 32125 | CTCN_6455 | 46184 |
| TTCN_1302 | 32126 | GTCN_3418 | 46185 |
| TTCN_1303 | 32127 | CTCN_6456 | 46186 |
| CTCN_1593 | 32128 | ATCN_3640 | 46187 |
| GTCN_902 | 32129 | TTCN_5216 | 46188 |
| CTCN_1594 | 32130 | ATCN_3641 | 46189 |
| TTCN_1304 | 32131 | GTCN_3419 | 46190 |
| TTCN_1305 | 32132 | TTCN_5217 | 46191 |
| TTCN_1306 | 32133 | TTCN_5218 | 46192 |
| TTCN_1307 | 32134 | ATCN_3642 | 46193 |
| TTCN_1308 | 32135 | TTCN_5219 | 46194 |
| TTCN_1309 | 32136 | TTCN_5220 | 46195 |
| TTCN_1310 | 32137 | ATCN_3643 | 46196 |

| | | | |
|---|---|---|---|
| ATCN_874 | 32138 | TTCN_5221 | 46197 |
| ATCN_875 | 32139 | TTCN_5222 | 46198 |
| ATCN_876 | 32140 | GTCN_3420 | 46199 |
| ATCN_877 | 32141 | TTCN_5223 | 46200 |
| CTCN_1595 | 32142 | TTCN_5224 | 46201 |
| GTCN_903 | 32143 | GTCN_3421 | 46202 |
| TTCN_1311 | 32144 | CTCN_6457 | 46203 |
| CTCN_1596 | 32145 | GTCN_3422 | 46204 |
| GTCN_904 | 32146 | TTCN_5225 | 46205 |
| CTCN_1597 | 32147 | CTCN_6458 | 46206 |
| CTCN_1598 | 32148 | ATCN_3644 | 46207 |
| TTCN_1312 | 32149 | TTCN_5226 | 46208 |
| GTCN_905 | 32150 | ATCN_3645 | 46209 |
| TTCN_1313 | 32151 | CTCN_6459 | 46210 |
| GTCN_906 | 32152 | TTCN_5227 | 46211 |
| ATCN_878 | 32153 | GTCN_3423 | 46212 |
| ATCN_879 | 32154 | ATCN_3646 | 46213 |
| ATCN_880 | 32155 | ATCN_3647 | 46214 |
| CTCN_1599 | 32156 | TTCN_5228 | 46215 |
| CTCN_1600 | 32157 | GTCN_3424 | 46216 |
| CTCN_1601 | 32158 | ATCN_3648 | 46217 |
| CTCN_1602 | 32159 | CTCN_6460 | 46218 |
| TTCN_1314 | 32160 | ATCN_3649 | 46219 |
| CTCN_1603 | 32161 | ATCN_3650 | 46220 |
| GTCN_907 | 32162 | GTCN_3425 | 46221 |
| TTCN_1315 | 32163 | CTCN_6461 | 46222 |
| TTCN_1316 | 32164 | GTCN_3426 | 46223 |
| ATCN_881 | 32165 | TTCN_5229 | 46224 |
| CTCN_1604 | 32166 | TTCN_5230 | 46225 |
| CTCN_1605 | 32167 | CTCN_6462 | 46226 |
| CTCN_1606 | 32168 | TTCN_5231 | 46227 |
| TTCN_1317 | 32169 | GTCN_3427 | 46228 |
| CTCN_1607 | 32170 | CTCN_6463 | 46229 |
| TTCN_1318 | 32171 | TTCN_5232 | 46230 |
| CTCN_1608 | 32172 | GTCN_3428 | 46231 |
| TTCN_1319 | 32173 | CTCN_6464 | 46232 |
| TTCN_1320 | 32174 | ATCN_3651 | 46233 |
| TTCN_1321 | 32175 | GTCN_3429 | 46234 |
| TTCN_1322 | 32176 | CTCN_6465 | 46235 |
| CTCN_1609 | 32177 | TTCN_5233 | 46236 |
| ATCN_882 | 32178 | CTCN_6466 | 46237 |
| ATCN_883 | 32179 | ATCN_3652 | 46238 |
| TTCN_1323 | 32180 | TTCN_5234 | 46239 |

FIG. 37 (continued)

| | | | |
|---|---|---|---|
| GTCN_908 | 32181 | TTCN_5235 | 46240 |
| CTCN_1610 | 32182 | CTCN_6467 | 46241 |
| ATCN_884 | 32183 | TTCN_5236 | 46242 |
| TTCN_1324 | 32184 | CTCN_6468 | 46243 |
| CTCN_1611 | 32185 | CTCN_6469 | 46244 |
| TTCN_1325 | 32186 | ATCN_3653 | 46245 |
| GTCN_909 | 32187 | ATCN_3654 | 46246 |
| CTCN_1612 | 32188 | TTCN_5237 | 46247 |
| ATCN_885 | 32189 | ATCN_3655 | 46248 |
| ATCN_886 | 32190 | GTCN_3430 | 46249 |
| TTCN_1326 | 32191 | ATCN_3656 | 46250 |
| ATCN_887 | 32192 | ATCN_3657 | 46251 |
| ATCN_888 | 32193 | ATCN_3658 | 46252 |
| TTCN_1327 | 32194 | GTCN_3431 | 46253 |
| TTCN_1328 | 32195 | TTCN_5238 | 46254 |
| ATCN_889 | 32196 | CTCN_6470 | 46255 |
| CTCN_1613 | 32197 | GTCN_3432 | 46256 |
| GTCN_910 | 32198 | TTCN_5239 | 46257 |
| TTCN_1329 | 32199 | CTCN_6471 | 46258 |
| CTCN_1614 | 32200 | TTCN_5240 | 46259 |
| GTCN_911 | 32201 | TTCN_5241 | 46260 |
| TTCN_1330 | 32202 | TTCN_5242 | 46261 |
| TTCN_1331 | 32203 | CTCN_6472 | 46262 |
| ATCN_890 | 32204 | CTCN_6473 | 46263 |
| CTCN_1615 | 32205 | GTCN_3433 | 46264 |
| TTCN_1332 | 32206 | GTCN_3434 | 46265 |
| ATCN_891 | 32207 | TTCN_5243 | 46266 |
| TTCN_1333 | 32208 | ATCN_3659 | 46267 |
| TTCN_1334 | 32209 | CTCN_6474 | 46268 |
| ATCN_892 | 32210 | GTCN_3435 | 46269 |
| ATCN_893 | 32211 | TTCN_5244 | 46270 |
| TTCN_1335 | 32212 | TTCN_5245 | 46271 |
| TTCN_1336 | 32213 | ATCN_3660 | 46272 |
| TTCN_1337 | 32214 | TTCN_5246 | 46273 |
| ATCN_894 | 32215 | TTCN_5247 | 46274 |
| CTCN_1616 | 32216 | TTCN_5248 | 46275 |
| ATCN_895 | 32217 | TTCN_5249 | 46276 |
| TTCN_1338 | 32218 | ATCN_3661 | 46277 |
| TTCN_1339 | 32219 | TTCN_5250 | 46278 |
| CTCN_1617 | 32220 | ATCN_3662 | 46279 |
| TTCN_1340 | 32221 | CTCN_6475 | 46280 |
| ATCN_896 | 32222 | TTCN_5251 | 46281 |
| TTCN_1341 | 32223 | CTCN_6476 | 46282 |

| | | | |
|---|---|---|---|
| CTCN_1618 | 32224 | CTCN_6477 | 46283 |
| TTCN_1342 | 32225 | CTCN_6478 | 46284 |
| GTCN_912 | 32226 | GTCN_3436 | 46285 |
| CTCN_1619 | 32227 | GTCN_3437 | 46286 |
| GTCN_913 | 32228 | CTCN_6479 | 46287 |
| ATCN_897 | 32229 | ATCN_3663 | 46288 |
| CTCN_1620 | 32230 | TTCN_5252 | 46289 |
| ATCN_898 | 32231 | CTCN_6480 | 46290 |
| ATCN_899 | 32232 | TTCN_5253 | 46291 |
| GTCN_914 | 32233 | CTCN_6481 | 46292 |
| GTCN_915 | 32234 | CTCN_6482 | 46293 |
| TTCN_1343 | 32235 | TTCN_5254 | 46294 |
| ATCN_900 | 32236 | TTCN_5255 | 46295 |
| CTCN_1621 | 32237 | ATCN_3664 | 46296 |
| CTCN_1622 | 32238 | CTCN_6483 | 46297 |
| ATCN_901 | 32239 | ATCN_3665 | 46298 |
| CTCN_1623 | 32240 | CTCN_6484 | 46299 |
| CTCN_1624 | 32241 | CTCN_6485 | 46300 |
| TTCN_1344 | 32242 | TTCN_5256 | 46301 |
| ATCN_902 | 32243 | CTCN_6486 | 46302 |
| CTCN_1625 | 32244 | TTCN_5257 | 46303 |
| GTCN_916 | 32245 | TTCN_5258 | 46304 |
| GTCN_917 | 32246 | CTCN_6487 | 46305 |
| GTCN_918 | 32247 | GTCN_3438 | 46306 |
| GTCN_919 | 32248 | ATCN_3666 | 46307 |
| CTCN_1626 | 32249 | TTCN_5259 | 46308 |
| TTCN_1345 | 32250 | TTCN_5260 | 46309 |
| GTCN_920 | 32251 | CTCN_6488 | 46310 |
| CTCN_1627 | 32252 | CTCN_6489 | 46311 |
| CTCN_1628 | 32253 | ATCN_3667 | 46312 |
| CTCN_1629 | 32254 | TTCN_5261 | 46313 |
| ATCN_903 | 32255 | ATCN_3668 | 46314 |
| ATCN_904 | 32256 | GTCN_3439 | 46315 |
| CTCN_1630 | 32257 | GTCN_3440 | 46316 |
| CTCN_1631 | 32258 | ATCN_3669 | 46317 |
| CTCN_1632 | 32259 | ATCN_3670 | 46318 |
| CTCN_1633 | 32260 | ATCN_3671 | 46319 |
| ATCN_905 | 32261 | TTCN_5262 | 46320 |
| ATCN_906 | 32262 | GTCN_3441 | 46321 |
| CTCN_1634 | 32263 | CTCN_6490 | 46322 |
| GTCN_921 | 32264 | CTCN_6491 | 46323 |
| CTCN_1635 | 32265 | GTCN_3442 | 46324 |
| GTCN_922 | 32266 | ATCN_3672 | 46325 |

FIG. 37 (continued)

| | | | |
|---|---|---|---|
| CTCN_1636 | 32267 | TTCN_5263 | 46326 |
| CTCN_1637 | 32268 | TTCN_5264 | 46327 |
| GTCN_923 | 32269 | GTCN_3443 | 46328 |
| TTCN_1346 | 32270 | GTCN_3444 | 46329 |
| GTCN_924 | 32271 | TTCN_5265 | 46330 |
| GTCN_925 | 32272 | CTCN_6492 | 46331 |
| CTCN_1638 | 32273 | CTCN_6493 | 46332 |
| TTCN_1347 | 32274 | GTCN_3445 | 46333 |
| TTCN_1348 | 32275 | TTCN_5266 | 46334 |
| CTCN_1639 | 32276 | ATCN_3673 | 46335 |
| TTCN_1349 | 32277 | CTCN_6494 | 46336 |
| TTCN_1350 | 32278 | CTCN_6495 | 46337 |
| TTCN_1351 | 32279 | CTCN_6496 | 46338 |
| ATCN_907 | 32280 | TTCN_5267 | 46339 |
| CTCN_1640 | 32281 | ATCN_3674 | 46340 |
| CTCN_1641 | 32282 | GTCN_3446 | 46341 |
| TTCN_1352 | 32283 | TTCN_5268 | 46342 |
| GTCN_926 | 32284 | ATCN_3675 | 46343 |
| CTCN_1642 | 32285 | TTCN_5269 | 46344 |
| CTCN_1643 | 32286 | ATCN_3676 | 46345 |
| CTCN_1644 | 32287 | TTCN_5270 | 46346 |
| ATCN_908 | 32288 | GTCN_3447 | 46347 |
| ATCN_909 | 32289 | TTCN_5271 | 46348 |
| TTCN_1353 | 32290 | ATCN_3677 | 46349 |
| CTCN_1645 | 32291 | CTCN_6497 | 46350 |
| ATCN_910 | 32292 | TTCN_5272 | 46351 |
| GTCN_927 | 32293 | GTCN_3448 | 46352 |
| TTCN_1354 | 32294 | CTCN_6498 | 46353 |
| TTCN_1355 | 32295 | CTCN_6499 | 46354 |
| TTCN_1356 | 32296 | ATCN_3678 | 46355 |
| GTCN_928 | 32297 | GTCN_3449 | 46356 |
| GTCN_929 | 32298 | CTCN_6500 | 46357 |
| CTCN_1646 | 32299 | GTCN_3450 | 46358 |
| TTCN_1357 | 32300 | CTCN_6501 | 46359 |
| CTCN_1647 | 32301 | CTCN_6502 | 46360 |
| ATCN_911 | 32302 | CTCN_6503 | 46361 |
| ATCN_912 | 32303 | GTCN_3451 | 46362 |
| CTCN_1648 | 32304 | CTCN_6504 | 46363 |
| TTCN_1358 | 32305 | TTCN_5273 | 46364 |
| TTCN_1359 | 32306 | TTCN_5274 | 46365 |
| TTCN_1360 | 32307 | GTCN_3452 | 46366 |
| TTCN_1361 | 32308 | ATCN_3679 | 46367 |
| ATCN_913 | 32309 | ATCN_3680 | 46368 |

| | | | |
|---|---|---|---|
| TTCN_1362 | 32310 | ATCN_3681 | 46369 |
| ATCN_914 | 32311 | CTCN_6505 | 46370 |
| ATCN_915 | 32312 | CTCN_6506 | 46371 |
| CTCN_1649 | 32313 | TTCN_5275 | 46372 |
| TTCN_1363 | 32314 | TTCN_5276 | 46373 |
| CTCN_1650 | 32315 | GTCN_3453 | 46374 |
| CTCN_1651 | 32316 | TTCN_5277 | 46375 |
| GTCN_930 | 32317 | CTCN_6507 | 46376 |
| TTCN_1364 | 32318 | TTCN_5278 | 46377 |
| GTCN_931 | 32319 | CTCN_6508 | 46378 |
| GTCN_932 | 32320 | TTCN_5279 | 46379 |
| ATCN_916 | 32321 | ATCN_3682 | 46380 |
| GTCN_933 | 32322 | GTCN_3454 | 46381 |
| ATCN_917 | 32323 | TTCN_5280 | 46382 |
| ATCN_918 | 32324 | TTCN_5281 | 46383 |
| TTCN_1365 | 32325 | GTCN_3455 | 46384 |
| TTCN_1366 | 32326 | TTCN_5282 | 46385 |
| TTCN_1367 | 32327 | CTCN_6509 | 46386 |
| CTCN_1652 | 32328 | TTCN_5283 | 46387 |
| TTCN_1368 | 32329 | GTCN_3456 | 46388 |
| TTCN_1369 | 32330 | ATCN_3683 | 46389 |
| CTCN_1653 | 32331 | ATCN_3684 | 46390 |
| ATCN_919 | 32332 | CTCN_6510 | 46391 |
| CTCN_1654 | 32333 | TTCN_5284 | 46392 |
| CTCN_1655 | 32334 | TTCN_5285 | 46393 |
| CTCN_1656 | 32335 | GTCN_3457 | 46394 |
| CTCN_1657 | 32336 | ATCN_3685 | 46395 |
| ATCN_920 | 32337 | TTCN_5286 | 46396 |
| ATCN_921 | 32338 | CTCN_6511 | 46397 |
| CTCN_1658 | 32339 | ATCN_3686 | 46398 |
| CTCN_1659 | 32340 | TTCN_5287 | 46399 |
| CTCN_1660 | 32341 | TTCN_5288 | 46400 |
| GTCN_934 | 32342 | TTCN_5289 | 46401 |
| TTCN_1370 | 32343 | TTCN_5290 | 46402 |
| TTCN_1371 | 32344 | GTCN_3458 | 46403 |
| ATCN_922 | 32345 | CTCN_6512 | 46404 |
| CTCN_1661 | 32346 | GTCN_3459 | 46405 |
| CTCN_1662 | 32347 | ATCN_3687 | 46406 |
| GTCN_935 | 32348 | CTCN_6513 | 46407 |
| CTCN_1663 | 32349 | CTCN_6514 | 46408 |
| TTCN_1372 | 32350 | CTCN_6515 | 46409 |
| ATCN_923 | 32351 | TTCN_5291 | 46410 |
| TTCN_1373 | 32352 | GTCN_3460 | 46411 |

FIG. 37 (continued)

| | | | |
|---|---|---|---|
| CTCN_1664 | 32353 | CTCN_6516 | 46412 |
| GTCN_936 | 32354 | GTCN_3461 | 46413 |
| CTCN_1665 | 32355 | TTCN_5292 | 46414 |
| TTCN_1374 | 32356 | GTCN_3462 | 46415 |
| CTCN_1666 | 32357 | TTCN_5293 | 46416 |
| TTCN_1375 | 32358 | CTCN_6517 | 46417 |
| GTCN_937 | 32359 | TTCN_5294 | 46418 |
| CTCN_1667 | 32360 | GTCN_3463 | 46419 |
| TTCN_1376 | 32361 | TTCN_5295 | 46420 |
| ATCN_924 | 32362 | TTCN_5296 | 46421 |
| ATCN_925 | 32363 | GTCN_3464 | 46422 |
| CTCN_1668 | 32364 | GTCN_3465 | 46423 |
| CTCN_1669 | 32365 | CTCN_6518 | 46424 |
| CTCN_1670 | 32366 | TTCN_5297 | 46425 |
| TTCN_1377 | 32367 | CTCN_6519 | 46426 |
| ATCN_926 | 32368 | ATCN_3688 | 46427 |
| TTCN_1378 | 32369 | TTCN_5298 | 46428 |
| ATCN_927 | 32370 | TTCN_5299 | 46429 |
| CTCN_1671 | 32371 | TTCN_5300 | 46430 |
| CTCN_1672 | 32372 | TTCN_5301 | 46431 |
| CTCN_1673 | 32373 | TTCN_5302 | 46432 |
| CTCN_1674 | 32374 | CTCN_6520 | 46433 |
| ATCN_928 | 32375 | GTCN_3466 | 46434 |
| ATCN_929 | 32376 | CTCN_6521 | 46435 |
| CTCN_1675 | 32377 | ATCN_3689 | 46436 |
| CTCN_1676 | 32378 | ATCN_3690 | 46437 |
| TTCN_1379 | 32379 | ATCN_3691 | 46438 |
| ATCN_930 | 32380 | CTCN_6522 | 46439 |
| CTCN_1677 | 32381 | TTCN_5303 | 46440 |
| CTCN_1678 | 32382 | CTCN_6523 | 46441 |
| CTCN_1679 | 32383 | CTCN_6524 | 46442 |
| CTCN_1680 | 32384 | GTCN_3467 | 46443 |
| TTCN_1380 | 32385 | CTCN_6525 | 46444 |
| CTCN_1681 | 32386 | CTCN_6526 | 46445 |
| CTCN_1682 | 32387 | CTCN_6527 | 46446 |
| TTCN_1381 | 32388 | TTCN_5304 | 46447 |
| CTCN_1683 | 32389 | TTCN_5305 | 46448 |
| CTCN_1684 | 32390 | TTCN_5306 | 46449 |
| CTCN_1685 | 32391 | CTCN_6528 | 46450 |
| TTCN_1382 | 32392 | CTCN_6529 | 46451 |
| CTCN_1686 | 32393 | GTCN_3468 | 46452 |
| ATCN_931 | 32394 | GTCN_3469 | 46453 |
| CTCN_1687 | 32395 | TTCN_5307 | 46454 |

| | | | |
|---|---|---|---|
| TTCN_1383 | 32396 | CTCN_6530 | 46455 |
| CTCN_1688 | 32397 | ATCN_3692 | 46456 |
| CTCN_1689 | 32398 | ATCN_3693 | 46457 |
| TTCN_1384 | 32399 | ATCN_3694 | 46458 |
| TTCN_1385 | 32400 | CTCN_6531 | 46459 |
| TTCN_1386 | 32401 | CTCN_6532 | 46460 |
| CTCN_1690 | 32402 | ATCN_3695 | 46461 |
| GTCN_938 | 32403 | CTCN_6533 | 46462 |
| ATCN_932 | 32404 | ATCN_3696 | 46463 |
| TTCN_1387 | 32405 | ATCN_3697 | 46464 |
| ATCN_933 | 32406 | CTCN_6534 | 46465 |
| GTCN_939 | 32407 | CTCN_6535 | 46466 |
| CTCN_1691 | 32408 | ATCN_3698 | 46467 |
| CTCN_1692 | 32409 | TTCN_5308 | 46468 |
| CTCN_1693 | 32410 | TTCN_5309 | 46469 |
| CTCN_1694 | 32411 | TTCN_5310 | 46470 |
| CTCN_1695 | 32412 | GTCN_3470 | 46471 |
| CTCN_1696 | 32413 | GTCN_3471 | 46472 |
| ATCN_934 | 32414 | ATCN_3699 | 46473 |
| CTCN_1697 | 32415 | CTCN_6536 | 46474 |
| CTCN_1698 | 32416 | CTCN_6537 | 46475 |
| TTCN_1388 | 32417 | TTCN_5311 | 46476 |
| GTCN_940 | 32418 | ATCN_3700 | 46477 |
| CTCN_1699 | 32419 | TTCN_5312 | 46478 |
| ATCN_935 | 32420 | TTCN_5313 | 46479 |
| CTCN_1700 | 32421 | ATCN_3701 | 46480 |
| CTCN_1701 | 32422 | TTCN_5314 | 46481 |
| CTCN_1702 | 32423 | TTCN_5315 | 46482 |
| TTCN_1389 | 32424 | TTCN_5316 | 46483 |
| ATCN_936 | 32425 | ATCN_3702 | 46484 |
| ATCN_937 | 32426 | TTCN_5317 | 46485 |
| TTCN_1390 | 32427 | TTCN_5318 | 46486 |
| CTCN_1703 | 32428 | CTCN_6538 | 46487 |
| GTCN_941 | 32429 | CTCN_6539 | 46488 |
| CTCN_1704 | 32430 | TTCN_5319 | 46489 |
| CTCN_1705 | 32431 | TTCN_5320 | 46490 |
| GTCN_942 | 32432 | CTCN_6540 | 46491 |
| ATCN_938 | 32433 | TTCN_5321 | 46492 |
| CTCN_1706 | 32434 | TTCN_5322 | 46493 |
| GTCN_943 | 32435 | TTCN_5323 | 46494 |
| CTCN_1707 | 32436 | TTCN_5324 | 46495 |
| CTCN_1708 | 32437 | TTCN_5325 | 46496 |
| GTCN_944 | 32438 | ATCN_3703 | 46497 |

FIG. 37 (continued)

| | | | |
|---|---|---|---|
| ATCN_939 | 32439 | GTCN_3472 | 46498 |
| CTCN_1709 | 32440 | TTCN_5326 | 46499 |
| ATCN_940 | 32441 | GTCN_3473 | 46500 |
| GTCN_945 | 32442 | TTCN_5327 | 46501 |
| CTCN_1710 | 32443 | ATCN_3704 | 46502 |
| GTCN_946 | 32444 | CTCN_6541 | 46503 |
| CTCN_1711 | 32445 | CTCN_6542 | 46504 |
| CTCN_1712 | 32446 | TTCN_5328 | 46505 |
| GTCN_947 | 32447 | ATCN_3705 | 46506 |
| GTCN_948 | 32448 | GTCN_3474 | 46507 |
| CTCN_1713 | 32449 | CTCN_6543 | 46508 |
| GTCN_949 | 32450 | GTCN_3475 | 46509 |
| TTCN_1391 | 32451 | CTCN_6544 | 46510 |
| CTCN_1714 | 32452 | GTCN_3476 | 46511 |
| GTCN_950 | 32453 | TTCN_5329 | 46512 |
| TTCN_1392 | 32454 | CTCN_6545 | 46513 |
| CTCN_1715 | 32455 | TTCN_5330 | 46514 |
| GTCN_951 | 32456 | TTCN_5331 | 46515 |
| CTCN_1716 | 32457 | GTCN_3477 | 46516 |
| ATCN_941 | 32458 | TTCN_5332 | 46517 |
| CTCN_1717 | 32459 | GTCN_3478 | 46518 |
| TTCN_1393 | 32460 | CTCN_6546 | 46519 |
| GTCN_952 | 32461 | ATCN_3706 | 46520 |
| TTCN_1394 | 32462 | GTCN_3479 | 46521 |
| TTCN_1395 | 32463 | CTCN_6547 | 46522 |
| TTCN_1396 | 32464 | CTCN_6548 | 46523 |
| TTCN_1397 | 32465 | ATCN_3707 | 46524 |
| TTCN_1398 | 32466 | TTCN_5333 | 46525 |
| TTCN_1399 | 32467 | CTCN_6549 | 46526 |
| TTCN_1400 | 32468 | TTCN_5334 | 46527 |
| CTCN_1718 | 32469 | CTCN_6550 | 46528 |
| TTCN_1401 | 32470 | TTCN_5335 | 46529 |
| CTCN_1719 | 32471 | GTCN_3480 | 46530 |
| TTCN_1402 | 32472 | ATCN_3708 | 46531 |
| TTCN_1403 | 32473 | ATCN_3709 | 46532 |
| ATCN_942 | 32474 | CTCN_6551 | 46533 |
| CTCN_1720 | 32475 | ATCN_3710 | 46534 |
| GTCN_953 | 32476 | CTCN_6552 | 46535 |
| CTCN_1721 | 32477 | ATCN_3711 | 46536 |
| CTCN_1722 | 32478 | ATCN_3712 | 46537 |
| ATCN_943 | 32479 | CTCN_6553 | 46538 |
| TTCN_1404 | 32480 | CTCN_6554 | 46539 |
| CTCN_1723 | 32481 | CTCN_6555 | 46540 |

| | | | |
|---|---|---|---|
| GTCN_954 | 32482 | CTCN_6556 | 46541 |
| CTCN_1724 | 32483 | TTCN_5336 | 46542 |
| CTCN_1725 | 32484 | GTCN_3481 | 46543 |
| CTCN_1726 | 32485 | TTCN_5337 | 46544 |
| CTCN_1727 | 32486 | GTCN_3482 | 46545 |
| ATCN_944 | 32487 | CTCN_6557 | 46546 |
| TTCN_1405 | 32488 | GTCN_3483 | 46547 |
| ATCN_945 | 32489 | CTCN_6558 | 46548 |
| CTCN_1728 | 32490 | CTCN_6559 | 46549 |
| CTCN_1729 | 32491 | CTCN_6560 | 46550 |
| TTCN_1406 | 32492 | TTCN_5338 | 46551 |
| CTCN_1730 | 32493 | ATCN_3713 | 46552 |
| GTCN_955 | 32494 | GTCN_3484 | 46553 |
| CTCN_1731 | 32495 | TTCN_5339 | 46554 |
| CTCN_1732 | 32496 | GTCN_3485 | 46555 |
| ATCN_946 | 32497 | CTCN_6561 | 46556 |
| GTCN_956 | 32498 | CTCN_6562 | 46557 |
| GTCN_957 | 32499 | ATCN_3714 | 46558 |
| CTCN_1733 | 32500 | CTCN_6563 | 46559 |
| ATCN_947 | 32501 | GTCN_3486 | 46560 |
| ATCN_948 | 32502 | CTCN_6564 | 46561 |
| CTCN_1734 | 32503 | TTCN_5340 | 46562 |
| ATCN_949 | 32504 | GTCN_3487 | 46563 |
| TTCN_1407 | 32505 | TTCN_5341 | 46564 |
| CTCN_1735 | 32506 | ATCN_3715 | 46565 |
| CTCN_1736 | 32507 | CTCN_6565 | 46566 |
| ATCN_950 | 32508 | TTCN_5342 | 46567 |
| CTCN_1737 | 32509 | CTCN_6566 | 46568 |
| TTCN_1408 | 32510 | ATCN_3716 | 46569 |
| TTCN_1409 | 32511 | ATCN_3717 | 46570 |
| CTCN_1738 | 32512 | TTCN_5343 | 46571 |
| CTCN_1739 | 32513 | TTCN_5344 | 46572 |
| TTCN_1410 | 32514 | GTCN_3488 | 46573 |
| TTCN_1411 | 32515 | CTCN_6567 | 46574 |
| TTCN_1412 | 32516 | GTCN_3489 | 46575 |
| ATCN_951 | 32517 | TTCN_5345 | 46576 |
| ATCN_952 | 32518 | ATCN_3718 | 46577 |
| ATCN_953 | 32519 | ATCN_3719 | 46578 |
| CTCN_1740 | 32520 | TTCN_5346 | 46579 |
| ATCN_954 | 32521 | TTCN_5347 | 46580 |
| TTCN_1413 | 32522 | TTCN_5348 | 46581 |
| TTCN_1414 | 32523 | GTCN_3490 | 46582 |
| CTCN_1741 | 32524 | TTCN_5349 | 46583 |

FIG. 37 (continued)

| | | | |
|---|---|---|---|
| ATCN_955 | 32525 | ATCN_3720 | 46584 |
| TTCN_1415 | 32526 | ATCN_3721 | 46585 |
| GTCN_958 | 32527 | CTCN_6568 | 46586 |
| CTCN_1742 | 32528 | CTCN_6569 | 46587 |
| TTCN_1416 | 32529 | CTCN_6570 | 46588 |
| ATCN_956 | 32530 | TTCN_5350 | 46589 |
| CTCN_1743 | 32531 | GTCN_3491 | 46590 |
| TTCN_1417 | 32532 | CTCN_6571 | 46591 |
| CTCN_1744 | 32533 | CTCN_6572 | 46592 |
| ATCN_957 | 32534 | GTCN_3492 | 46593 |
| TTCN_1418 | 32535 | CTCN_6573 | 46594 |
| TTCN_1419 | 32536 | TTCN_5351 | 46595 |
| TTCN_1420 | 32537 | TTCN_5352 | 46596 |
| TTCN_1421 | 32538 | CTCN_6574 | 46597 |
| GTCN_959 | 32539 | CTCN_6575 | 46598 |
| TTCN_1422 | 32540 | TTCN_5353 | 46599 |
| TTCN_1423 | 32541 | GTCN_3493 | 46600 |
| CTCN_1745 | 32542 | ATCN_3722 | 46601 |
| ATCN_958 | 32543 | CTCN_6576 | 46602 |
| ATCN_959 | 32544 | CTCN_6577 | 46603 |
| CTCN_1746 | 32545 | ATCN_3723 | 46604 |
| TTCN_1424 | 32546 | TTCN_5354 | 46605 |
| GTCN_960 | 32547 | CTCN_6578 | 46606 |
| TTCN_1425 | 32548 | TTCN_5355 | 46607 |
| GTCN_961 | 32549 | CTCN_6579 | 46608 |
| CTCN_1747 | 32550 | TTCN_5356 | 46609 |
| GTCN_962 | 32551 | TTCN_5357 | 46610 |
| CTCN_1748 | 32552 | ATCN_3724 | 46611 |
| CTCN_1749 | 32553 | ATCN_3725 | 46612 |
| TTCN_1426 | 32554 | CTCN_6580 | 46613 |
| ATCN_960 | 32555 | GTCN_3494 | 46614 |
| TTCN_1427 | 32556 | TTCN_5358 | 46615 |
| CTCN_1750 | 32557 | CTCN_6581 | 46616 |
| TTCN_1428 | 32558 | GTCN_3495 | 46617 |
| ATCN_961 | 32559 | ATCN_3726 | 46618 |
| GTCN_963 | 32560 | ATCN_3727 | 46619 |
| CTCN_1751 | 32561 | TTCN_5359 | 46620 |
| CTCN_1752 | 32562 | GTCN_3496 | 46621 |
| TTCN_1429 | 32563 | ATCN_3728 | 46622 |
| ATCN_962 | 32564 | CTCN_6582 | 46623 |
| ATCN_963 | 32565 | GTCN_3497 | 46624 |
| ATCN_964 | 32566 | TTCN_5360 | 46625 |
| GTCN_964 | 32567 | GTCN_3498 | 46626 |
| CTCN_1753 | 32568 | CTCN_6583 | 46627 |
| CTCN_1754 | 32569 | CTCN_6584 | 46628 |
| CTCN_1755 | 32570 | TTCN_5361 | 46629 |
| GTCN_965 | 32571 | TTCN_5362 | 46630 |
| TTCN_1430 | 32572 | ATCN_3729 | 46631 |
| CTCN_1756 | 32573 | CTCN_6585 | 46632 |
| TTCN_1431 | 32574 | GTCN_3499 | 46633 |
| TTCN_1432 | 32575 | TTCN_5363 | 46634 |
| GTCN_966 | 32576 | GTCN_3500 | 46635 |
| ATCN_965 | 32577 | TTCN_5364 | 46636 |
| TTCN_1433 | 32578 | TTCN_5365 | 46637 |
| ATCN_966 | 32579 | GTCN_3501 | 46638 |
| GTCN_967 | 32580 | GTCN_3502 | 46639 |
| TTCN_1434 | 32581 | ATCN_3730 | 46640 |
| GTCN_968 | 32582 | CTCN_6586 | 46641 |
| GTCN_969 | 32583 | CTCN_6587 | 46642 |
| ATCN_967 | 32584 | GTCN_3503 | 46643 |
| ATCN_968 | 32585 | GTCN_3504 | 46644 |
| GTCN_970 | 32586 | GTCN_3505 | 46645 |
| GTCN_971 | 32587 | TTCN_5366 | 46646 |
| GTCN_972 | 32588 | GTCN_3506 | 46647 |
| ATCN_969 | 32589 | TTCN_5367 | 46648 |
| TTCN_1435 | 32590 | CTCN_6588 | 46649 |
| CTCN_1757 | 32591 | CTCN_6589 | 46650 |
| TTCN_1436 | 32592 | ATCN_3731 | 46651 |
| TTCN_1437 | 32593 | TTCN_5368 | 46652 |
| TTCN_1438 | 32594 | CTCN_6590 | 46653 |
| TTCN_1439 | 32595 | CTCN_6591 | 46654 |
| ATCN_970 | 32596 | CTCN_6592 | 46655 |
| GTCN_973 | 32597 | CTCN_6593 | 46656 |
| TTCN_1440 | 32598 | TTCN_5369 | 46657 |
| GTCN_974 | 32599 | CTCN_6594 | 46658 |
| TTCN_1441 | 32600 | ATCN_3732 | 46659 |
| CTCN_1758 | 32601 | CTCN_6595 | 46660 |
| CTCN_1759 | 32602 | CTCN_6596 | 46661 |
| GTCN_975 | 32603 | CTCN_6597 | 46662 |
| TTCN_1442 | 32604 | CTCN_6598 | 46663 |
| ATCN_971 | 32605 | GTCN_3507 | 46664 |
| ATCN_972 | 32606 | TTCN_5370 | 46665 |
| TTCN_1443 | 32607 | GTCN_3508 | 46666 |
| ATCN_973 | 32608 | GTCN_3509 | 46667 |
| CTCN_1760 | 32609 | GTCN_3510 | 46668 |
| TTCN_1444 | 32610 | CTCN_6599 | 46669 |

FIG. 37 (continued)

| | | | |
|---|---|---|---|
| CTCN_1761 | 32611 | GTCN_3511 | 46670 |
| CTCN_1762 | 32612 | CTCN_6600 | 46671 |
| GTCN_976 | 32613 | TTCN_5371 | 46672 |
| GTCN_977 | 32614 | TTCN_5372 | 46673 |
| ATCN_974 | 32615 | ATCN_3733 | 46674 |
| TTCN_1445 | 32616 | TTCN_5373 | 46675 |
| TTCN_1446 | 32617 | GTCN_3512 | 46676 |
| CTCN_1763 | 32618 | TTCN_5374 | 46677 |
| TTCN_1447 | 32619 | CTCN_6601 | 46678 |
| TTCN_1448 | 32620 | CTCN_6602 | 46679 |
| CTCN_1764 | 32621 | TTCN_5375 | 46680 |
| TTCN_1449 | 32622 | ATCN_3734 | 46681 |
| GTCN_978 | 32623 | ATCN_3735 | 46682 |
| TTCN_1450 | 32624 | CTCN_6603 | 46683 |
| TTCN_1451 | 32625 | GTCN_3513 | 46684 |
| CTCN_1765 | 32626 | CTCN_6604 | 46685 |
| TTCN_1452 | 32627 | GTCN_3514 | 46686 |
| ATCN_975 | 32628 | TTCN_5376 | 46687 |
| CTCN_1766 | 32629 | GTCN_3515 | 46688 |
| TTCN_1453 | 32630 | TTCN_5377 | 46689 |
| TTCN_1454 | 32631 | CTCN_6605 | 46690 |
| TTCN_1455 | 32632 | GTCN_3516 | 46691 |
| CTCN_1767 | 32633 | TTCN_5378 | 46692 |
| TTCN_1456 | 32634 | CTCN_6606 | 46693 |
| CTCN_1768 | 32635 | CTCN_6607 | 46694 |
| TTCN_1457 | 32636 | ATCN_3736 | 46695 |
| ATCN_976 | 32637 | GTCN_3517 | 46696 |
| CTCN_1769 | 32638 | CTCN_6608 | 46697 |
| CTCN_1770 | 32639 | CTCN_6609 | 46698 |
| TTCN_1458 | 32640 | CTCN_6610 | 46699 |
| CTCN_1771 | 32641 | CTCN_6611 | 46700 |
| TTCN_1459 | 32642 | CTCN_6612 | 46701 |
| TTCN_1460 | 32643 | CTCN_6613 | 46702 |
| CTCN_1772 | 32644 | CTCN_6614 | 46703 |
| GTCN_979 | 32645 | TTCN_5379 | 46704 |
| CTCN_1773 | 32646 | CTCN_6615 | 46705 |
| GTCN_980 | 32647 | CTCN_6616 | 46706 |
| CTCN_1774 | 32648 | GTCN_3518 | 46707 |
| CTCN_1775 | 32649 | ATCN_3737 | 46708 |
| CTCN_1776 | 32650 | GTCN_3519 | 46709 |
| CTCN_1777 | 32651 | GTCN_3520 | 46710 |
| ATCN_977 | 32652 | ATCN_3738 | 46711 |
| ATCN_978 | 32653 | ATCN_3739 | 46712 |

| | | | |
|---|---|---|---|
| CTCN_1778 | 32654 | CTCN_6617 | 46713 |
| CTCN_1779 | 32655 | GTCN_3521 | 46714 |
| CTCN_1780 | 32656 | TTCN_5380 | 46715 |
| CTCN_1781 | 32657 | CTCN_6618 | 46716 |
| TTCN_1461 | 32658 | CTCN_6619 | 46717 |
| TTCN_1462 | 32659 | GTCN_3522 | 46718 |
| CTCN_1782 | 32660 | GTCN_3523 | 46719 |
| CTCN_1783 | 32661 | ATCN_3740 | 46720 |
| CTCN_1784 | 32662 | CTCN_6620 | 46721 |
| ATCN_979 | 32663 | ATCN_3741 | 46722 |
| CTCN_1785 | 32664 | ATCN_3742 | 46723 |
| GTCN_981 | 32665 | ATCN_3743 | 46724 |
| TTCN_1463 | 32666 | CTCN_6621 | 46725 |
| GTCN_982 | 32667 | TTCN_5381 | 46726 |
| CTCN_1786 | 32668 | CTCN_6622 | 46727 |
| TTCN_1464 | 32669 | TTCN_5382 | 46728 |
| CTCN_1787 | 32670 | ATCN_3744 | 46729 |
| GTCN_983 | 32671 | TTCN_5383 | 46730 |
| CTCN_1788 | 32672 | ATCN_3745 | 46731 |
| ATCN_980 | 32673 | ATCN_3746 | 46732 |
| ATCN_981 | 32674 | TTCN_5384 | 46733 |
| CTCN_1789 | 32675 | ATCN_3747 | 46734 |
| ATCN_982 | 32676 | ATCN_3748 | 46735 |
| CTCN_1790 | 32677 | CTCN_6623 | 46736 |
| ATCN_983 | 32678 | ATCN_3749 | 46737 |
| CTCN_1791 | 32679 | TTCN_5385 | 46738 |
| TTCN_1465 | 32680 | ATCN_3750 | 46739 |
| TTCN_1466 | 32681 | ATCN_3751 | 46740 |
| ATCN_984 | 32682 | ATCN_3752 | 46741 |
| TTCN_1467 | 32683 | TTCN_5386 | 46742 |
| ATCN_985 | 32684 | GTCN_3524 | 46743 |
| GTCN_984 | 32685 | ATCN_3753 | 46744 |
| TTCN_1468 | 32686 | GTCN_3525 | 46745 |
| CTCN_1792 | 32687 | GTCN_3526 | 46746 |
| ATCN_986 | 32688 | CTCN_6624 | 46747 |
| TTCN_1469 | 32689 | CTCN_6625 | 46748 |
| TTCN_1470 | 32690 | CTCN_6626 | 46749 |
| CTCN_1793 | 32691 | TTCN_5387 | 46750 |
| TTCN_1471 | 32692 | CTCN_6627 | 46751 |
| TTCN_1472 | 32693 | ATCN_3754 | 46752 |
| CTCN_1794 | 32694 | GTCN_3527 | 46753 |
| CTCN_1795 | 32695 | ATCN_3755 | 46754 |
| ATCN_987 | 32696 | ATCN_3756 | 46755 |

FIG. 37 (continued)

| | | | |
|---|---|---|---|
| TTCN_1473 | 32697 | GTCN_3528 | 46756 |
| CTCN_1796 | 32698 | CTCN_6628 | 46757 |
| CTCN_1797 | 32699 | TTCN_5388 | 46758 |
| GTCN_985 | 32700 | CTCN_6629 | 46759 |
| ATCN_988 | 32701 | CTCN_6630 | 46760 |
| CTCN_1798 | 32702 | GTCN_3529 | 46761 |
| TTCN_1474 | 32703 | GTCN_3530 | 46762 |
| TTCN_1475 | 32704 | CTCN_6631 | 46763 |
| ATCN_989 | 32705 | CTCN_6632 | 46764 |
| ATCN_990 | 32706 | TTCN_5389 | 46765 |
| TTCN_1476 | 32707 | TTCN_5390 | 46766 |
| TTCN_1477 | 32708 | GTCN_3531 | 46767 |
| TTCN_1478 | 32709 | GTCN_3532 | 46768 |
| CTCN_1799 | 32710 | ATCN_3757 | 46769 |
| TTCN_1479 | 32711 | TTCN_5391 | 46770 |
| TTCN_1480 | 32712 | CTCN_6633 | 46771 |
| GTCN_986 | 32713 | CTCN_6634 | 46772 |
| ATCN_991 | 32714 | ATCN_3758 | 46773 |
| CTCN_1800 | 32715 | ATCN_3759 | 46774 |
| TTCN_1481 | 32716 | TTCN_5392 | 46775 |
| TTCN_1482 | 32717 | GTCN_3533 | 46776 |
| TTCN_1483 | 32718 | TTCN_5393 | 46777 |
| TTCN_1484 | 32719 | TTCN_5394 | 46778 |
| TTCN_1485 | 32720 | ATCN_3760 | 46779 |
| TTCN_1486 | 32721 | TTCN_5395 | 46780 |
| ATCN_992 | 32722 | TTCN_5396 | 46781 |
| ATCN_993 | 32723 | ATCN_3761 | 46782 |
| TTCN_1487 | 32724 | TTCN_5397 | 46783 |
| TTCN_1488 | 32725 | ATCN_3762 | 46784 |
| GTCN_987 | 32726 | CTCN_6635 | 46785 |
| GTCN_988 | 32727 | CTCN_6636 | 46786 |
| TTCN_1489 | 32728 | ATCN_3763 | 46787 |
| TTCN_1490 | 32729 | TTCN_5398 | 46788 |
| CTCN_1801 | 32730 | GTCN_3534 | 46789 |
| GTCN_989 | 32731 | TTCN_5399 | 46790 |
| CTCN_1802 | 32732 | ATCN_3764 | 46791 |
| TTCN_1491 | 32733 | TTCN_5400 | 46792 |
| GTCN_990 | 32734 | TTCN_5401 | 46793 |
| TTCN_1492 | 32735 | GTCN_3535 | 46794 |
| TTCN_1493 | 32736 | CTCN_6637 | 46795 |
| GTCN_991 | 32737 | TTCN_5402 | 46796 |
| TTCN_1494 | 32738 | TTCN_5403 | 46797 |
| ATCN_994 | 32739 | GTCN_3536 | 46798 |

| | | | |
|---|---|---|---|
| TTCN_1495 | 32740 | TTCN_5404 | 46799 |
| ATCN_995 | 32741 | TTCN_5405 | 46800 |
| TTCN_1496 | 32742 | TTCN_5406 | 46801 |
| ATCN_996 | 32743 | ATCN_3765 | 46802 |
| ATCN_997 | 32744 | ATCN_3766 | 46803 |
| GTCN_992 | 32745 | TTCN_5407 | 46804 |
| TTCN_1497 | 32746 | TTCN_5408 | 46805 |
| GTCN_993 | 32747 | TTCN_5409 | 46806 |
| TTCN_1498 | 32748 | TTCN_5410 | 46807 |
| TTCN_1499 | 32749 | ATCN_3767 | 46808 |
| TTCN_1500 | 32750 | ATCN_3768 | 46809 |
| TTCN_1501 | 32751 | ATCN_3769 | 46810 |
| GTCN_994 | 32752 | CTCN_6638 | 46811 |
| CTCN_1803 | 32753 | GTCN_3537 | 46812 |
| TTCN_1502 | 32754 | TTCN_5411 | 46813 |
| GTCN_995 | 32755 | CTCN_6639 | 46814 |
| CTCN_1804 | 32756 | ATCN_3770 | 46815 |
| GTCN_996 | 32757 | GTCN_3538 | 46816 |
| CTCN_1805 | 32758 | TTCN_5412 | 46817 |
| GTCN_997 | 32759 | TTCN_5413 | 46818 |
| ATCN_998 | 32760 | TTCN_5414 | 46819 |
| TTCN_1503 | 32761 | GTCN_3539 | 46820 |
| CTCN_1806 | 32762 | GTCN_3540 | 46821 |
| TTCN_1504 | 32763 | CTCN_6640 | 46822 |
| TTCN_1505 | 32764 | GTCN_3541 | 46823 |
| ATCN_999 | 32765 | CTCN_6641 | 46824 |
| CTCN_1807 | 32766 | CTCN_6642 | 46825 |
| TTCN_1506 | 32767 | GTCN_3542 | 46826 |
| GTCN_998 | 32768 | CTCN_6643 | 46827 |
| ATCN_1000 | 32769 | ATCN_3771 | 46828 |
| GTCN_999 | 32770 | CTCN_6644 | 46829 |
| TTCN_1507 | 32771 | TTCN_5415 | 46830 |
| GTCN_1000 | 32772 | ATCN_3772 | 46831 |
| CTCN_1808 | 32773 | TTCN_5416 | 46832 |
| GTCN_1001 | 32774 | GTCN_3543 | 46833 |
| TTCN_1508 | 32775 | CTCN_6645 | 46834 |
| TTCN_1509 | 32776 | TTCN_5417 | 46835 |
| TTCN_1510 | 32777 | ATCN_3773 | 46836 |
| GTCN_1002 | 32778 | ATCN_3774 | 46837 |
| CTCN_1809 | 32779 | CTCN_6646 | 46838 |
| GTCN_1003 | 32780 | CTCN_6647 | 46839 |
| ATCN_1001 | 32781 | GTCN_3544 | 46840 |
| ATCN_1002 | 32782 | CTCN_6648 | 46841 |

FIG. 37 (continued)

| | | | |
|---|---|---|---|
| CTCN_1810 | 32783 | GTCN_3545 | 46842 |
| GTCN_1004 | 32784 | ATCN_3775 | 46843 |
| GTCN_1005 | 32785 | CTCN_6649 | 46844 |
| GTCN_1006 | 32786 | CTCN_6650 | 46845 |
| CTCN_1811 | 32787 | TTCN_5418 | 46846 |
| CTCN_1812 | 32788 | GTCN_3546 | 46847 |
| ATCN_1003 | 32789 | CTCN_6651 | 46848 |
| TTCN_1511 | 32790 | CTCN_6652 | 46849 |
| ATCN_1004 | 32791 | CTCN_6653 | 46850 |
| TTCN_1512 | 32792 | GTCN_3547 | 46851 |
| TTCN_1513 | 32793 | TTCN_5419 | 46852 |
| TTCN_1514 | 32794 | CTCN_6654 | 46853 |
| GTCN_1007 | 32795 | CTCN_6655 | 46854 |
| ATCN_1005 | 32796 | CTCN_6656 | 46855 |
| ATCN_1006 | 32797 | GTCN_3548 | 46856 |
| ATCN_1007 | 32798 | CTCN_6657 | 46857 |
| ATCN_1008 | 32799 | ATCN_3776 | 46858 |
| GTCN_1008 | 32800 | TTCN_5420 | 46859 |
| TTCN_1515 | 32801 | CTCN_6658 | 46860 |
| CTCN_1813 | 32802 | GTCN_3549 | 46861 |
| TTCN_1516 | 32803 | GTCN_3550 | 46862 |
| CTCN_1814 | 32804 | TTCN_5421 | 46863 |
| TTCN_1517 | 32805 | GTCN_3551 | 46864 |
| GTCN_1009 | 32806 | CTCN_6659 | 46865 |
| TTCN_1518 | 32807 | GTCN_3552 | 46866 |
| GTCN_1010 | 32808 | CTCN_6660 | 46867 |
| GTCN_1011 | 32809 | ATCN_3777 | 46868 |
| ATCN_1009 | 32810 | CTCN_6661 | 46869 |
| TTCN_1519 | 32811 | TTCN_5422 | 46870 |
| TTCN_1520 | 32812 | CTCN_6662 | 46871 |
| GTCN_1012 | 32813 | CTCN_6663 | 46872 |
| TTCN_1521 | 32814 | TTCN_5423 | 46873 |
| GTCN_1013 | 32815 | GTCN_3553 | 46874 |
| TTCN_1522 | 32816 | TTCN_5424 | 46875 |
| TTCN_1523 | 32817 | TTCN_5425 | 46876 |
| GTCN_1014 | 32818 | TTCN_5426 | 46877 |
| TTCN_1524 | 32819 | CTCN_6664 | 46878 |
| TTCN_1525 | 32820 | ATCN_3778 | 46879 |
| ATCN_1010 | 32821 | TTCN_5427 | 46880 |
| ATCN_1011 | 32822 | ATCN_3779 | 46881 |
| TTCN_1526 | 32823 | GTCN_3554 | 46882 |
| TTCN_1527 | 32824 | ATCN_3780 | 46883 |
| GTCN_1015 | 32825 | GTCN_3555 | 46884 |

| | | | |
|---|---|---|---|
| ATCN_1012 | 32826 | CTCN_6665 | 46885 |
| TTCN_1528 | 32827 | ATCN_3781 | 46886 |
| ATCN_1013 | 32828 | GTCN_3556 | 46887 |
| TTCN_1529 | 32829 | TTCN_5428 | 46888 |
| TTCN_1530 | 32830 | CTCN_6666 | 46889 |
| ATCN_1014 | 32831 | TTCN_5429 | 46890 |
| CTCN_1815 | 32832 | TTCN_5430 | 46891 |
| TTCN_1531 | 32833 | TTCN_5431 | 46892 |
| CTCN_1816 | 32834 | TTCN_5432 | 46893 |
| TTCN_1532 | 32835 | TTCN_5433 | 46894 |
| TTCN_1533 | 32836 | TTCN_5434 | 46895 |
| TTCN_1534 | 32837 | TTCN_5435 | 46896 |
| GTCN_1016 | 32838 | TTCN_5436 | 46897 |
| TTCN_1535 | 32839 | TTCN_5437 | 46898 |
| GTCN_1017 | 32840 | CTCN_6667 | 46899 |
| TTCN_1536 | 32841 | ATCN_3782 | 46900 |
| TTCN_1537 | 32842 | TTCN_5438 | 46901 |
| CTCN_1817 | 32843 | CTCN_6668 | 46902 |
| GTCN_1018 | 32844 | GTCN_3557 | 46903 |
| CTCN_1818 | 32845 | TTCN_5439 | 46904 |
| ATCN_1015 | 32846 | GTCN_3558 | 46905 |
| ATCN_1016 | 32847 | TTCN_5440 | 46906 |
| ATCN_1017 | 32848 | ATCN_3783 | 46907 |
| TTCN_1538 | 32849 | TTCN_5441 | 46908 |
| CTCN_1819 | 32850 | GTCN_3559 | 46909 |
| TTCN_1539 | 32851 | CTCN_6669 | 46910 |
| GTCN_1019 | 32852 | GTCN_3560 | 46911 |
| TTCN_1540 | 32853 | ATCN_3784 | 46912 |
| GTCN_1020 | 32854 | TTCN_5442 | 46913 |
| ATCN_1018 | 32855 | TTCN_5443 | 46914 |
| GTCN_1021 | 32856 | GTCN_3561 | 46915 |
| TTCN_1541 | 32857 | CTCN_6670 | 46916 |
| CTCN_1820 | 32858 | TTCN_5444 | 46917 |
| ATCN_1019 | 32859 | GTCN_3562 | 46918 |
| ATCN_1020 | 32860 | TTCN_5445 | 46919 |
| TTCN_1542 | 32861 | CTCN_6671 | 46920 |
| ATCN_1021 | 32862 | CTCN_6672 | 46921 |
| ATCN_1022 | 32863 | TTCN_5446 | 46922 |
| GTCN_1022 | 32864 | GTCN_3563 | 46923 |
| TTCN_1543 | 32865 | ATCN_3785 | 46924 |
| TTCN_1544 | 32866 | ATCN_3786 | 46925 |
| CTCN_1821 | 32867 | ATCN_3787 | 46926 |
| TTCN_1545 | 32868 | ATCN_3788 | 46927 |

FIG. 37 (continued)

| | | | |
|---|---|---|---|
| TTCN_1546 | 32869 | TTCN_5447 | 46928 |
| TTCN_1547 | 32870 | ATCN_3789 | 46929 |
| ATCN_1023 | 32871 | ATCN_3790 | 46930 |
| CTCN_1822 | 32872 | ATCN_3791 | 46931 |
| TTCN_1548 | 32873 | CTCN_6673 | 46932 |
| TTCN_1549 | 32874 | TTCN_5448 | 46933 |
| TTCN_1550 | 32875 | CTCN_6674 | 46934 |
| CTCN_1823 | 32876 | TTCN_5449 | 46935 |
| TTCN_1551 | 32877 | GTCN_3564 | 46936 |
| ATCN_1024 | 32878 | CTCN_6675 | 46937 |
| CTCN_1824 | 32879 | CTCN_6676 | 46938 |
| TTCN_1552 | 32880 | CTCN_6677 | 46939 |
| GTCN_1023 | 32881 | TTCN_5450 | 46940 |
| CTCN_1825 | 32882 | ATCN_3792 | 46941 |
| GTCN_1024 | 32883 | TTCN_5451 | 46942 |
| CTCN_1826 | 32884 | TTCN_5452 | 46943 |
| TTCN_1553 | 32885 | ATCN_3793 | 46944 |
| GTCN_1025 | 32886 | TTCN_5453 | 46945 |
| CTCN_1827 | 32887 | TTCN_5454 | 46946 |
| TTCN_1554 | 32888 | CTCN_6678 | 46947 |
| TTCN_1555 | 32889 | TTCN_5455 | 46948 |
| TTCN_1556 | 32890 | TTCN_5456 | 46949 |
| ATCN_1025 | 32891 | CTCN_6679 | 46950 |
| GTCN_1026 | 32892 | CTCN_6680 | 46951 |
| CTCN_1828 | 32893 | TTCN_5457 | 46952 |
| CTCN_1829 | 32894 | ATCN_3794 | 46953 |
| TTCN_1557 | 32895 | ATCN_3795 | 46954 |
| TTCN_1558 | 32896 | CTCN_6681 | 46955 |
| TTCN_1559 | 32897 | CTCN_6682 | 46956 |
| TTCN_1560 | 32898 | TTCN_5458 | 46957 |
| TTCN_1561 | 32899 | CTCN_6683 | 46958 |
| ATCN_1026 | 32900 | ATCN_3796 | 46959 |
| ATCN_1027 | 32901 | CTCN_6684 | 46960 |
| CTCN_1830 | 32902 | TTCN_5459 | 46961 |
| TTCN_1562 | 32903 | ATCN_3797 | 46962 |
| CTCN_1831 | 32904 | TTCN_5460 | 46963 |
| GTCN_1027 | 32905 | ATCN_3798 | 46964 |
| TTCN_1563 | 32906 | TTCN_5461 | 46965 |
| CTCN_1832 | 32907 | ATCN_3799 | 46966 |
| GTCN_1028 | 32908 | CTCN_6685 | 46967 |
| TTCN_1564 | 32909 | ATCN_3800 | 46968 |
| ATCN_1028 | 32910 | ATCN_3801 | 46969 |
| TTCN_1565 | 32911 | CTCN_6686 | 46970 |

| | | | |
|---|---|---|---|
| CTCN_1833 | 32912 | ATCN_3802 | 46971 |
| ATCN_1029 | 32913 | TTCN_5462 | 46972 |
| CTCN_1834 | 32914 | TTCN_5463 | 46973 |
| GTCN_1029 | 32915 | ATCN_3803 | 46974 |
| GTCN_1030 | 32916 | CTCN_6687 | 46975 |
| TTCN_1566 | 32917 | GTCN_3565 | 46976 |
| ATCN_1030 | 32918 | GTCN_3566 | 46977 |
| ATCN_1031 | 32919 | ATCN_3804 | 46978 |
| CTCN_1835 | 32920 | TTCN_5464 | 46979 |
| ATCN_1032 | 32921 | GTCN_3567 | 46980 |
| GTCN_1031 | 32922 | GTCN_3568 | 46981 |
| TTCN_1567 | 32923 | ATCN_3805 | 46982 |
| TTCN_1568 | 32924 | ATCN_3806 | 46983 |
| CTCN_1836 | 32925 | ATCN_3807 | 46984 |
| GTCN_1032 | 32926 | ATCN_3808 | 46985 |
| CTCN_1837 | 32927 | TTCN_5465 | 46986 |
| GTCN_1033 | 32928 | ATCN_3809 | 46987 |
| CTCN_1838 | 32929 | TTCN_5466 | 46988 |
| GTCN_1034 | 32930 | GTCN_3569 | 46989 |
| CTCN_1839 | 32931 | GTCN_3570 | 46990 |
| ATCN_1033 | 32932 | CTCN_6688 | 46991 |
| ATCN_1034 | 32933 | CTCN_6689 | 46992 |
| CTCN_1840 | 32934 | TTCN_5467 | 46993 |
| CTCN_1841 | 32935 | GTCN_3571 | 46994 |
| CTCN_1842 | 32936 | TTCN_5468 | 46995 |
| TTCN_1569 | 32937 | CTCN_6690 | 46996 |
| TTCN_1570 | 32938 | ATCN_3810 | 46997 |
| CTCN_1843 | 32939 | TTCN_5469 | 46998 |
| TTCN_1571 | 32940 | CTCN_6691 | 46999 |
| CTCN_1844 | 32941 | GTCN_3572 | 47000 |
| GTCN_1035 | 32942 | GTCN_3573 | 47001 |
| TTCN_1572 | 32943 | CTCN_6692 | 47002 |
| TTCN_1573 | 32944 | GTCN_3574 | 47003 |
| CTCN_1845 | 32945 | GTCN_3575 | 47004 |
| GTCN_1036 | 32946 | CTCN_6693 | 47005 |
| TTCN_1574 | 32947 | ATCN_3811 | 47006 |
| GTCN_1037 | 32948 | ATCN_3812 | 47007 |
| CTCN_1846 | 32949 | ATCN_3813 | 47008 |
| TTCN_1575 | 32950 | CTCN_6694 | 47009 |
| CTCN_1847 | 32951 | TTCN_5470 | 47010 |
| GTCN_1038 | 32952 | CTCN_6695 | 47011 |
| CTCN_1848 | 32953 | CTCN_6696 | 47012 |
| ATCN_1035 | 32954 | ATCN_3814 | 47013 |

FIG. 37 (continued)

| | | | |
|---|---|---|---|
| ATCN_1036 | 32955 | CTCN_6697 | 47014 |
| CTCN_1849 | 32956 | CTCN_6698 | 47015 |
| ATCN_1037 | 32957 | TTCN_5471 | 47016 |
| CTCN_1850 | 32958 | ATCN_3815 | 47017 |
| TTCN_1576 | 32959 | ATCN_3816 | 47018 |
| CTCN_1851 | 32960 | TTCN_5472 | 47019 |
| ATCN_1038 | 32961 | GTCN_3576 | 47020 |
| CTCN_1852 | 32962 | TTCN_5473 | 47021 |
| GTCN_1039 | 32963 | ATCN_3817 | 47022 |
| CTCN_1853 | 32964 | CTCN_6699 | 47023 |
| ATCN_1039 | 32965 | CTCN_6700 | 47024 |
| CTCN_1854 | 32966 | ATCN_3818 | 47025 |
| GTCN_1040 | 32967 | ATCN_3819 | 47026 |
| CTCN_1855 | 32968 | TTCN_5474 | 47027 |
| GTCN_1041 | 32969 | TTCN_5475 | 47028 |
| CTCN_1856 | 32970 | TTCN_5476 | 47029 |
| GTCN_1042 | 32971 | CTCN_6701 | 47030 |
| GTCN_1043 | 32972 | GTCN_3577 | 47031 |
| CTCN_1857 | 32973 | TTCN_5477 | 47032 |
| ATCN_1040 | 32974 | CTCN_6702 | 47033 |
| CTCN_1858 | 32975 | CTCN_6703 | 47034 |
| CTCN_1859 | 32976 | TTCN_5478 | 47035 |
| TTCN_1577 | 32977 | TTCN_5479 | 47036 |
| TTCN_1578 | 32978 | CTCN_6704 | 47037 |
| ATCN_1041 | 32979 | GTCN_3578 | 47038 |
| TTCN_1579 | 32980 | GTCN_3579 | 47039 |
| ATCN_1042 | 32981 | TTCN_5480 | 47040 |
| ATCN_1043 | 32982 | GTCN_3580 | 47041 |
| ATCN_1044 | 32983 | GTCN_3581 | 47042 |
| CTCN_1860 | 32984 | TTCN_5481 | 47043 |
| GTCN_1044 | 32985 | GTCN_3582 | 47044 |
| TTCN_1580 | 32986 | TTCN_5482 | 47045 |
| GTCN_1045 | 32987 | GTCN_3583 | 47046 |
| GTCN_1046 | 32988 | GTCN_3584 | 47047 |
| CTCN_1861 | 32989 | TTCN_5483 | 47048 |
| TTCN_1581 | 32990 | TTCN_5484 | 47049 |
| ATCN_1045 | 32991 | CTCN_6705 | 47050 |
| CTCN_1862 | 32992 | TTCN_5485 | 47051 |
| TTCN_1582 | 32993 | CTCN_6706 | 47052 |
| GTCN_1047 | 32994 | ATCN_3820 | 47053 |
| TTCN_1583 | 32995 | CTCN_6707 | 47054 |
| CTCN_1863 | 32996 | TTCN_5486 | 47055 |
| TTCN_1584 | 32997 | ATCN_3821 | 47056 |

| | | | |
|---|---|---|---|
| ATCN_1046 | 32998 | TTCN_5487 | 47057 |
| ATCN_1047 | 32999 | ATCN_3822 | 47058 |
| CTCN_1864 | 33000 | ATCN_3823 | 47059 |
| ATCN_1048 | 33001 | ATCN_3824 | 47060 |
| CTCN_1865 | 33002 | GTCN_3585 | 47061 |
| TTCN_1585 | 33003 | GTCN_3586 | 47062 |
| ATCN_1049 | 33004 | TTCN_5488 | 47063 |
| ATCN_1050 | 33005 | CTCN_6708 | 47064 |
| CTCN_1866 | 33006 | TTCN_5489 | 47065 |
| GTCN_1048 | 33007 | TTCN_5490 | 47066 |
| CTCN_1867 | 33008 | ATCN_3825 | 47067 |
| TTCN_1586 | 33009 | CTCN_6709 | 47068 |
| GTCN_1049 | 33010 | TTCN_5491 | 47069 |
| GTCN_1050 | 33011 | CTCN_6710 | 47070 |
| ATCN_1051 | 33012 | GTCN_3587 | 47071 |
| TTCN_1587 | 33013 | ATCN_3826 | 47072 |
| GTCN_1051 | 33014 | CTCN_6711 | 47073 |
| CTCN_1868 | 33015 | ATCN_3827 | 47074 |
| CTCN_1869 | 33016 | ATCN_3828 | 47075 |
| ATCN_1052 | 33017 | TTCN_5492 | 47076 |
| CTCN_1870 | 33018 | TTCN_5493 | 47077 |
| CTCN_1871 | 33019 | GTCN_3588 | 47078 |
| ATCN_1053 | 33020 | TTCN_5494 | 47079 |
| ATCN_1054 | 33021 | TTCN_5495 | 47080 |
| TTCN_1588 | 33022 | TTCN_5496 | 47081 |
| GTCN_1052 | 33023 | CTCN_6712 | 47082 |
| CTCN_1872 | 33024 | TTCN_5497 | 47083 |
| ATCN_1055 | 33025 | TTCN_5498 | 47084 |
| ATCN_1056 | 33026 | CTCN_6713 | 47085 |
| CTCN_1873 | 33027 | TTCN_5499 | 47086 |
| GTCN_1053 | 33028 | CTCN_6714 | 47087 |
| ATCN_1057 | 33029 | TTCN_5500 | 47088 |
| TTCN_1589 | 33030 | TTCN_5501 | 47089 |
| ATCN_1058 | 33031 | TTCN_5502 | 47090 |
| CTCN_1874 | 33032 | GTCN_3589 | 47091 |
| CTCN_1875 | 33033 | TTCN_5503 | 47092 |
| GTCN_1054 | 33034 | ATCN_3829 | 47093 |
| CTCN_1876 | 33035 | TTCN_5504 | 47094 |
| CTCN_1877 | 33036 | TTCN_5505 | 47095 |
| CTCN_1878 | 33037 | TTCN_5506 | 47096 |
| CTCN_1879 | 33038 | TTCN_5507 | 47097 |
| TTCN_1590 | 33039 | TTCN_5508 | 47098 |
| TTCN_1591 | 33040 | GTCN_3590 | 47099 |

FIG. 37 (continued)

| | | | |
|---|---|---|---|
| CTCN_1880 | 33041 | GTCN_3591 | 47100 |
| CTCN_1881 | 33042 | CTCN_6715 | 47101 |
| CTCN_1882 | 33043 | GTCN_3592 | 47102 |
| CTCN_1883 | 33044 | CTCN_6716 | 47103 |
| ATCN_1059 | 33045 | ATCN_3830 | 47104 |
| ATCN_1060 | 33046 | TTCN_5509 | 47105 |
| CTCN_1884 | 33047 | GTCN_3593 | 47106 |
| GTCN_1055 | 33048 | GTCN_3594 | 47107 |
| CTCN_1885 | 33049 | TTCN_5510 | 47108 |
| GTCN_1056 | 33050 | TTCN_5511 | 47109 |
| CTCN_1886 | 33051 | TTCN_5512 | 47110 |
| GTCN_1057 | 33052 | CTCN_6717 | 47111 |
| CTCN_1887 | 33053 | GTCN_3595 | 47112 |
| ATCN_1061 | 33054 | CTCN_6718 | 47113 |
| TTCN_1592 | 33055 | CTCN_6719 | 47114 |
| CTCN_1888 | 33056 | TTCN_5513 | 47115 |
| CTCN_1889 | 33057 | TTCN_5514 | 47116 |
| CTCN_1890 | 33058 | CTCN_6720 | 47117 |
| TTCN_1593 | 33059 | TTCN_5515 | 47118 |
| ATCN_1062 | 33060 | CTCN_6721 | 47119 |
| CTCN_1891 | 33061 | CTCN_6722 | 47120 |
| TTCN_1594 | 33062 | TTCN_5516 | 47121 |
| CTCN_1892 | 33063 | CTCN_6723 | 47122 |
| GTCN_1058 | 33064 | GTCN_3596 | 47123 |
| CTCN_1893 | 33065 | CTCN_6724 | 47124 |
| CTCN_1894 | 33066 | TTCN_5517 | 47125 |
| GTCN_1059 | 33067 | ATCN_3831 | 47126 |
| CTCN_1895 | 33068 | CTCN_6725 | 47127 |
| CTCN_1896 | 33069 | CTCN_6726 | 47128 |
| CTCN_1897 | 33070 | ATCN_3832 | 47129 |
| GTCN_1060 | 33071 | CTCN_6727 | 47130 |
| TTCN_1595 | 33072 | GTCN_3597 | 47131 |
| GTCN_1061 | 33073 | CTCN_6728 | 47132 |
| CTCN_1898 | 33074 | CTCN_6729 | 47133 |
| ATCN_1063 | 33075 | CTCN_6730 | 47134 |
| ATCN_1064 | 33076 | CTCN_6731 | 47135 |
| CTCN_1899 | 33077 | CTCN_6732 | 47136 |
| ATCN_1065 | 33078 | CTCN_6733 | 47137 |
| TTCN_1596 | 33079 | CTCN_6734 | 47138 |
| ATCN_1066 | 33080 | CTCN_6735 | 47139 |
| CTCN_1900 | 33081 | TTCN_5518 | 47140 |
| TTCN_1597 | 33082 | GTCN_3598 | 47141 |
| CTCN_1901 | 33083 | GTCN_3599 | 47142 |

| | | | |
|---|---|---|---|
| GTCN_1062 | 33084 | TTCN_5519 | 47143 |
| CTCN_1902 | 33085 | TTCN_5520 | 47144 |
| TTCN_1598 | 33086 | GTCN_3600 | 47145 |
| ATCN_1067 | 33087 | ATCN_3833 | 47146 |
| TTCN_1599 | 33088 | TTCN_5521 | 47147 |
| ATCN_1068 | 33089 | TTCN_5522 | 47148 |
| CTCN_1903 | 33090 | TTCN_5523 | 47149 |
| GTCN_1063 | 33091 | GTCN_3601 | 47150 |
| TTCN_1600 | 33092 | CTCN_6736 | 47151 |
| ATCN_1069 | 33093 | TTCN_5524 | 47152 |
| CTCN_1904 | 33094 | TTCN_5525 | 47153 |
| GTCN_1064 | 33095 | ATCN_3834 | 47154 |
| TTCN_1601 | 33096 | CTCN_6737 | 47155 |
| ATCN_1070 | 33097 | TTCN_5526 | 47156 |
| ATCN_1071 | 33098 | TTCN_5527 | 47157 |
| TTCN_1602 | 33099 | CTCN_6738 | 47158 |
| GTCN_1065 | 33100 | ATCN_3835 | 47159 |
| CTCN_1905 | 33101 | TTCN_5528 | 47160 |
| GTCN_1066 | 33102 | ATCN_3836 | 47161 |
| CTCN_1906 | 33103 | GTCN_3602 | 47162 |
| TTCN_1603 | 33104 | TTCN_5529 | 47163 |
| TTCN_1604 | 33105 | ATCN_3837 | 47164 |
| ATCN_1072 | 33106 | TTCN_5530 | 47165 |
| TTCN_1605 | 33107 | TTCN_5531 | 47166 |
| GTCN_1067 | 33108 | GTCN_3603 | 47167 |
| CTCN_1907 | 33109 | GTCN_3604 | 47168 |
| TTCN_1606 | 33110 | TTCN_5532 | 47169 |
| ATCN_1073 | 33111 | ATCN_3838 | 47170 |
| CTCN_1908 | 33112 | CTCN_6739 | 47171 |
| GTCN_1068 | 33113 | TTCN_5533 | 47172 |
| CTCN_1909 | 33114 | ATCN_3839 | 47173 |
| TTCN_1607 | 33115 | TTCN_5534 | 47174 |
| CTCN_1910 | 33116 | GTCN_3605 | 47175 |
| ATCN_1074 | 33117 | TTCN_5535 | 47176 |
| CTCN_1911 | 33118 | TTCN_5536 | 47177 |
| TTCN_1608 | 33119 | TTCN_5537 | 47178 |
| GTCN_1069 | 33120 | TTCN_5538 | 47179 |
| TTCN_1609 | 33121 | CTCN_6740 | 47180 |
| ATCN_1075 | 33122 | ATCN_3840 | 47181 |
| ATCN_1076 | 33123 | ATCN_3841 | 47182 |
| TTCN_1610 | 33124 | CTCN_6741 | 47183 |
| ATCN_1077 | 33125 | ATCN_3842 | 47184 |
| CTCN_1912 | 33126 | TTCN_5539 | 47185 |

FIG. 37 (continued)

| | | | |
|---|---|---|---|
| TTCN_1611 | 33127 | TTCN_5540 | 47186 |
| TTCN_1612 | 33128 | CTCN_6742 | 47187 |
| CTCN_1913 | 33129 | GTCN_3606 | 47188 |
| ATCN_1078 | 33130 | TTCN_5541 | 47189 |
| CTCN_1914 | 33131 | CTCN_6743 | 47190 |
| TTCN_1613 | 33132 | ATCN_3843 | 47191 |
| CTCN_1915 | 33133 | ATCN_3844 | 47192 |
| CTCN_1916 | 33134 | TTCN_5542 | 47193 |
| GTCN_1070 | 33135 | CTCN_6744 | 47194 |
| CTCN_1917 | 33136 | ATCN_3845 | 47195 |
| CTCN_1918 | 33137 | GTCN_3607 | 47196 |
| CTCN_1919 | 33138 | GTCN_3608 | 47197 |
| TTCN_1614 | 33139 | ATCN_3846 | 47198 |
| ATCN_1079 | 33140 | CTCN_6745 | 47199 |
| TTCN_1615 | 33141 | CTCN_6746 | 47200 |
| CTCN_1920 | 33142 | GTCN_3609 | 47201 |
| CTCN_1921 | 33143 | CTCN_6747 | 47202 |
| CTCN_1922 | 33144 | ATCN_3847 | 47203 |
| TTCN_1616 | 33145 | GTCN_3610 | 47204 |
| CTCN_1923 | 33146 | TTCN_5543 | 47205 |
| GTCN_1071 | 33147 | CTCN_6748 | 47206 |
| TTCN_1617 | 33148 | TTCN_5544 | 47207 |
| GTCN_1072 | 33149 | TTCN_5545 | 47208 |
| CTCN_1924 | 33150 | TTCN_5546 | 47209 |
| TTCN_1618 | 33151 | ATCN_3848 | 47210 |
| CTCN_1925 | 33152 | TTCN_5547 | 47211 |
| GTCN_1073 | 33153 | ATCN_3849 | 47212 |
| CTCN_1926 | 33154 | TTCN_5548 | 47213 |
| ATCN_1080 | 33155 | GTCN_3611 | 47214 |
| ATCN_1081 | 33156 | ATCN_3850 | 47215 |
| CTCN_1927 | 33157 | CTCN_6749 | 47216 |
| GTCN_1074 | 33158 | GTCN_3612 | 47217 |
| CTCN_1928 | 33159 | CTCN_6750 | 47218 |
| ATCN_1082 | 33160 | GTCN_3613 | 47219 |
| CTCN_1929 | 33161 | TTCN_5549 | 47220 |
| CTCN_1930 | 33162 | TTCN_5550 | 47221 |
| TTCN_1619 | 33163 | TTCN_5551 | 47222 |
| GTCN_1075 | 33164 | TTCN_5552 | 47223 |
| ATCN_1083 | 33165 | ATCN_3851 | 47224 |
| TTCN_1620 | 33166 | GTCN_3614 | 47225 |
| TTCN_1621 | 33167 | CTCN_6751 | 47226 |
| GTCN_1076 | 33168 | CTCN_6752 | 47227 |
| ATCN_1084 | 33169 | CTCN_6753 | 47228 |

| | | | |
|---|---|---|---|
| CTCN_1931 | 33170 | CTCN_6754 | 47229 |
| CTCN_1932 | 33171 | TTCN_5553 | 47230 |
| TTCN_1622 | 33172 | GTCN_3615 | 47231 |
| CTCN_1933 | 33173 | ATCN_3852 | 47232 |
| CTCN_1934 | 33174 | CTCN_6755 | 47233 |
| GTCN_1077 | 33175 | GTCN_3616 | 47234 |
| CTCN_1935 | 33176 | ATCN_3853 | 47235 |
| CTCN_1936 | 33177 | TTCN_5554 | 47236 |
| CTCN_1937 | 33178 | TTCN_5555 | 47237 |
| CTCN_1938 | 33179 | CTCN_6756 | 47238 |
| TTCN_1623 | 33180 | ATCN_3854 | 47239 |
| GTCN_1078 | 33181 | CTCN_6757 | 47240 |
| CTCN_1939 | 33182 | GTCN_3617 | 47241 |
| TTCN_1624 | 33183 | CTCN_6758 | 47242 |
| TTCN_1625 | 33184 | GTCN_3618 | 47243 |
| ATCN_1085 | 33185 | CTCN_6759 | 47244 |
| GTCN_1079 | 33186 | ATCN_3855 | 47245 |
| GTCN_1080 | 33187 | GTCN_3619 | 47246 |
| GTCN_1081 | 33188 | CTCN_6760 | 47247 |
| TTCN_1626 | 33189 | TTCN_5556 | 47248 |
| TTCN_1627 | 33190 | CTCN_6761 | 47249 |
| CTCN_1940 | 33191 | GTCN_3620 | 47250 |
| ATCN_1086 | 33192 | ATCN_3856 | 47251 |
| ATCN_1087 | 33193 | CTCN_6762 | 47252 |
| TTCN_1628 | 33194 | ATCN_3857 | 47253 |
| GTCN_1082 | 33195 | GTCN_3621 | 47254 |
| CTCN_1941 | 33196 | CTCN_6763 | 47255 |
| CTCN_1942 | 33197 | TTCN_5557 | 47256 |
| CTCN_1943 | 33198 | ATCN_3858 | 47257 |
| TTCN_1629 | 33199 | CTCN_6764 | 47258 |
| ATCN_1088 | 33200 | CTCN_6765 | 47259 |
| ATCN_1089 | 33201 | TTCN_5558 | 47260 |
| CTCN_1944 | 33202 | ATCN_3859 | 47261 |
| ATCN_1090 | 33203 | ATCN_3860 | 47262 |
| CTCN_1945 | 33204 | CTCN_6766 | 47263 |
| GTCN_1083 | 33205 | GTCN_3622 | 47264 |
| CTCN_1946 | 33206 | CTCN_6767 | 47265 |
| CTCN_1947 | 33207 | CTCN_6768 | 47266 |
| ATCN_1091 | 33208 | GTCN_3623 | 47267 |
| CTCN_1948 | 33209 | CTCN_6769 | 47268 |
| CTCN_1949 | 33210 | GTCN_3624 | 47269 |
| CTCN_1950 | 33211 | CTCN_6770 | 47270 |
| CTCN_1951 | 33212 | CTCN_6771 | 47271 |

FIG. 37 (continued)

| | | | |
|---|---|---|---|
| ATCN_1092 | 33213 | GTCN_3625 | 47272 |
| ATCN_1093 | 33214 | TTCN_5559 | 47273 |
| ATCN_1094 | 33215 | TTCN_5560 | 47274 |
| CTCN_1952 | 33216 | GTCN_3626 | 47275 |
| TTCN_1630 | 33217 | ATCN_3861 | 47276 |
| GTCN_1084 | 33218 | ATCN_3862 | 47277 |
| CTCN_1953 | 33219 | ATCN_3863 | 47278 |
| GTCN_1085 | 33220 | CTCN_6772 | 47279 |
| CTCN_1954 | 33221 | CTCN_6773 | 47280 |
| GTCN_1086 | 33222 | TTCN_5561 | 47281 |
| TTCN_1631 | 33223 | CTCN_6774 | 47282 |
| ATCN_1095 | 33224 | TTCN_5562 | 47283 |
| CTCN_1955 | 33225 | CTCN_6775 | 47284 |
| ATCN_1096 | 33226 | CTCN_6776 | 47285 |
| ATCN_1097 | 33227 | CTCN_6777 | 47286 |
| CTCN_1956 | 33228 | ATCN_3864 | 47287 |
| CTCN_1957 | 33229 | CTCN_6778 | 47288 |
| GTCN_1087 | 33230 | ATCN_3865 | 47289 |
| ATCN_1098 | 33231 | CTCN_6779 | 47290 |
| ATCN_1099 | 33232 | ATCN_3866 | 47291 |
| ATCN_1100 | 33233 | ATCN_3867 | 47292 |
| CTCN_1958 | 33234 | CTCN_6780 | 47293 |
| CTCN_1959 | 33235 | CTCN_6781 | 47294 |
| CTCN_1960 | 33236 | CTCN_6782 | 47295 |
| TTCN_1632 | 33237 | CTCN_6783 | 47296 |
| TTCN_1633 | 33238 | GTCN_3627 | 47297 |
| CTCN_1961 | 33239 | TTCN_5563 | 47298 |
| GTCN_1088 | 33240 | CTCN_6784 | 47299 |
| CTCN_1962 | 33241 | ATCN_3868 | 47300 |
| CTCN_1963 | 33242 | TTCN_5564 | 47301 |
| CTCN_1964 | 33243 | ATCN_3869 | 47302 |
| ATCN_1101 | 33244 | CTCN_6785 | 47303 |
| CTCN_1965 | 33245 | ATCN_3870 | 47304 |
| CTCN_1966 | 33246 | ATCN_3871 | 47305 |
| GTCN_1089 | 33247 | CTCN_6786 | 47306 |
| CTCN_1967 | 33248 | GTCN_3628 | 47307 |
| GTCN_1090 | 33249 | ATCN_3872 | 47308 |
| CTCN_1968 | 33250 | CTCN_6787 | 47309 |
| GTCN_1091 | 33251 | GTCN_3629 | 47310 |
| ATCN_1102 | 33252 | ATCN_3873 | 47311 |
| CTCN_1969 | 33253 | ATCN_3874 | 47312 |
| ATCN_1103 | 33254 | ATCN_3875 | 47313 |
| ATCN_1104 | 33255 | ATCN_3876 | 47314 |

| | | | |
|---|---|---|---|
| TTCN_1634 | 33256 | CTCN_6788 | 47315 |
| TTCN_1635 | 33257 | TTCN_5565 | 47316 |
| CTCN_1970 | 33258 | CTCN_6789 | 47317 |
| CTCN_1971 | 33259 | ATCN_3877 | 47318 |
| TTCN_1636 | 33260 | CTCN_6790 | 47319 |
| TTCN_1637 | 33261 | GTCN_3630 | 47320 |
| TTCN_1638 | 33262 | CTCN_6791 | 47321 |
| ATCN_1105 | 33263 | CTCN_6792 | 47322 |
| CTCN_1972 | 33264 | TTCN_5566 | 47323 |
| CTCN_1973 | 33265 | CTCN_6793 | 47324 |
| TTCN_1639 | 33266 | CTCN_6794 | 47325 |
| CTCN_1974 | 33267 | CTCN_6795 | 47326 |
| TTCN_1640 | 33268 | TTCN_5567 | 47327 |
| CTCN_1975 | 33269 | GTCN_3631 | 47328 |
| TTCN_1641 | 33270 | GTCN_3632 | 47329 |
| CTCN_1976 | 33271 | CTCN_6796 | 47330 |
| CTCN_1977 | 33272 | TTCN_5568 | 47331 |
| TTCN_1642 | 33273 | ATCN_3878 | 47332 |
| CTCN_1978 | 33274 | CTCN_6797 | 47333 |
| CTCN_1979 | 33275 | GTCN_3633 | 47334 |
| TTCN_1643 | 33276 | CTCN_6798 | 47335 |
| TTCN_1644 | 33277 | CTCN_6799 | 47336 |
| CTCN_1980 | 33278 | TTCN_5569 | 47337 |
| GTCN_1092 | 33279 | GTCN_3634 | 47338 |
| GTCN_1093 | 33280 | TTCN_5570 | 47339 |
| CTCN_1981 | 33281 | CTCN_6800 | 47340 |
| CTCN_1982 | 33282 | TTCN_5571 | 47341 |
| ATCN_1106 | 33283 | ATCN_3879 | 47342 |
| CTCN_1983 | 33284 | GTCN_3635 | 47343 |
| TTCN_1645 | 33285 | ATCN_3880 | 47344 |
| TTCN_1646 | 33286 | CTCN_6801 | 47345 |
| CTCN_1984 | 33287 | TTCN_5572 | 47346 |
| CTCN_1985 | 33288 | TTCN_5573 | 47347 |
| ATCN_1107 | 33289 | ATCN_3881 | 47348 |
| ATCN_1108 | 33290 | TTCN_5574 | 47349 |
| CTCN_1986 | 33291 | TTCN_5575 | 47350 |
| CTCN_1987 | 33292 | CTCN_6802 | 47351 |
| CTCN_1988 | 33293 | CTCN_6803 | 47352 |
| CTCN_1989 | 33294 | TTCN_5576 | 47353 |
| GTCN_1094 | 33295 | TTCN_5577 | 47354 |
| CTCN_1990 | 33296 | CTCN_6804 | 47355 |
| CTCN_1991 | 33297 | CTCN_6805 | 47356 |
| GTCN_1095 | 33298 | CTCN_6806 | 47357 |

FIG. 37 (continued)

| | | | |
|---|---|---|---|
| TTCN_1647 | 33299 | TTCN_5578 | 47358 |
| GTCN_1096 | 33300 | CTCN_6807 | 47359 |
| CTCN_1992 | 33301 | TTCN_5579 | 47360 |
| ATCN_1109 | 33302 | CTCN_6808 | 47361 |
| CTCN_1993 | 33303 | GTCN_3636 | 47362 |
| CTCN_1994 | 33304 | CTCN_6809 | 47363 |
| ATCN_1110 | 33305 | CTCN_6810 | 47364 |
| ATCN_1111 | 33306 | ATCN_3882 | 47365 |
| ATCN_1112 | 33307 | CTCN_6811 | 47366 |
| ATCN_1113 | 33308 | ATCN_3883 | 47367 |
| CTCN_1995 | 33309 | ATCN_3884 | 47368 |
| GTCN_1097 | 33310 | CTCN_6812 | 47369 |
| ATCN_1114 | 33311 | CTCN_6813 | 47370 |
| GTCN_1098 | 33312 | CTCN_6814 | 47371 |
| CTCN_1996 | 33313 | CTCN_6815 | 47372 |
| GTCN_1099 | 33314 | CTCN_6816 | 47373 |
| ATCN_1115 | 33315 | CTCN_6817 | 47374 |
| ATCN_1116 | 33316 | CTCN_6818 | 47375 |
| TTCN_1648 | 33317 | CTCN_6819 | 47376 |
| TTCN_1649 | 33318 | CTCN_6820 | 47377 |
| CTCN_1997 | 33319 | TTCN_5580 | 47378 |
| GTCN_1100 | 33320 | TTCN_5581 | 47379 |
| TTCN_1650 | 33321 | GTCN_3637 | 47380 |
| CTCN_1998 | 33322 | CTCN_6821 | 47381 |
| CTCN_1999 | 33323 | ATCN_3885 | 47382 |
| CTCN_2000 | 33324 | TTCN_5582 | 47383 |
| TTCN_1651 | 33325 | GTCN_3638 | 47384 |
| TTCN_1652 | 33326 | ATCN_3886 | 47385 |
| GTCN_1101 | 33327 | ATCN_3887 | 47386 |
| ATCN_1117 | 33328 | TTCN_5583 | 47387 |
| TTCN_1653 | 33329 | GTCN_3639 | 47388 |
| TTCN_1654 | 33330 | ATCN_3888 | 47389 |
| TTCN_1655 | 33331 | TTCN_5584 | 47390 |
| ATCN_1118 | 33332 | TTCN_5585 | 47391 |
| CTCN_2001 | 33333 | ATCN_3889 | 47392 |
| TTCN_1656 | 33334 | TTCN_5586 | 47393 |
| GTCN_1102 | 33335 | TTCN_5587 | 47394 |
| GTCN_1103 | 33336 | ATCN_3890 | 47395 |
| CTCN_2002 | 33337 | CTCN_6822 | 47396 |
| GTCN_1104 | 33338 | CTCN_6823 | 47397 |
| TTCN_1657 | 33339 | ATCN_3891 | 47398 |
| TTCN_1658 | 33340 | GTCN_3640 | 47399 |
| ATCN_1119 | 33341 | CTCN_6824 | 47400 |

| | | | |
|---|---|---|---|
| ATCN_1120 | 33342 | ATCN_3892 | 47401 |
| TTCN_1659 | 33343 | CTCN_6825 | 47402 |
| ATCN_1121 | 33344 | CTCN_6826 | 47403 |
| CTCN_2003 | 33345 | CTCN_6827 | 47404 |
| CTCN_2004 | 33346 | TTCN_5588 | 47405 |
| GTCN_1105 | 33347 | TTCN_5589 | 47406 |
| CTCN_2005 | 33348 | TTCN_5590 | 47407 |
| CTCN_2006 | 33349 | TTCN_5591 | 47408 |
| CTCN_2007 | 33350 | TTCN_5592 | 47409 |
| TTCN_1660 | 33351 | CTCN_6828 | 47410 |
| TTCN_1661 | 33352 | GTCN_3641 | 47411 |
| ATCN_1122 | 33353 | GTCN_3642 | 47412 |
| TTCN_1662 | 33354 | GTCN_3643 | 47413 |
| GTCN_1106 | 33355 | CTCN_6829 | 47414 |
| TTCN_1663 | 33356 | CTCN_6830 | 47415 |
| TTCN_1664 | 33357 | ATCN_3893 | 47416 |
| TTCN_1665 | 33358 | CTCN_6831 | 47417 |
| TTCN_1666 | 33359 | GTCN_3644 | 47418 |
| CTCN_2008 | 33360 | GTCN_3645 | 47419 |
| CTCN_2009 | 33361 | TTCN_5593 | 47420 |
| TTCN_1667 | 33362 | TTCN_5594 | 47421 |
| ATCN_1123 | 33363 | TTCN_5595 | 47422 |
| CTCN_2010 | 33364 | ATCN_3894 | 47423 |
| TTCN_1668 | 33365 | CTCN_6832 | 47424 |
| TTCN_1669 | 33366 | CTCN_6833 | 47425 |
| GTCN_1107 | 33367 | GTCN_3646 | 47426 |
| CTCN_2011 | 33368 | TTCN_5596 | 47427 |
| GTCN_1108 | 33369 | CTCN_6834 | 47428 |
| CTCN_2012 | 33370 | CTCN_6835 | 47429 |
| CTCN_2013 | 33371 | CTCN_6836 | 47430 |
| CTCN_2014 | 33372 | CTCN_6837 | 47431 |
| GTCN_1109 | 33373 | GTCN_3647 | 47432 |
| TTCN_1670 | 33374 | TTCN_5597 | 47433 |
| ATCN_1124 | 33375 | CTCN_6838 | 47434 |
| ATCN_1125 | 33376 | GTCN_3648 | 47435 |
| TTCN_1671 | 33377 | CTCN_6839 | 47436 |
| GTCN_1110 | 33378 | CTCN_6840 | 47437 |
| CTCN_2015 | 33379 | CTCN_6841 | 47438 |
| ATCN_1126 | 33380 | CTCN_6842 | 47439 |
| CTCN_2016 | 33381 | TTCN_5598 | 47440 |
| ATCN_1127 | 33382 | GTCN_3649 | 47441 |
| CTCN_2017 | 33383 | ATCN_3895 | 47442 |
| CTCN_2018 | 33384 | CTCN_6843 | 47443 |

FIG. 37 (continued)

| | | | |
|---|---|---|---|
| CTCN_2019 | 33385 | CTCN_6844 | 47444 |
| ATCN_1128 | 33386 | ATCN_3896 | 47445 |
| CTCN_2020 | 33387 | TTCN_5599 | 47446 |
| CTCN_2021 | 33388 | CTCN_6845 | 47447 |
| TTCN_1672 | 33389 | CTCN_6846 | 47448 |
| TTCN_1673 | 33390 | GTCN_3650 | 47449 |
| ATCN_1129 | 33391 | GTCN_3651 | 47450 |
| TTCN_1674 | 33392 | TTCN_5600 | 47451 |
| TTCN_1675 | 33393 | CTCN_6847 | 47452 |
| CTCN_2022 | 33394 | TTCN_5601 | 47453 |
| TTCN_1676 | 33395 | ATCN_3897 | 47454 |
| TTCN_1677 | 33396 | TTCN_5602 | 47455 |
| CTCN_2023 | 33397 | ATCN_3898 | 47456 |
| GTCN_1111 | 33398 | CTCN_6848 | 47457 |
| CTCN_2024 | 33399 | GTCN_3652 | 47458 |
| GTCN_1112 | 33400 | TTCN_5603 | 47459 |
| CTCN_2025 | 33401 | TTCN_5604 | 47460 |
| GTCN_1113 | 33402 | TTCN_5605 | 47461 |
| CTCN_2026 | 33403 | GTCN_3653 | 47462 |
| GTCN_1114 | 33404 | TTCN_5606 | 47463 |
| TTCN_1678 | 33405 | ATCN_3899 | 47464 |
| ATCN_1130 | 33406 | ATCN_3900 | 47465 |
| TTCN_1679 | 33407 | GTCN_3654 | 47466 |
| CTCN_2027 | 33408 | TTCN_5607 | 47467 |
| ATCN_1131 | 33409 | CTCN_6849 | 47468 |
| ATCN_1132 | 33410 | GTCN_3655 | 47469 |
| ATCN_1133 | 33411 | ATCN_3901 | 47470 |
| CTCN_2028 | 33412 | CTCN_6850 | 47471 |
| CTCN_2029 | 33413 | GTCN_3656 | 47472 |
| CTCN_2030 | 33414 | ATCN_3902 | 47473 |
| CTCN_2031 | 33415 | CTCN_6851 | 47474 |
| ATCN_1134 | 33416 | GTCN_3657 | 47475 |
| ATCN_1135 | 33417 | GTCN_3658 | 47476 |
| CTCN_2032 | 33418 | ATCN_3903 | 47477 |
| TTCN_1680 | 33419 | CTCN_6852 | 47478 |
| CTCN_2033 | 33420 | GTCN_3659 | 47479 |
| ATCN_1136 | 33421 | CTCN_6853 | 47480 |
| GTCN_1115 | 33422 | ATCN_3904 | 47481 |
| GTCN_1116 | 33423 | TTCN_5608 | 47482 |
| TTCN_1681 | 33424 | TTCN_5609 | 47483 |
| CTCN_2034 | 33425 | CTCN_6854 | 47484 |
| CTCN_2035 | 33426 | GTCN_3660 | 47485 |
| TTCN_1682 | 33427 | ATCN_3905 | 47486 |

| | | | |
|---|---|---|---|
| CTCN_2036 | 33428 | CTCN_6855 | 47487 |
| GTCN_1117 | 33429 | ATCN_3906 | 47488 |
| ATCN_1137 | 33430 | TTCN_5610 | 47489 |
| TTCN_1683 | 33431 | ATCN_3907 | 47490 |
| GTCN_1118 | 33432 | CTCN_6856 | 47491 |
| TTCN_1684 | 33433 | CTCN_6857 | 47492 |
| TTCN_1685 | 33434 | GTCN_3661 | 47493 |
| CTCN_2037 | 33435 | ATCN_3908 | 47494 |
| ATCN_1138 | 33436 | TTCN_5611 | 47495 |
| ATCN_1139 | 33437 | CTCN_6858 | 47496 |
| TTCN_1686 | 33438 | CTCN_6859 | 47497 |
| TTCN_1687 | 33439 | TTCN_5612 | 47498 |
| ATCN_1140 | 33440 | TTCN_5613 | 47499 |
| CTCN_2038 | 33441 | GTCN_3662 | 47500 |
| TTCN_1688 | 33442 | TTCN_5614 | 47501 |
| ATCN_1141 | 33443 | GTCN_3663 | 47502 |
| TTCN_1689 | 33444 | TTCN_5615 | 47503 |
| GTCN_1119 | 33445 | CTCN_6860 | 47504 |
| TTCN_1690 | 33446 | GTCN_3664 | 47505 |
| GTCN_1120 | 33447 | TTCN_5616 | 47506 |
| TTCN_1691 | 33448 | TTCN_5617 | 47507 |
| TTCN_1692 | 33449 | CTCN_6861 | 47508 |
| CTCN_2039 | 33450 | TTCN_5618 | 47509 |
| CTCN_2040 | 33451 | TTCN_5619 | 47510 |
| CTCN_2041 | 33452 | CTCN_6862 | 47511 |
| GTCN_1121 | 33453 | TTCN_5620 | 47512 |
| CTCN_2042 | 33454 | ATCN_3909 | 47513 |
| GTCN_1122 | 33455 | TTCN_5621 | 47514 |
| TTCN_1693 | 33456 | CTCN_6863 | 47515 |
| GTCN_1123 | 33457 | GTCN_3665 | 47516 |
| GTCN_1124 | 33458 | GTCN_3666 | 47517 |
| CTCN_2043 | 33459 | CTCN_6864 | 47518 |
| CTCN_2044 | 33460 | TTCN_5622 | 47519 |
| CTCN_2045 | 33461 | TTCN_5623 | 47520 |
| TTCN_1694 | 33462 | CTCN_6865 | 47521 |
| CTCN_2046 | 33463 | TTCN_5624 | 47522 |
| CTCN_2047 | 33464 | CTCN_6866 | 47523 |
| CTCN_2048 | 33465 | GTCN_3667 | 47524 |
| CTCN_2049 | 33466 | TTCN_5625 | 47525 |
| CTCN_2050 | 33467 | CTCN_6867 | 47526 |
| ATCN_1142 | 33468 | CTCN_6868 | 47527 |
| CTCN_2051 | 33469 | GTCN_3668 | 47528 |
| GTCN_1125 | 33470 | GTCN_3669 | 47529 |

FIG. 37 (continued)

| | | | |
|---|---|---|---|
| CTCN_2052 | 33471 | TTCN_5626 | 47530 |
| GTCN_1126 | 33472 | ATCN_3910 | 47531 |
| CTCN_2053 | 33473 | TTCN_5627 | 47532 |
| TTCN_1695 | 33474 | TTCN_5628 | 47533 |
| GTCN_1127 | 33475 | GTCN_3670 | 47534 |
| TTCN_1696 | 33476 | TTCN_5629 | 47535 |
| TTCN_1697 | 33477 | ATCN_3911 | 47536 |
| TTCN_1698 | 33478 | TTCN_5630 | 47537 |
| TTCN_1699 | 33479 | CTCN_6869 | 47538 |
| ATCN_1143 | 33480 | TTCN_5631 | 47539 |
| TTCN_1700 | 33481 | GTCN_3671 | 47540 |
| ATCN_1144 | 33482 | TTCN_5632 | 47541 |
| TTCN_1701 | 33483 | TTCN_5633 | 47542 |
| TTCN_1702 | 33484 | ATCN_3912 | 47543 |
| TTCN_1703 | 33485 | ATCN_3913 | 47544 |
| TTCN_1704 | 33486 | GTCN_3672 | 47545 |
| TTCN_1705 | 33487 | CTCN_6870 | 47546 |
| ATCN_1145 | 33488 | ATCN_3914 | 47547 |
| CTCN_2054 | 33489 | GTCN_3673 | 47548 |
| ATCN_1146 | 33490 | TTCN_5634 | 47549 |
| GTCN_1128 | 33491 | ATCN_3915 | 47550 |
| TTCN_1706 | 33492 | TTCN_5635 | 47551 |
| GTCN_1129 | 33493 | CTCN_6871 | 47552 |
| CTCN_2055 | 33494 | TTCN_5636 | 47553 |
| TTCN_1707 | 33495 | TTCN_5637 | 47554 |
| TTCN_1708 | 33496 | GTCN_3674 | 47555 |
| CTCN_2056 | 33497 | TTCN_5638 | 47556 |
| TTCN_1709 | 33498 | GTCN_3675 | 47557 |
| TTCN_1710 | 33499 | GTCN_3676 | 47558 |
| ATCN_1147 | 33500 | TTCN_5639 | 47559 |
| GTCN_1130 | 33501 | CTCN_6872 | 47560 |
| ATCN_1148 | 33502 | ATCN_3916 | 47561 |
| CTCN_2057 | 33503 | TTCN_5640 | 47562 |
| TTCN_1711 | 33504 | CTCN_6873 | 47563 |
| CTCN_2058 | 33505 | ATCN_3917 | 47564 |
| TTCN_1712 | 33506 | TTCN_5641 | 47565 |
| ATCN_1149 | 33507 | TTCN_5642 | 47566 |
| TTCN_1713 | 33508 | TTCN_5643 | 47567 |
| CTCN_2059 | 33509 | ATCN_3918 | 47568 |
| ATCN_1150 | 33510 | ATCN_3919 | 47569 |
| GTCN_1131 | 33511 | ATCN_3920 | 47570 |
| TTCN_1714 | 33512 | CTCN_6874 | 47571 |
| TTCN_1715 | 33513 | GTCN_3677 | 47572 |

| | | | |
|---|---|---|---|
| TTCN_1716 | 33514 | ATCN_3921 | 47573 |
| CTCN_2060 | 33515 | GTCN_3678 | 47574 |
| GTCN_1132 | 33516 | CTCN_6875 | 47575 |
| TTCN_1717 | 33517 | TTCN_5644 | 47576 |
| ATCN_1151 | 33518 | ATCN_3922 | 47577 |
| ATCN_1152 | 33519 | CTCN_6876 | 47578 |
| GTCN_1133 | 33520 | TTCN_5645 | 47579 |
| GTCN_1134 | 33521 | GTCN_3679 | 47580 |
| GTCN_1135 | 33522 | TTCN_5646 | 47581 |
| GTCN_1136 | 33523 | CTCN_6877 | 47582 |
| TTCN_1718 | 33524 | CTCN_6878 | 47583 |
| TTCN_1719 | 33525 | CTCN_6879 | 47584 |
| CTCN_2061 | 33526 | CTCN_6880 | 47585 |
| CTCN_2062 | 33527 | TTCN_5647 | 47586 |
| ATCN_1153 | 33528 | TTCN_5648 | 47587 |
| GTCN_1137 | 33529 | CTCN_6881 | 47588 |
| TTCN_1720 | 33530 | ATCN_3923 | 47589 |
| CTCN_2063 | 33531 | ATCN_3924 | 47590 |
| TTCN_1721 | 33532 | CTCN_6882 | 47591 |
| CTCN_2064 | 33533 | CTCN_6883 | 47592 |
| ATCN_1154 | 33534 | CTCN_6884 | 47593 |
| ATCN_1155 | 33535 | ATCN_3925 | 47594 |
| CTCN_2065 | 33536 | CTCN_6885 | 47595 |
| ATCN_1156 | 33537 | TTCN_5649 | 47596 |
| ATCN_1157 | 33538 | TTCN_5650 | 47597 |
| CTCN_2066 | 33539 | CTCN_6886 | 47598 |
| GTCN_1138 | 33540 | CTCN_6887 | 47599 |
| ATCN_1158 | 33541 | CTCN_6888 | 47600 |
| GTCN_1139 | 33542 | CTCN_6889 | 47601 |
| GTCN_1140 | 33543 | GTCN_3680 | 47602 |
| TTCN_1722 | 33544 | TTCN_5651 | 47603 |
| TTCN_1723 | 33545 | CTCN_6890 | 47604 |
| ATCN_1159 | 33546 | CTCN_6891 | 47605 |
| TTCN_1724 | 33547 | TTCN_5652 | 47606 |
| ATCN_1160 | 33548 | TTCN_5653 | 47607 |
| TTCN_1725 | 33549 | TTCN_5654 | 47608 |
| TTCN_1726 | 33550 | CTCN_6892 | 47609 |
| ATCN_1161 | 33551 | GTCN_3681 | 47610 |
| TTCN_1727 | 33552 | TTCN_5655 | 47611 |
| TTCN_1728 | 33553 | ATCN_3926 | 47612 |
| TTCN_1729 | 33554 | TTCN_5656 | 47613 |
| CTCN_2067 | 33555 | GTCN_3682 | 47614 |
| ATCN_1162 | 33556 | ATCN_3927 | 47615 |

FIG. 37 (continued)

| | | | |
|---|---|---|---|
| GTCN_1141 | 33557 | TTCN_5657 | 47616 |
| ATCN_1163 | 33558 | ATCN_3928 | 47617 |
| TTCN_1730 | 33559 | GTCN_3683 | 47618 |
| ATCN_1164 | 33560 | CTCN_6893 | 47619 |
| TTCN_1731 | 33561 | GTCN_3684 | 47620 |
| CTCN_2068 | 33562 | TTCN_5658 | 47621 |
| TTCN_1732 | 33563 | CTCN_6894 | 47622 |
| GTCN_1142 | 33564 | CTCN_6895 | 47623 |
| TTCN_1733 | 33565 | CTCN_6896 | 47624 |
| ATCN_1165 | 33566 | GTCN_3685 | 47625 |
| TTCN_1734 | 33567 | ATCN_3929 | 47626 |
| ATCN_1166 | 33568 | ATCN_3930 | 47627 |
| GTCN_1143 | 33569 | ATCN_3931 | 47628 |
| CTCN_2069 | 33570 | TTCN_5659 | 47629 |
| GTCN_1144 | 33571 | ATCN_3932 | 47630 |
| ATCN_1167 | 33572 | TTCN_5660 | 47631 |
| CTCN_2070 | 33573 | CTCN_6897 | 47632 |
| CTCN_2071 | 33574 | GTCN_3686 | 47633 |
| CTCN_2072 | 33575 | TTCN_5661 | 47634 |
| GTCN_1145 | 33576 | ATCN_3933 | 47635 |
| TTCN_1735 | 33577 | ATCN_3934 | 47636 |
| GTCN_1146 | 33578 | GTCN_3687 | 47637 |
| CTCN_2073 | 33579 | ATCN_3935 | 47638 |
| CTCN_2074 | 33580 | TTCN_5662 | 47639 |
| ATCN_1168 | 33581 | TTCN_5663 | 47640 |
| ATCN_1169 | 33582 | TTCN_5664 | 47641 |
| CTCN_2075 | 33583 | GTCN_3688 | 47642 |
| CTCN_2076 | 33584 | CTCN_6898 | 47643 |
| CTCN_2077 | 33585 | GTCN_3689 | 47644 |
| TTCN_1736 | 33586 | ATCN_3936 | 47645 |
| ATCN_1170 | 33587 | TTCN_5665 | 47646 |
| TTCN_1737 | 33588 | CTCN_6899 | 47647 |
| CTCN_2078 | 33589 | ATCN_3937 | 47648 |
| CTCN_2079 | 33590 | TTCN_5666 | 47649 |
| CTCN_2080 | 33591 | ATCN_3938 | 47650 |
| CTCN_2081 | 33592 | CTCN_6900 | 47651 |
| ATCN_1171 | 33593 | CTCN_6901 | 47652 |
| ATCN_1172 | 33594 | ATCN_3939 | 47653 |
| CTCN_2082 | 33595 | TTCN_5667 | 47654 |
| GTCN_1147 | 33596 | ATCN_3940 | 47655 |
| GTCN_1148 | 33597 | TTCN_5668 | 47656 |
| GTCN_1149 | 33598 | ATCN_3941 | 47657 |
| CTCN_2083 | 33599 | TTCN_5669 | 47658 |

| | | | |
|---|---|---|---|
| CTCN_2084 | 33600 | CTCN_6902 | 47659 |
| CTCN_2085 | 33601 | CTCN_6903 | 47660 |
| CTCN_2086 | 33602 | CTCN_6904 | 47661 |
| TTCN_1738 | 33603 | CTCN_6905 | 47662 |
| TTCN_1739 | 33604 | GTCN_3690 | 47663 |
| TTCN_1740 | 33605 | ATCN_3942 | 47664 |
| ATCN_1173 | 33606 | CTCN_6906 | 47665 |
| TTCN_1741 | 33607 | TTCN_5670 | 47666 |
| ATCN_1174 | 33608 | ATCN_3943 | 47667 |
| ATCN_1175 | 33609 | TTCN_5671 | 47668 |
| ATCN_1176 | 33610 | CTCN_6907 | 47669 |
| GTCN_1150 | 33611 | ATCN_3944 | 47670 |
| ATCN_1177 | 33612 | ATCN_3945 | 47671 |
| ATCN_1178 | 33613 | GTCN_3691 | 47672 |
| ATCN_1179 | 33614 | ATCN_3946 | 47673 |
| ATCN_1180 | 33615 | ATCN_3947 | 47674 |
| ATCN_1181 | 33616 | CTCN_6908 | 47675 |
| ATCN_1182 | 33617 | CTCN_6909 | 47676 |
| ATCN_1183 | 33618 | CTCN_6910 | 47677 |
| ATCN_1184 | 33619 | GTCN_3692 | 47678 |
| ATCN_1185 | 33620 | GTCN_3693 | 47679 |
| ATCN_1186 | 33621 | CTCN_6911 | 47680 |
| ATCN_1187 | 33622 | CTCN_6912 | 47681 |
| ATCN_1188 | 33623 | TTCN_5672 | 47682 |
| GTCN_1151 | 33624 | GTCN_3694 | 47683 |
| ATCN_1189 | 33625 | TTCN_5673 | 47684 |
| ATCN_1190 | 33626 | TTCN_5674 | 47685 |
| ATCN_1191 | 33627 | TTCN_5675 | 47686 |
| ATCN_1192 | 33628 | CTCN_6913 | 47687 |
| ATCN_1193 | 33629 | CTCN_6914 | 47688 |
| GTCN_1152 | 33630 | TTCN_5676 | 47689 |
| ATCN_1194 | 33631 | ATCN_3948 | 47690 |
| ATCN_1195 | 33632 | ATCN_3949 | 47691 |
| ATCN_1196 | 33633 | GTCN_3695 | 47692 |
| ATCN_1197 | 33634 | ATCN_3950 | 47693 |
| ATCN_1198 | 33635 | TTCN_5677 | 47694 |
| ATCN_1199 | 33636 | TTCN_5678 | 47695 |
| ATCN_1200 | 33637 | CTCN_6915 | 47696 |
| ATCN_1201 | 33638 | TTCN_5679 | 47697 |
| ATCN_1202 | 33639 | TTCN_5680 | 47698 |
| ATCN_1203 | 33640 | TTCN_5681 | 47699 |
| ATCN_1204 | 33641 | GTCN_3696 | 47700 |
| ATCN_1205 | 33642 | ATCN_3951 | 47701 |

FIG. 37 (continued)

| | | | |
|---|---|---|---|
| ATCN_1206 | 33643 | GTCN_3697 | 47702 |
| ATCN_1207 | 33644 | ATCN_3952 | 47703 |
| ATCN_1208 | 33645 | TTCN_5682 | 47704 |
| ATCN_1209 | 33646 | TTCN_5683 | 47705 |
| ATCN_1210 | 33647 | CTCN_6916 | 47706 |
| ATCN_1211 | 33648 | CTCN_6917 | 47707 |
| ATCN_1212 | 33649 | TTCN_5684 | 47708 |
| ATCN_1213 | 33650 | GTCN_3698 | 47709 |
| ATCN_1214 | 33651 | CTCN_6918 | 47710 |
| ATCN_1215 | 33652 | TTCN_5685 | 47711 |
| ATCN_1216 | 33653 | CTCN_6919 | 47712 |
| ATCN_1217 | 33654 | ATCN_3953 | 47713 |
| ATCN_1218 | 33655 | ATCN_3954 | 47714 |
| ATCN_1219 | 33656 | TTCN_5686 | 47715 |
| ATCN_1220 | 33657 | GTCN_3699 | 47716 |
| GTCN_1153 | 33658 | TTCN_5687 | 47717 |
| ATCN_1221 | 33659 | CTCN_6920 | 47718 |
| ATCN_1222 | 33660 | TTCN_5688 | 47719 |
| ATCN_1223 | 33661 | ATCN_3955 | 47720 |
| ATCN_1224 | 33662 | CTCN_6921 | 47721 |
| ATCN_1225 | 33663 | GTCN_3700 | 47722 |
| ATCN_1226 | 33664 | TTCN_5689 | 47723 |
| ATCN_1227 | 33665 | TTCN_5690 | 47724 |
| ATCN_1228 | 33666 | CTCN_6922 | 47725 |
| GTCN_1154 | 33667 | CTCN_6923 | 47726 |
| ATCN_1229 | 33668 | CTCN_6924 | 47727 |
| ATCN_1230 | 33669 | TTCN_5691 | 47728 |
| ATCN_1231 | 33670 | CTCN_6925 | 47729 |
| ATCN_1232 | 33671 | CTCN_6926 | 47730 |
| ATCN_1233 | 33672 | ATCN_3956 | 47731 |
| ATCN_1234 | 33673 | ATCN_3957 | 47732 |
| ATCN_1235 | 33674 | TTCN_5692 | 47733 |
| ATCN_1236 | 33675 | GTCN_3701 | 47734 |
| CTCN_2087 | 33676 | TTCN_5693 | 47735 |
| ATCN_1237 | 33677 | ATCN_3958 | 47736 |
| GTCN_1155 | 33678 | ATCN_3959 | 47737 |
| CTCN_2088 | 33679 | TTCN_5694 | 47738 |
| ATCN_1238 | 33680 | GTCN_3702 | 47739 |
| GTCN_1156 | 33681 | TTCN_5695 | 47740 |
| ATCN_1239 | 33682 | TTCN_5696 | 47741 |
| GTCN_1157 | 33683 | ATCN_3960 | 47742 |
| GTCN_1158 | 33684 | ATCN_3961 | 47743 |
| CTCN_2089 | 33685 | TTCN_5697 | 47744 |

| | | | |
|---|---|---|---|
| CTCN_2090 | 33686 | TTCN_5698 | 47745 |
| TTCN_1742 | 33687 | TTCN_5699 | 47746 |
| GTCN_1159 | 33688 | TTCN_5700 | 47747 |
| CTCN_2091 | 33689 | CTCN_6927 | 47748 |
| TTCN_1743 | 33690 | ATCN_3962 | 47749 |
| CTCN_2092 | 33691 | TTCN_5701 | 47750 |
| GTCN_1160 | 33692 | TTCN_5702 | 47751 |
| TTCN_1744 | 33693 | ATCN_3963 | 47752 |
| GTCN_1161 | 33694 | CTCN_6928 | 47753 |
| CTCN_2093 | 33695 | GTCN_3703 | 47754 |
| GTCN_1162 | 33696 | TTCN_5703 | 47755 |
| CTCN_2094 | 33697 | TTCN_5704 | 47756 |
| CTCN_2095 | 33698 | ATCN_3964 | 47757 |
| ATCN_1240 | 33699 | CTCN_6929 | 47758 |
| GTCN_1163 | 33700 | TTCN_5705 | 47759 |
| GTCN_1164 | 33701 | TTCN_5706 | 47760 |
| GTCN_1165 | 33702 | CTCN_6930 | 47761 |
| ATCN_1241 | 33703 | GTCN_3704 | 47762 |
| ATCN_1242 | 33704 | CTCN_6931 | 47763 |
| CTCN_2096 | 33705 | CTCN_6932 | 47764 |
| ATCN_1243 | 33706 | GTCN_3705 | 47765 |
| ATCN_1244 | 33707 | TTCN_5707 | 47766 |
| CTCN_2097 | 33708 | GTCN_3706 | 47767 |
| TTCN_1745 | 33709 | CTCN_6933 | 47768 |
| CTCN_2098 | 33710 | CTCN_6934 | 47769 |
| CTCN_2099 | 33711 | CTCN_6935 | 47770 |
| TTCN_1746 | 33712 | TTCN_5708 | 47771 |
| CTCN_2100 | 33713 | GTCN_3707 | 47772 |
| ATCN_1245 | 33714 | TTCN_5709 | 47773 |
| TTCN_1747 | 33715 | TTCN_5710 | 47774 |
| CTCN_2101 | 33716 | CTCN_6936 | 47775 |
| TTCN_1748 | 33717 | GTCN_3708 | 47776 |
| CTCN_2102 | 33718 | CTCN_6937 | 47777 |
| TTCN_1749 | 33719 | CTCN_6938 | 47778 |
| ATCN_1246 | 33720 | TTCN_5711 | 47779 |
| TTCN_1750 | 33721 | ATCN_3965 | 47780 |
| CTCN_2103 | 33722 | ATCN_3966 | 47781 |
| TTCN_1751 | 33723 | TTCN_5712 | 47782 |
| GTCN_1166 | 33724 | TTCN_5713 | 47783 |
| TTCN_1752 | 33725 | TTCN_5714 | 47784 |
| ATCN_1247 | 33726 | TTCN_5715 | 47785 |
| CTCN_2104 | 33727 | TTCN_5716 | 47786 |
| ATCN_1248 | 33728 | TTCN_5717 | 47787 |

FIG. 37 (continued)

| | | | | | | | |
|---|---|---|---|---|---|---|---|
| ATCN_1249 | 33729 | TTCN_5718 | 47788 | TTCN_1766 | 33772 | GTCN_3718 | 47831 |
| ATCN_1250 | 33730 | CTCN_6939 | 47789 | CTCN_2118 | 33773 | CTCN_6951 | 47832 |
| TTCN_1753 | 33731 | TTCN_5719 | 47790 | CTCN_2119 | 33774 | CTCN_6952 | 47833 |
| TTCN_1754 | 33732 | ATCN_3967 | 47791 | TTCN_1767 | 33775 | CTCN_6953 | 47834 |
| ATCN_1251 | 33733 | TTCN_5720 | 47792 | CTCN_2120 | 33776 | CTCN_6954 | 47835 |
| ATCN_1252 | 33734 | ATCN_3968 | 47793 | ATCN_1263 | 33777 | TTCN_5733 | 47836 |
| ATCN_1253 | 33735 | ATCN_3969 | 47794 | GTCN_1170 | 33778 | ATCN_3974 | 47837 |
| ATCN_1254 | 33736 | GTCN_3709 | 47795 | TTCN_1768 | 33779 | CTCN_6955 | 47838 |
| TTCN_1755 | 33737 | TTCN_5721 | 47796 | CTCN_2121 | 33780 | ATCN_3975 | 47839 |
| ATCN_1255 | 33738 | GTCN_3710 | 47797 | GTCN_1171 | 33781 | ATCN_3976 | 47840 |
| CTCN_2105 | 33739 | GTCN_3711 | 47798 | GTCN_1172 | 33782 | TTCN_5734 | 47841 |
| TTCN_1756 | 33740 | CTCN_6940 | 47799 | ATCN_1264 | 33783 | TTCN_5735 | 47842 |
| CTCN_2106 | 33741 | TTCN_5722 | 47800 | ATCN_1265 | 33784 | TTCN_5736 | 47843 |
| CTCN_2107 | 33742 | ATCN_3970 | 47801 | ATCN_1266 | 33785 | CTCN_6956 | 47844 |
| TTCN_1757 | 33743 | CTCN_6941 | 47802 | TTCN_1769 | 33786 | TTCN_5737 | 47845 |
| ATCN_1256 | 33744 | TTCN_5723 | 47803 | GTCN_1173 | 33787 | ATCN_3977 | 47846 |
| ATCN_1257 | 33745 | TTCN_5724 | 47804 | TTCN_1770 | 33788 | CTCN_6957 | 47847 |
| TTCN_1758 | 33746 | CTCN_6942 | 47805 | TTCN_1771 | 33789 | TTCN_5738 | 47848 |
| ATCN_1258 | 33747 | GTCN_3712 | 47806 | GTCN_1174 | 33790 | CTCN_6958 | 47849 |
| ATCN_1259 | 33748 | CTCN_6943 | 47807 | TTCN_1772 | 33791 | ATCN_3978 | 47850 |
| ATCN_1260 | 33749 | TTCN_5725 | 47808 | ATCN_1267 | 33792 | CTCN_6959 | 47851 |
| TTCN_1759 | 33750 | GTCN_3713 | 47809 | TTCN_1773 | 33793 | GTCN_3719 | 47852 |
| CTCN_2108 | 33751 | TTCN_5726 | 47810 | TTCN_1774 | 33794 | ATCN_3979 | 47853 |
| CTCN_2109 | 33752 | GTCN_3714 | 47811 | ATCN_1268 | 33795 | ATCN_3980 | 47854 |
| TTCN_1760 | 33753 | CTCN_6944 | 47812 | TTCN_1775 | 33796 | ATCN_3981 | 47855 |
| CTCN_2110 | 33754 | ATCN_3971 | 47813 | CTCN_2122 | 33797 | CTCN_6960 | 47856 |
| TTCN_1761 | 33755 | TTCN_5727 | 47814 | CTCN_2123 | 33798 | TTCN_5739 | 47857 |
| GTCN_1167 | 33756 | CTCN_6945 | 47815 | ATCN_1269 | 33799 | CTCN_6961 | 47858 |
| GTCN_1168 | 33757 | TTCN_5728 | 47816 | ATCN_1270 | 33800 | CTCN_6962 | 47859 |
| GTCN_1169 | 33758 | TTCN_5729 | 47817 | ATCN_1271 | 33801 | TTCN_5740 | 47860 |
| CTCN_2111 | 33759 | TTCN_5730 | 47818 | ATCN_1272 | 33802 | TTCN_5741 | 47861 |
| TTCN_1762 | 33760 | CTCN_6946 | 47819 | TTCN_1776 | 33803 | CTCN_6963 | 47862 |
| TTCN_1763 | 33761 | TTCN_5731 | 47820 | ATCN_1273 | 33804 | GTCN_3720 | 47863 |
| CTCN_2112 | 33762 | CTCN_6947 | 47821 | TTCN_1777 | 33805 | CTCN_6964 | 47864 |
| TTCN_1764 | 33763 | CTCN_6948 | 47822 | TTCN_1778 | 33806 | CTCN_6965 | 47865 |
| CTCN_2113 | 33764 | ATCN_3972 | 47823 | ATCN_1274 | 33807 | GTCN_3721 | 47866 |
| CTCN_2114 | 33765 | CTCN_6949 | 47824 | ATCN_1275 | 33808 | GTCN_3722 | 47867 |
| ATCN_1261 | 33766 | GTCN_3715 | 47825 | GTCN_1175 | 33809 | TTCN_5742 | 47868 |
| ATCN_1262 | 33767 | ATCN_3973 | 47826 | CTCN_2124 | 33810 | GTCN_3723 | 47869 |
| CTCN_2115 | 33768 | TTCN_5732 | 47827 | ATCN_1276 | 33811 | ATCN_3982 | 47870 |
| CTCN_2116 | 33769 | GTCN_3716 | 47828 | ATCN_1277 | 33812 | CTCN_6966 | 47871 |
| CTCN_2117 | 33770 | CTCN_6950 | 47829 | TTCN_1779 | 33813 | CTCN_6967 | 47872 |
| TTCN_1765 | 33771 | GTCN_3717 | 47830 | GTCN_1176 | 33814 | GTCN_3724 | 47873 |

FIG. 37 (continued)

| | | | |
|---|---|---|---|
| TTCN_1780 | 33815 | GTCN_3725 | 47874 |
| ATCN_1278 | 33816 | GTCN_3726 | 47875 |
| CTCN_2125 | 33817 | TTCN_5743 | 47876 |
| TTCN_1781 | 33818 | CTCN_6968 | 47877 |
| CTCN_2126 | 33819 | CTCN_6969 | 47878 |
| GTCN_1177 | 33820 | CTCN_6970 | 47879 |
| CTCN_2127 | 33821 | TTCN_5744 | 47880 |
| ATCN_1279 | 33822 | GTCN_3727 | 47881 |
| ATCN_1280 | 33823 | ATCN_3983 | 47882 |
| CTCN_2128 | 33824 | TTCN_5745 | 47883 |
| CTCN_2129 | 33825 | TTCN_5746 | 47884 |
| ATCN_1281 | 33826 | ATCN_3984 | 47885 |
| ATCN_1282 | 33827 | CTCN_6971 | 47886 |
| TTCN_1782 | 33828 | CTCN_6972 | 47887 |
| GTCN_1178 | 33829 | ATCN_3985 | 47888 |
| CTCN_2130 | 33830 | GTCN_3728 | 47889 |
| ATCN_1283 | 33831 | CTCN_6973 | 47890 |
| CTCN_2131 | 33832 | TTCN_5747 | 47891 |
| CTCN_2132 | 33833 | TTCN_5748 | 47892 |
| CTCN_2133 | 33834 | GTCN_3729 | 47893 |
| ATCN_1284 | 33835 | CTCN_6974 | 47894 |
| ATCN_1285 | 33836 | CTCN_6975 | 47895 |
| TTCN_1783 | 33837 | ATCN_3986 | 47896 |
| CTCN_2134 | 33838 | TTCN_5749 | 47897 |
| CTCN_2135 | 33839 | CTCN_6976 | 47898 |
| CTCN_2136 | 33840 | CTCN_6977 | 47899 |
| CTCN_2137 | 33841 | TTCN_5750 | 47900 |
| ATCN_1286 | 33842 | TTCN_5751 | 47901 |
| ATCN_1287 | 33843 | CTCN_6978 | 47902 |
| CTCN_2138 | 33844 | TTCN_5752 | 47903 |
| CTCN_2139 | 33845 | TTCN_5753 | 47904 |
| CTCN_2140 | 33846 | GTCN_3730 | 47905 |
| GTCN_1179 | 33847 | CTCN_6979 | 47906 |
| CTCN_2141 | 33848 | TTCN_5754 | 47907 |
| TTCN_1784 | 33849 | GTCN_3731 | 47908 |
| CTCN_2142 | 33850 | GTCN_3732 | 47909 |
| CTCN_2143 | 33851 | TTCN_5755 | 47910 |
| CTCN_2144 | 33852 | TTCN_5756 | 47911 |
| ATCN_1288 | 33853 | TTCN_5757 | 47912 |
| GTCN_1180 | 33854 | ATCN_3987 | 47913 |
| CTCN_2145 | 33855 | ATCN_3988 | 47914 |
| CTCN_2146 | 33856 | TTCN_5758 | 47915 |
| CTCN_2147 | 33857 | CTCN_6980 | 47916 |

| | | | |
|---|---|---|---|
| TTCN_1785 | 33858 | TTCN_5759 | 47917 |
| ATCN_1289 | 33859 | TTCN_5760 | 47918 |
| TTCN_1786 | 33860 | TTCN_5761 | 47919 |
| TTCN_1787 | 33861 | CTCN_6981 | 47920 |
| TTCN_1788 | 33862 | CTCN_6982 | 47921 |
| CTCN_2148 | 33863 | TTCN_5762 | 47922 |
| GTCN_1181 | 33864 | GTCN_3733 | 47923 |
| CTCN_2149 | 33865 | ATCN_3989 | 47924 |
| GTCN_1182 | 33866 | CTCN_6983 | 47925 |
| TTCN_1789 | 33867 | TTCN_5763 | 47926 |
| CTCN_2150 | 33868 | TTCN_5764 | 47927 |
| TTCN_1790 | 33869 | CTCN_6984 | 47928 |
| CTCN_2151 | 33870 | ATCN_3990 | 47929 |
| CTCN_2152 | 33871 | TTCN_5765 | 47930 |
| CTCN_2153 | 33872 | TTCN_5766 | 47931 |
| ATCN_1290 | 33873 | ATCN_3991 | 47932 |
| ATCN_1291 | 33874 | TTCN_5767 | 47933 |
| CTCN_2154 | 33875 | ATCN_3992 | 47934 |
| CTCN_2155 | 33876 | CTCN_6985 | 47935 |
| TTCN_1791 | 33877 | TTCN_5768 | 47936 |
| CTCN_2156 | 33878 | GTCN_3734 | 47937 |
| TTCN_1792 | 33879 | ATCN_3993 | 47938 |
| ATCN_1292 | 33880 | TTCN_5769 | 47939 |
| TTCN_1793 | 33881 | TTCN_5770 | 47940 |
| GTCN_1183 | 33882 | GTCN_3735 | 47941 |
| CTCN_2157 | 33883 | CTCN_6986 | 47942 |
| CTCN_2158 | 33884 | ATCN_3994 | 47943 |
| ATCN_1293 | 33885 | ATCN_3995 | 47944 |
| ATCN_1294 | 33886 | CTCN_6987 | 47945 |
| TTCN_1794 | 33887 | ATCN_3996 | 47946 |
| ATCN_1295 | 33888 | GTCN_3736 | 47947 |
| TTCN_1795 | 33889 | TTCN_5771 | 47948 |
| TTCN_1796 | 33890 | TTCN_5772 | 47949 |
| TTCN_1797 | 33891 | GTCN_3737 | 47950 |
| ATCN_1296 | 33892 | TTCN_5773 | 47951 |
| TTCN_1798 | 33893 | TTCN_5774 | 47952 |
| TTCN_1799 | 33894 | CTCN_6988 | 47953 |
| GTCN_1184 | 33895 | GTCN_3738 | 47954 |
| TTCN_1800 | 33896 | ATCN_3997 | 47955 |
| CTCN_2159 | 33897 | ATCN_3998 | 47956 |
| GTCN_1185 | 33898 | CTCN_6989 | 47957 |
| CTCN_2160 | 33899 | TTCN_5775 | 47958 |
| CTCN_2161 | 33900 | ATCN_3999 | 47959 |

FIG. 37 (continued)

| | | | |
|---|---|---|---|
| ATCN_1297 | 33901 | ATCN_4000 | 47960 |
| ATCN_1298 | 33902 | TTCN_5776 | 47961 |
| ATCN_1299 | 33903 | TTCN_5777 | 47962 |
| TTCN_1801 | 33904 | TTCN_5778 | 47963 |
| TTCN_1802 | 33905 | ATCN_4001 | 47964 |
| TTCN_1803 | 33906 | TTCN_5779 | 47965 |
| ATCN_1300 | 33907 | ATCN_4002 | 47966 |
| ATCN_1301 | 33908 | CTCN_6990 | 47967 |
| GTCN_1186 | 33909 | CTCN_6991 | 47968 |
| CTCN_2162 | 33910 | TTCN_5780 | 47969 |
| ATCN_1302 | 33911 | ATCN_4003 | 47970 |
| CTCN_2163 | 33912 | GTCN_3739 | 47971 |
| CTCN_2164 | 33913 | TTCN_5781 | 47972 |
| CTCN_2165 | 33914 | TTCN_5782 | 47973 |
| CTCN_2166 | 33915 | CTCN_6992 | 47974 |
| TTCN_1804 | 33916 | TTCN_5783 | 47975 |
| GTCN_1187 | 33917 | GTCN_3740 | 47976 |
| CTCN_2167 | 33918 | CTCN_6993 | 47977 |
| TTCN_1805 | 33919 | TTCN_5784 | 47978 |
| ATCN_1303 | 33920 | TTCN_5785 | 47979 |
| TTCN_1806 | 33921 | CTCN_6994 | 47980 |
| GTCN_1188 | 33922 | ATCN_4004 | 47981 |
| CTCN_2168 | 33923 | CTCN_6995 | 47982 |
| TTCN_1807 | 33924 | TTCN_5786 | 47983 |
| TTCN_1808 | 33925 | TTCN_5787 | 47984 |
| GTCN_1189 | 33926 | ATCN_4005 | 47985 |
| GTCN_1190 | 33927 | TTCN_5788 | 47986 |
| ATCN_1304 | 33928 | CTCN_6996 | 47987 |
| TTCN_1809 | 33929 | TTCN_5789 | 47988 |
| ATCN_1305 | 33930 | TTCN_5790 | 47989 |
| TTCN_1810 | 33931 | ATCN_4006 | 47990 |
| TTCN_1811 | 33932 | ATCN_4007 | 47991 |
| CTCN_2169 | 33933 | ATCN_4008 | 47992 |
| CTCN_2170 | 33934 | CTCN_6997 | 47993 |
| TTCN_1812 | 33935 | ATCN_4009 | 47994 |
| ATCN_1306 | 33936 | ATCN_4010 | 47995 |
| ATCN_1307 | 33937 | GTCN_3741 | 47996 |
| ATCN_1308 | 33938 | GTCN_3742 | 47997 |
| TTCN_1813 | 33939 | TTCN_5791 | 47998 |
| CTCN_2171 | 33940 | CTCN_6998 | 47999 |
| CTCN_2172 | 33941 | TTCN_5792 | 48000 |
| GTCN_1191 | 33942 | CTCN_6999 | 48001 |
| TTCN_1814 | 33943 | ATCN_4011 | 48002 |

| | | | |
|---|---|---|---|
| ATCN_1309 | 33944 | CTCN_7000 | 48003 |
| TTCN_1815 | 33945 | GTCN_3743 | 48004 |
| ATCN_1310 | 33946 | ATCN_4012 | 48005 |
| GTCN_1192 | 33947 | TTCN_5793 | 48006 |
| TTCN_1816 | 33948 | GTCN_3744 | 48007 |
| CTCN_2173 | 33949 | TTCN_5794 | 48008 |
| TTCN_1817 | 33950 | ATCN_4013 | 48009 |
| GTCN_1193 | 33951 | GTCN_3745 | 48010 |
| TTCN_1818 | 33952 | TTCN_5795 | 48011 |
| ATCN_1311 | 33953 | ATCN_4014 | 48012 |
| TTCN_1819 | 33954 | ATCN_4015 | 48013 |
| ATCN_1312 | 33955 | TTCN_5796 | 48014 |
| TTCN_1820 | 33956 | TTCN_5797 | 48015 |
| TTCN_1821 | 33957 | CTCN_7001 | 48016 |
| CTCN_2174 | 33958 | TTCN_5798 | 48017 |
| TTCN_1822 | 33959 | ATCN_4016 | 48018 |
| GTCN_1194 | 33960 | TTCN_5799 | 48019 |
| CTCN_2175 | 33961 | CTCN_7002 | 48020 |
| TTCN_1823 | 33962 | TTCN_5800 | 48021 |
| TTCN_1824 | 33963 | TTCN_5801 | 48022 |
| TTCN_1825 | 33964 | GTCN_3746 | 48023 |
| CTCN_2176 | 33965 | TTCN_5802 | 48024 |
| TTCN_1826 | 33966 | ATCN_4017 | 48025 |
| ATCN_1313 | 33967 | ATCN_4018 | 48026 |
| CTCN_2177 | 33968 | ATCN_4019 | 48027 |
| ATCN_1314 | 33969 | ATCN_4020 | 48028 |
| TTCN_1827 | 33970 | ATCN_4021 | 48029 |
| CTCN_2178 | 33971 | TTCN_5803 | 48030 |
| CTCN_2179 | 33972 | TTCN_5804 | 48031 |
| TTCN_1828 | 33973 | ATCN_4022 | 48032 |
| TTCN_1829 | 33974 | ATCN_4023 | 48033 |
| TTCN_1830 | 33975 | TTCN_5805 | 48034 |
| ATCN_1315 | 33976 | TTCN_5806 | 48035 |
| ATCN_1316 | 33977 | GTCN_3747 | 48036 |
| CTCN_2180 | 33978 | CTCN_7003 | 48037 |
| CTCN_2181 | 33979 | ATCN_4024 | 48038 |
| CTCN_2182 | 33980 | CTCN_7004 | 48039 |
| ATCN_1317 | 33981 | TTCN_5807 | 48040 |
| TTCN_1831 | 33982 | TTCN_5808 | 48041 |
| GTCN_1195 | 33983 | CTCN_7005 | 48042 |
| CTCN_2183 | 33984 | GTCN_3748 | 48043 |
| ATCN_1318 | 33985 | ATCN_4025 | 48044 |
| GTCN_1196 | 33986 | CTCN_7006 | 48045 |

FIG. 37 (continued)

| | | | |
|---|---|---|---|
| ATCN_1319 | 33987 | CTCN_7007 | 48046 |
| ATCN_1320 | 33988 | GTCN_3749 | 48047 |
| TTCN_1832 | 33989 | CTCN_7008 | 48048 |
| CTCN_2184 | 33990 | CTCN_7009 | 48049 |
| CTCN_2185 | 33991 | CTCN_7010 | 48050 |
| TTCN_1833 | 33992 | CTCN_7011 | 48051 |
| TTCN_1834 | 33993 | TTCN_5809 | 48052 |
| ATCN_1321 | 33994 | CTCN_7012 | 48053 |
| TTCN_1835 | 33995 | TTCN_5810 | 48054 |
| ATCN_1322 | 33996 | TTCN_5811 | 48055 |
| TTCN_1836 | 33997 | TTCN_5812 | 48056 |
| TTCN_1837 | 33998 | CTCN_7013 | 48057 |
| TTCN_1838 | 33999 | CTCN_7014 | 48058 |
| ATCN_1323 | 34000 | TTCN_5813 | 48059 |
| TTCN_1839 | 34001 | TTCN_5814 | 48060 |
| ATCN_1324 | 34002 | CTCN_7015 | 48061 |
| ATCN_1325 | 34003 | CTCN_7016 | 48062 |
| TTCN_1840 | 34004 | TTCN_5815 | 48063 |
| TTCN_1841 | 34005 | CTCN_7017 | 48064 |
| ATCN_1326 | 34006 | ATCN_4026 | 48065 |
| GTCN_1197 | 34007 | GTCN_3750 | 48066 |
| CTCN_2186 | 34008 | ATCN_4027 | 48067 |
| ATCN_1327 | 34009 | TTCN_5816 | 48068 |
| ATCN_1328 | 34010 | TTCN_5817 | 48069 |
| CTCN_2187 | 34011 | GTCN_3751 | 48070 |
| CTCN_2188 | 34012 | GTCN_3752 | 48071 |
| TTCN_1842 | 34013 | ATCN_4028 | 48072 |
| CTCN_2189 | 34014 | ATCN_4029 | 48073 |
| CTCN_2190 | 34015 | ATCN_4030 | 48074 |
| TTCN_1843 | 34016 | ATCN_4031 | 48075 |
| ATCN_1329 | 34017 | CTCN_7018 | 48076 |
| CTCN_2191 | 34018 | GTCN_3753 | 48077 |
| TTCN_1844 | 34019 | CTCN_7019 | 48078 |
| ATCN_1330 | 34020 | GTCN_3754 | 48079 |
| TTCN_1845 | 34021 | ATCN_4032 | 48080 |
| CTCN_2192 | 34022 | ATCN_4033 | 48081 |
| CTCN_2193 | 34023 | CTCN_7020 | 48082 |
| GTCN_1198 | 34024 | CTCN_7021 | 48083 |
| TTCN_1846 | 34025 | CTCN_7022 | 48084 |
| CTCN_2194 | 34026 | TTCN_5818 | 48085 |
| TTCN_1847 | 34027 | GTCN_3755 | 48086 |
| TTCN_1848 | 34028 | CTCN_7023 | 48087 |
| TTCN_1849 | 34029 | TTCN_5819 | 48088 |

| | | | |
|---|---|---|---|
| TTCN_1850 | 34030 | ATCN_4034 | 48089 |
| ATCN_1331 | 34031 | ATCN_4035 | 48090 |
| ATCN_1332 | 34032 | GTCN_3756 | 48091 |
| ATCN_1333 | 34033 | TTCN_5820 | 48092 |
| ATCN_1334 | 34034 | GTCN_3757 | 48093 |
| TTCN_1851 | 34035 | CTCN_7024 | 48094 |
| GTCN_1199 | 34036 | ATCN_4036 | 48095 |
| GTCN_1200 | 34037 | ATCN_4037 | 48096 |
| GTCN_1201 | 34038 | TTCN_5821 | 48097 |
| CTCN_2195 | 34039 | CTCN_7025 | 48098 |
| CTCN_2196 | 34040 | ATCN_4038 | 48099 |
| CTCN_2197 | 34041 | CTCN_7026 | 48100 |
| TTCN_1852 | 34042 | TTCN_5822 | 48101 |
| TTCN_1853 | 34043 | TTCN_5823 | 48102 |
| CTCN_2198 | 34044 | TTCN_5824 | 48103 |
| GTCN_1202 | 34045 | TTCN_5825 | 48104 |
| CTCN_2199 | 34046 | GTCN_3758 | 48105 |
| TTCN_1854 | 34047 | TTCN_5826 | 48106 |
| GTCN_1203 | 34048 | TTCN_5827 | 48107 |
| ATCN_1335 | 34049 | TTCN_5828 | 48108 |
| ATCN_1336 | 34050 | CTCN_7027 | 48109 |
| TTCN_1855 | 34051 | GTCN_3759 | 48110 |
| ATCN_1337 | 34052 | CTCN_7028 | 48111 |
| GTCN_1204 | 34053 | CTCN_7029 | 48112 |
| ATCN_1338 | 34054 | GTCN_3760 | 48113 |
| GTCN_1205 | 34055 | CTCN_7030 | 48114 |
| ATCN_1339 | 34056 | ATCN_4039 | 48115 |
| ATCN_1340 | 34057 | TTCN_5829 | 48116 |
| GTCN_1206 | 34058 | CTCN_7031 | 48117 |
| CTCN_2200 | 34059 | CTCN_7032 | 48118 |
| TTCN_1856 | 34060 | GTCN_3761 | 48119 |
| ATCN_1341 | 34061 | TTCN_5830 | 48120 |
| ATCN_1342 | 34062 | TTCN_5831 | 48121 |
| ATCN_1343 | 34063 | TTCN_5832 | 48122 |
| ATCN_1344 | 34064 | ATCN_4040 | 48123 |
| CTCN_2201 | 34065 | CTCN_7033 | 48124 |
| ATCN_1345 | 34066 | CTCN_7034 | 48125 |
| TTCN_1857 | 34067 | TTCN_5833 | 48126 |
| ATCN_1346 | 34068 | CTCN_7035 | 48127 |
| TTCN_1858 | 34069 | ATCN_4041 | 48128 |
| GTCN_1207 | 34070 | TTCN_5834 | 48129 |
| TTCN_1859 | 34071 | GTCN_3762 | 48130 |
| GTCN_1208 | 34072 | CTCN_7036 | 48131 |

FIG. 37 (continued)

| | | | |
|---|---|---|---|
| TTCN_1860 | 34073 | TTCN_5835 | 48132 |
| CTCN_2202 | 34074 | CTCN_7037 | 48133 |
| ATCN_1347 | 34075 | TTCN_5836 | 48134 |
| TTCN_1861 | 34076 | ATCN_4042 | 48135 |
| TTCN_1862 | 34077 | GTCN_3763 | 48136 |
| CTCN_2203 | 34078 | CTCN_7038 | 48137 |
| ATCN_1348 | 34079 | CTCN_7039 | 48138 |
| TTCN_1863 | 34080 | CTCN_7040 | 48139 |
| ATCN_1349 | 34081 | TTCN_5837 | 48140 |
| ATCN_1350 | 34082 | CTCN_7041 | 48141 |
| CTCN_2204 | 34083 | GTCN_3764 | 48142 |
| TTCN_1864 | 34084 | TTCN_5838 | 48143 |
| ATCN_1351 | 34085 | ATCN_4043 | 48144 |
| TTCN_1865 | 34086 | TTCN_5839 | 48145 |
| TTCN_1866 | 34087 | ATCN_4044 | 48146 |
| GTCN_1209 | 34088 | TTCN_5840 | 48147 |
| TTCN_1867 | 34089 | CTCN_7042 | 48148 |
| TTCN_1868 | 34090 | CTCN_7043 | 48149 |
| TTCN_1869 | 34091 | TTCN_5841 | 48150 |
| GTCN_1210 | 34092 | CTCN_7044 | 48151 |
| ATCN_1352 | 34093 | CTCN_7045 | 48152 |
| ATCN_1353 | 34094 | GTCN_3765 | 48153 |
| TTCN_1870 | 34095 | GTCN_3766 | 48154 |
| TTCN_1871 | 34096 | TTCN_5842 | 48155 |
| TTCN_1872 | 34097 | CTCN_7046 | 48156 |
| TTCN_1873 | 34098 | CTCN_7047 | 48157 |
| CTCN_2205 | 34099 | CTCN_7048 | 48158 |
| ATCN_1354 | 34100 | GTCN_3767 | 48159 |
| ATCN_1355 | 34101 | CTCN_7049 | 48160 |
| TTCN_1874 | 34102 | GTCN_3768 | 48161 |
| TTCN_1875 | 34103 | CTCN_7050 | 48162 |
| ATCN_1356 | 34104 | GTCN_3769 | 48163 |
| ATCN_1357 | 34105 | GTCN_3770 | 48164 |
| TTCN_1876 | 34106 | CTCN_7051 | 48165 |
| CTCN_2206 | 34107 | CTCN_7052 | 48166 |
| ATCN_1358 | 34108 | ATCN_4045 | 48167 |
| TTCN_1877 | 34109 | GTCN_3771 | 48168 |
| TTCN_1878 | 34110 | TTCN_5843 | 48169 |
| TTCN_1879 | 34111 | GTCN_3772 | 48170 |
| TTCN_1880 | 34112 | TTCN_5844 | 48171 |
| TTCN_1881 | 34113 | ATCN_4046 | 48172 |
| TTCN_1882 | 34114 | ATCN_4047 | 48173 |
| GTCN_1211 | 34115 | TTCN_5845 | 48174 |

| | | | |
|---|---|---|---|
| ATCN_1359 | 34116 | TTCN_5846 | 48175 |
| ATCN_1360 | 34117 | ATCN_4048 | 48176 |
| TTCN_1883 | 34118 | CTCN_7053 | 48177 |
| ATCN_1361 | 34119 | TTCN_5847 | 48178 |
| TTCN_1884 | 34120 | GTCN_3773 | 48179 |
| TTCN_1885 | 34121 | TTCN_5848 | 48180 |
| CTCN_2207 | 34122 | ATCN_4049 | 48181 |
| TTCN_1886 | 34123 | CTCN_7054 | 48182 |
| ATCN_1362 | 34124 | TTCN_5849 | 48183 |
| TTCN_1887 | 34125 | GTCN_3774 | 48184 |
| TTCN_1888 | 34126 | ATCN_4050 | 48185 |
| TTCN_1889 | 34127 | TTCN_5850 | 48186 |
| TTCN_1890 | 34128 | CTCN_7055 | 48187 |
| CTCN_2208 | 34129 | TTCN_5851 | 48188 |
| GTCN_1212 | 34130 | CTCN_7056 | 48189 |
| TTCN_1891 | 34131 | ATCN_4051 | 48190 |
| TTCN_1892 | 34132 | ATCN_4052 | 48191 |
| TTCN_1893 | 34133 | TTCN_5852 | 48192 |
| ATCN_1363 | 34134 | ATCN_4053 | 48193 |
| CTCN_2209 | 34135 | CTCN_7057 | 48194 |
| TTCN_1894 | 34136 | TTCN_5853 | 48195 |
| ATCN_1364 | 34137 | TTCN_5854 | 48196 |
| CTCN_2210 | 34138 | GTCN_3775 | 48197 |
| GTCN_1213 | 34139 | ATCN_4054 | 48198 |
| GTCN_1214 | 34140 | CTCN_7058 | 48199 |
| TTCN_1895 | 34141 | CTCN_7059 | 48200 |
| GTCN_1215 | 34142 | CTCN_7060 | 48201 |
| ATCN_1365 | 34143 | GTCN_3776 | 48202 |
| GTCN_1216 | 34144 | ATCN_4055 | 48203 |
| TTCN_1896 | 34145 | ATCN_4056 | 48204 |
| TTCN_1897 | 34146 | GTCN_3777 | 48205 |
| TTCN_1898 | 34147 | ATCN_4057 | 48206 |
| TTCN_1899 | 34148 | ATCN_4058 | 48207 |
| GTCN_1217 | 34149 | GTCN_3778 | 48208 |
| TTCN_1900 | 34150 | GTCN_3779 | 48209 |
| CTCN_2211 | 34151 | TTCN_5855 | 48210 |
| ATCN_1366 | 34152 | CTCN_7061 | 48211 |
| CTCN_2212 | 34153 | CTCN_7062 | 48212 |
| ATCN_1367 | 34154 | GTCN_3780 | 48213 |
| ATCN_1368 | 34155 | ATCN_4059 | 48214 |
| TTCN_1901 | 34156 | CTCN_7063 | 48215 |
| GTCN_1218 | 34157 | TTCN_5856 | 48216 |
| GTCN_1219 | 34158 | CTCN_7064 | 48217 |

FIG. 37 (continued)

| | | | |
|---|---|---|---|
| ATCN_1369 | 34159 | GTCN_3781 | 48218 |
| TTCN_1902 | 34160 | TTCN_5857 | 48219 |
| ATCN_1370 | 34161 | ATCN_4060 | 48220 |
| CTCN_2213 | 34162 | ATCN_4061 | 48221 |
| CTCN_2214 | 34163 | ATCN_4062 | 48222 |
| CTCN_2215 | 34164 | GTCN_3782 | 48223 |
| TTCN_1903 | 34165 | GTCN_3783 | 48224 |
| ATCN_1371 | 34166 | CTCN_7065 | 48225 |
| ATCN_1372 | 34167 | GTCN_3784 | 48226 |
| CTCN_2216 | 34168 | ATCN_4063 | 48227 |
| ATCN_1373 | 34169 | ATCN_4064 | 48228 |
| TTCN_1904 | 34170 | TTCN_5858 | 48229 |
| ATCN_1374 | 34171 | TTCN_5859 | 48230 |
| ATCN_1375 | 34172 | CTCN_7066 | 48231 |
| GTCN_1220 | 34173 | GTCN_3785 | 48232 |
| TTCN_1905 | 34174 | TTCN_5860 | 48233 |
| CTCN_2217 | 34175 | GTCN_3786 | 48234 |
| ATCN_1376 | 34176 | TTCN_5861 | 48235 |
| ATCN_1377 | 34177 | TTCN_5862 | 48236 |
| GTCN_1221 | 34178 | TTCN_5863 | 48237 |
| TTCN_1906 | 34179 | CTCN_7067 | 48238 |
| ATCN_1378 | 34180 | CTCN_7068 | 48239 |
| ATCN_1379 | 34181 | CTCN_7069 | 48240 |
| ATCN_1380 | 34182 | ATCN_4065 | 48241 |
| CTCN_2218 | 34183 | ATCN_4066 | 48242 |
| TTCN_1907 | 34184 | TTCN_5864 | 48243 |
| ATCN_1381 | 34185 | ATCN_4067 | 48244 |
| GTCN_1222 | 34186 | TTCN_5865 | 48245 |
| TTCN_1908 | 34187 | GTCN_3787 | 48246 |
| CTCN_2219 | 34188 | TTCN_5866 | 48247 |
| TTCN_1909 | 34189 | CTCN_7070 | 48248 |
| TTCN_1910 | 34190 | GTCN_3788 | 48249 |
| TTCN_1911 | 34191 | CTCN_7071 | 48250 |
| GTCN_1223 | 34192 | GTCN_3789 | 48251 |
| CTCN_2220 | 34193 | ATCN_4068 | 48252 |
| ATCN_1382 | 34194 | TTCN_5867 | 48253 |
| CTCN_2221 | 34195 | TTCN_5868 | 48254 |
| GTCN_1224 | 34196 | CTCN_7072 | 48255 |
| CTCN_2222 | 34197 | CTCN_7073 | 48256 |
| GTCN_1225 | 34198 | ATCN_4069 | 48257 |
| CTCN_2223 | 34199 | CTCN_7074 | 48258 |
| ATCN_1383 | 34200 | GTCN_3790 | 48259 |
| CTCN_2224 | 34201 | TTCN_5869 | 48260 |
| CTCN_2225 | 34202 | TTCN_5870 | 48261 |
| TTCN_1912 | 34203 | TTCN_5871 | 48262 |
| TTCN_1913 | 34204 | ATCN_4070 | 48263 |
| TTCN_1914 | 34205 | CTCN_7075 | 48264 |
| CTCN_2226 | 34206 | TTCN_5872 | 48265 |
| CTCN_2227 | 34207 | GTCN_3791 | 48266 |
| CTCN_2228 | 34208 | CTCN_7076 | 48267 |
| CTCN_2229 | 34209 | TTCN_5873 | 48268 |
| ATCN_1384 | 34210 | CTCN_7077 | 48269 |
| GTCN_1226 | 34211 | CTCN_7078 | 48270 |
| CTCN_2230 | 34212 | GTCN_3792 | 48271 |
| ATCN_1385 | 34213 | GTCN_3793 | 48272 |
| TTCN_1915 | 34214 | CTCN_7079 | 48273 |
| GTCN_1227 | 34215 | TTCN_5874 | 48274 |
| TTCN_1916 | 34216 | TTCN_5875 | 48275 |
| TTCN_1917 | 34217 | ATCN_4071 | 48276 |
| CTCN_2231 | 34218 | TTCN_5876 | 48277 |
| GTCN_1228 | 34219 | TTCN_5877 | 48278 |
| CTCN_2232 | 34220 | ATCN_4072 | 48279 |
| ATCN_1386 | 34221 | ATCN_4073 | 48280 |
| ATCN_1387 | 34222 | ATCN_4074 | 48281 |
| CTCN_2233 | 34223 | GTCN_3794 | 48282 |
| ATCN_1388 | 34224 | TTCN_5878 | 48283 |
| CTCN_2234 | 34225 | TTCN_5879 | 48284 |
| GTCN_1229 | 34226 | CTCN_7080 | 48285 |
| TTCN_1918 | 34227 | TTCN_5880 | 48286 |
| GTCN_1230 | 34228 | GTCN_3795 | 48287 |
| ATCN_1389 | 34229 | TTCN_5881 | 48288 |
| CTCN_2235 | 34230 | CTCN_7081 | 48289 |
| ATCN_1390 | 34231 | GTCN_3796 | 48290 |
| TTCN_1919 | 34232 | TTCN_5882 | 48291 |
| ATCN_1391 | 34233 | GTCN_3797 | 48292 |
| TTCN_1920 | 34234 | ATCN_4075 | 48293 |
| TTCN_1921 | 34235 | CTCN_7082 | 48294 |
| GTCN_1231 | 34236 | TTCN_5883 | 48295 |
| TTCN_1922 | 34237 | CTCN_7083 | 48296 |
| ATCN_1392 | 34238 | GTCN_3798 | 48297 |
| ATCN_1393 | 34239 | TTCN_5884 | 48298 |
| CTCN_2236 | 34240 | CTCN_7084 | 48299 |
| CTCN_2237 | 34241 | ATCN_4076 | 48300 |
| ATCN_1394 | 34242 | TTCN_5885 | 48301 |
| TTCN_1923 | 34243 | GTCN_3799 | 48302 |
| TTCN_1924 | 34244 | GTCN_3800 | 48303 |

FIG. 37 (continued)

| | | | |
|---|---|---|---|
| CTCN_2238 | 34245 | ATCN_4077 | 48304 |
| CTCN_2239 | 34246 | ATCN_4078 | 48305 |
| GTCN_1232 | 34247 | TTCN_5886 | 48306 |
| GTCN_1233 | 34248 | TTCN_5887 | 48307 |
| TTCN_1925 | 34249 | CTCN_7085 | 48308 |
| GTCN_1234 | 34250 | CTCN_7086 | 48309 |
| TTCN_1926 | 34251 | TTCN_5888 | 48310 |
| ATCN_1395 | 34252 | ATCN_4079 | 48311 |
| GTCN_1235 | 34253 | TTCN_5889 | 48312 |
| TTCN_1927 | 34254 | TTCN_5890 | 48313 |
| CTCN_2240 | 34255 | GTCN_3801 | 48314 |
| TTCN_1928 | 34256 | GTCN_3802 | 48315 |
| CTCN_2241 | 34257 | CTCN_7087 | 48316 |
| TTCN_1929 | 34258 | TTCN_5891 | 48317 |
| CTCN_2242 | 34259 | TTCN_5892 | 48318 |
| GTCN_1236 | 34260 | TTCN_5893 | 48319 |
| ATCN_1396 | 34261 | ATCN_4080 | 48320 |
| TTCN_1930 | 34262 | ATCN_4081 | 48321 |
| TTCN_1931 | 34263 | TTCN_5894 | 48322 |
| TTCN_1932 | 34264 | TTCN_5895 | 48323 |
| ATCN_1397 | 34265 | GTCN_3803 | 48324 |
| CTCN_2243 | 34266 | ATCN_4082 | 48325 |
| ATCN_1398 | 34267 | CTCN_7088 | 48326 |
| TTCN_1933 | 34268 | TTCN_5896 | 48327 |
| CTCN_2244 | 34269 | CTCN_7089 | 48328 |
| ATCN_1399 | 34270 | GTCN_3804 | 48329 |
| CTCN_2245 | 34271 | CTCN_7090 | 48330 |
| GTCN_1237 | 34272 | ATCN_4083 | 48331 |
| GTCN_1238 | 34273 | TTCN_5897 | 48332 |
| CTCN_2246 | 34274 | CTCN_7091 | 48333 |
| ATCN_1400 | 34275 | TTCN_5898 | 48334 |
| CTCN_2247 | 34276 | ATCN_4084 | 48335 |
| CTCN_2248 | 34277 | CTCN_7092 | 48336 |
| CTCN_2249 | 34278 | GTCN_3805 | 48337 |
| CTCN_2250 | 34279 | CTCN_7093 | 48338 |
| CTCN_2251 | 34280 | CTCN_7094 | 48339 |
| CTCN_2252 | 34281 | TTCN_5899 | 48340 |
| CTCN_2253 | 34282 | GTCN_3806 | 48341 |
| TTCN_1934 | 34283 | GTCN_3807 | 48342 |
| GTCN_1239 | 34284 | TTCN_5900 | 48343 |
| TTCN_1935 | 34285 | TTCN_5901 | 48344 |
| GTCN_1240 | 34286 | TTCN_5902 | 48345 |
| ATCN_1401 | 34287 | TTCN_5903 | 48346 |

| | | | |
|---|---|---|---|
| TTCN_1936 | 34288 | ATCN_4085 | 48347 |
| TTCN_1937 | 34289 | GTCN_3808 | 48348 |
| GTCN_1241 | 34290 | ATCN_4086 | 48349 |
| CTCN_2254 | 34291 | GTCN_3809 | 48350 |
| TTCN_1938 | 34292 | CTCN_7095 | 48351 |
| TTCN_1939 | 34293 | ATCN_4087 | 48352 |
| TTCN_1940 | 34294 | TTCN_5904 | 48353 |
| TTCN_1941 | 34295 | TTCN_5905 | 48354 |
| TTCN_1942 | 34296 | ATCN_4088 | 48355 |
| CTCN_2255 | 34297 | GTCN_3810 | 48356 |
| TTCN_1943 | 34298 | TTCN_5906 | 48357 |
| GTCN_1242 | 34299 | CTCN_7096 | 48358 |
| CTCN_2256 | 34300 | GTCN_3811 | 48359 |
| TTCN_1944 | 34301 | ATCN_4089 | 48360 |
| ATCN_1402 | 34302 | CTCN_7097 | 48361 |
| GTCN_1243 | 34303 | ATCN_4090 | 48362 |
| CTCN_2257 | 34304 | GTCN_3812 | 48363 |
| CTCN_2258 | 34305 | TTCN_5907 | 48364 |
| TTCN_1945 | 34306 | GTCN_3813 | 48365 |
| ATCN_1403 | 34307 | CTCN_7098 | 48366 |
| TTCN_1946 | 34308 | ATCN_4091 | 48367 |
| CTCN_2259 | 34309 | TTCN_5908 | 48368 |
| CTCN_2260 | 34310 | GTCN_3814 | 48369 |
| ATCN_1404 | 34311 | GTCN_3815 | 48370 |
| ATCN_1405 | 34312 | TTCN_5909 | 48371 |
| CTCN_2261 | 34313 | ATCN_4092 | 48372 |
| GTCN_1244 | 34314 | CTCN_7099 | 48373 |
| TTCN_1947 | 34315 | GTCN_3816 | 48374 |
| TTCN_1948 | 34316 | CTCN_7100 | 48375 |
| ATCN_1406 | 34317 | ATCN_4093 | 48376 |
| GTCN_1245 | 34318 | TTCN_5910 | 48377 |
| CTCN_2262 | 34319 | TTCN_5911 | 48378 |
| TTCN_1949 | 34320 | GTCN_3817 | 48379 |
| CTCN_2263 | 34321 | CTCN_7101 | 48380 |
| CTCN_2264 | 34322 | ATCN_4094 | 48381 |
| ATCN_1407 | 34323 | ATCN_4095 | 48382 |
| ATCN_1408 | 34324 | TTCN_5912 | 48383 |
| CTCN_2265 | 34325 | TTCN_5913 | 48384 |
| GTCN_1246 | 34326 | TTCN_5914 | 48385 |
| TTCN_1950 | 34327 | CTCN_7102 | 48386 |
| TTCN_1951 | 34328 | GTCN_3818 | 48387 |
| GTCN_1247 | 34329 | ATCN_4096 | 48388 |
| TTCN_1952 | 34330 | TTCN_5915 | 48389 |

FIG. 37 (continued)

| | | | |
|---|---|---|---|
| CTCN_2266 | 34331 | TTCN_5916 | 48390 |
| TTCN_1953 | 34332 | ATCN_4097 | 48391 |
| GTCN_1248 | 34333 | CTCN_7103 | 48392 |
| TTCN_1954 | 34334 | CTCN_7104 | 48393 |
| ATCN_1409 | 34335 | TTCN_5917 | 48394 |
| TTCN_1955 | 34336 | CTCN_7105 | 48395 |
| ATCN_1410 | 34337 | TTCN_5918 | 48396 |
| GTCN_1249 | 34338 | TTCN_5919 | 48397 |
| TTCN_1956 | 34339 | TTCN_5920 | 48398 |
| ATCN_1411 | 34340 | TTCN_5921 | 48399 |
| CTCN_2267 | 34341 | CTCN_7106 | 48400 |
| ATCN_1412 | 34342 | TTCN_5922 | 48401 |
| GTCN_1250 | 34343 | CTCN_7107 | 48402 |
| TTCN_1957 | 34344 | ATCN_4098 | 48403 |
| GTCN_1251 | 34345 | TTCN_5923 | 48404 |
| CTCN_2268 | 34346 | TTCN_5924 | 48405 |
| GTCN_1252 | 34347 | ATCN_4099 | 48406 |
| CTCN_2269 | 34348 | TTCN_5925 | 48407 |
| TTCN_1958 | 34349 | ATCN_4100 | 48408 |
| ATCN_1413 | 34350 | GTCN_3819 | 48409 |
| TTCN_1959 | 34351 | TTCN_5926 | 48410 |
| CTCN_2270 | 34352 | TTCN_5927 | 48411 |
| CTCN_2271 | 34353 | GTCN_3820 | 48412 |
| CTCN_2272 | 34354 | CTCN_7108 | 48413 |
| GTCN_1253 | 34355 | TTCN_5928 | 48414 |
| CTCN_2273 | 34356 | GTCN_3821 | 48415 |
| ATCN_1414 | 34357 | CTCN_7109 | 48416 |
| CTCN_2274 | 34358 | ATCN_4101 | 48417 |
| CTCN_2275 | 34359 | TTCN_5929 | 48418 |
| ATCN_1415 | 34360 | GTCN_3822 | 48419 |
| ATCN_1416 | 34361 | CTCN_7110 | 48420 |
| ATCN_1417 | 34362 | TTCN_5930 | 48421 |
| ATCN_1418 | 34363 | ATCN_4102 | 48422 |
| TTCN_1960 | 34364 | ATCN_4103 | 48423 |
| ATCN_1419 | 34365 | CTCN_7111 | 48424 |
| ATCN_1420 | 34366 | CTCN_7112 | 48425 |
| GTCN_1254 | 34367 | CTCN_7113 | 48426 |
| CTCN_2276 | 34368 | TTCN_5931 | 48427 |
| ATCN_1421 | 34369 | ATCN_4104 | 48428 |
| CTCN_2277 | 34370 | CTCN_7114 | 48429 |
| ATCN_1422 | 34371 | TTCN_5932 | 48430 |
| CTCN_2278 | 34372 | TTCN_5933 | 48431 |
| ATCN_1423 | 34373 | TTCN_5934 | 48432 |

| | | | |
|---|---|---|---|
| CTCN_2279 | 34374 | TTCN_5935 | 48433 |
| GTCN_1255 | 34375 | CTCN_7115 | 48434 |
| CTCN_2280 | 34376 | CTCN_7116 | 48435 |
| ATCN_1424 | 34377 | CTCN_7117 | 48436 |
| CTCN_2281 | 34378 | CTCN_7118 | 48437 |
| GTCN_1256 | 34379 | GTCN_3823 | 48438 |
| CTCN_2282 | 34380 | CTCN_7119 | 48439 |
| CTCN_2283 | 34381 | ATCN_4105 | 48440 |
| ATCN_1425 | 34382 | TTCN_5936 | 48441 |
| ATCN_1426 | 34383 | GTCN_3824 | 48442 |
| CTCN_2284 | 34384 | TTCN_5937 | 48443 |
| TTCN_1961 | 34385 | CTCN_7120 | 48444 |
| TTCN_1962 | 34386 | TTCN_5938 | 48445 |
| GTCN_1257 | 34387 | CTCN_7121 | 48446 |
| TTCN_1963 | 34388 | CTCN_7122 | 48447 |
| CTCN_2285 | 34389 | TTCN_5939 | 48448 |
| CTCN_2286 | 34390 | TTCN_5940 | 48449 |
| GTCN_1258 | 34391 | GTCN_3825 | 48450 |
| GTCN_1259 | 34392 | CTCN_7123 | 48451 |
| CTCN_2287 | 34393 | ATCN_4106 | 48452 |
| ATCN_1427 | 34394 | TTCN_5941 | 48453 |
| CTCN_2288 | 34395 | ATCN_4107 | 48454 |
| GTCN_1260 | 34396 | CTCN_7124 | 48455 |
| GTCN_1261 | 34397 | ATCN_4108 | 48456 |
| TTCN_1964 | 34398 | ATCN_4109 | 48457 |
| CTCN_2289 | 34399 | GTCN_3826 | 48458 |
| ATCN_1428 | 34400 | ATCN_4110 | 48459 |
| CTCN_2290 | 34401 | ATCN_4111 | 48460 |
| CTCN_2291 | 34402 | CTCN_7125 | 48461 |
| TTCN_1965 | 34403 | TTCN_5942 | 48462 |
| CTCN_2292 | 34404 | GTCN_3827 | 48463 |
| CTCN_2293 | 34405 | TTCN_5943 | 48464 |
| ATCN_1429 | 34406 | ATCN_4112 | 48465 |
| ATCN_1430 | 34407 | ATCN_4113 | 48466 |
| CTCN_2294 | 34408 | TTCN_5944 | 48467 |
| GTCN_1262 | 34409 | TTCN_5945 | 48468 |
| GTCN_1263 | 34410 | GTCN_3828 | 48469 |
| GTCN_1264 | 34411 | CTCN_7126 | 48470 |
| CTCN_2295 | 34412 | TTCN_5946 | 48471 |
| ATCN_1431 | 34413 | TTCN_5947 | 48472 |
| ATCN_1432 | 34414 | ATCN_4114 | 48473 |
| GTCN_1265 | 34415 | TTCN_5948 | 48474 |
| TTCN_1966 | 34416 | TTCN_5949 | 48475 |

FIG. 37 (continued)

| | | | |
|---|---|---|---|
| ATCN_1433 | 34417 | CTCN_7127 | 48476 |
| CTCN_2296 | 34418 | ATCN_4115 | 48477 |
| CTCN_2297 | 34419 | CTCN_7128 | 48478 |
| TTCN_1967 | 34420 | GTCN_3829 | 48479 |
| ATCN_1434 | 34421 | CTCN_7129 | 48480 |
| TTCN_1968 | 34422 | ATCN_4116 | 48481 |
| GTCN_1266 | 34423 | ATCN_4117 | 48482 |
| GTCN_1267 | 34424 | CTCN_7130 | 48483 |
| CTCN_2298 | 34425 | CTCN_7131 | 48484 |
| CTCN_2299 | 34426 | TTCN_5950 | 48485 |
| GTCN_1268 | 34427 | CTCN_7132 | 48486 |
| TTCN_1969 | 34428 | TTCN_5951 | 48487 |
| CTCN_2300 | 34429 | ATCN_4118 | 48488 |
| ATCN_1435 | 34430 | ATCN_4119 | 48489 |
| CTCN_2301 | 34431 | ATCN_4120 | 48490 |
| TTCN_1970 | 34432 | TTCN_5952 | 48491 |
| TTCN_1971 | 34433 | CTCN_7133 | 48492 |
| CTCN_2302 | 34434 | ATCN_4121 | 48493 |
| GTCN_1269 | 34435 | CTCN_7134 | 48494 |
| CTCN_2303 | 34436 | CTCN_7135 | 48495 |
| TTCN_1972 | 34437 | GTCN_3830 | 48496 |
| ATCN_1436 | 34438 | ATCN_4122 | 48497 |
| CTCN_2304 | 34439 | ATCN_4123 | 48498 |
| GTCN_1270 | 34440 | CTCN_7136 | 48499 |
| TTCN_1973 | 34441 | GTCN_3831 | 48500 |
| ATCN_1437 | 34442 | CTCN_7137 | 48501 |
| ATCN_1438 | 34443 | ATCN_4124 | 48502 |
| ATCN_1439 | 34444 | CTCN_7138 | 48503 |
| TTCN_1974 | 34445 | GTCN_3832 | 48504 |
| ATCN_1440 | 34446 | ATCN_4125 | 48505 |
| TTCN_1975 | 34447 | TTCN_5953 | 48506 |
| CTCN_2305 | 34448 | GTCN_3833 | 48507 |
| TTCN_1976 | 34449 | ATCN_4126 | 48508 |
| ATCN_1441 | 34450 | TTCN_5954 | 48509 |
| TTCN_1977 | 34451 | CTCN_7139 | 48510 |
| TTCN_1978 | 34452 | ATCN_4127 | 48511 |
| CTCN_2306 | 34453 | CTCN_7140 | 48512 |
| TTCN_1979 | 34454 | TTCN_5955 | 48513 |
| CTCN_2307 | 34455 | CTCN_7141 | 48514 |
| GTCN_1271 | 34456 | CTCN_7142 | 48515 |
| TTCN_1980 | 34457 | ATCN_4128 | 48516 |
| TTCN_1981 | 34458 | CTCN_7143 | 48517 |
| ATCN_1442 | 34459 | GTCN_3834 | 48518 |

| | | | |
|---|---|---|---|
| CTCN_2308 | 34460 | CTCN_7144 | 48519 |
| CTCN_2309 | 34461 | GTCN_3835 | 48520 |
| ATCN_1443 | 34462 | ATCN_4129 | 48521 |
| TTCN_1982 | 34463 | TTCN_5956 | 48522 |
| GTCN_1272 | 34464 | ATCN_4130 | 48523 |
| CTCN_2310 | 34465 | CTCN_7145 | 48524 |
| TTCN_1983 | 34466 | CTCN_7146 | 48525 |
| TTCN_1984 | 34467 | ATCN_4131 | 48526 |
| ATCN_1444 | 34468 | CTCN_7147 | 48527 |
| GTCN_1273 | 34469 | CTCN_7148 | 48528 |
| CTCN_2311 | 34470 | TTCN_5957 | 48529 |
| CTCN_2312 | 34471 | CTCN_7149 | 48530 |
| TTCN_1985 | 34472 | CTCN_7150 | 48531 |
| CTCN_2313 | 34473 | GTCN_3836 | 48532 |
| CTCN_2314 | 34474 | CTCN_7151 | 48533 |
| ATCN_1445 | 34475 | TTCN_5958 | 48534 |
| CTCN_2315 | 34476 | ATCN_4132 | 48535 |
| GTCN_1274 | 34477 | CTCN_7152 | 48536 |
| TTCN_1986 | 34478 | TTCN_5959 | 48537 |
| CTCN_2316 | 34479 | TTCN_5960 | 48538 |
| GTCN_1275 | 34480 | CTCN_7153 | 48539 |
| CTCN_2317 | 34481 | GTCN_3837 | 48540 |
| CTCN_2318 | 34482 | TTCN_5961 | 48541 |
| CTCN_2319 | 34483 | GTCN_3838 | 48542 |
| TTCN_1987 | 34484 | CTCN_7154 | 48543 |
| CTCN_2320 | 34485 | ATCN_4133 | 48544 |
| CTCN_2321 | 34486 | ATCN_4134 | 48545 |
| CTCN_2322 | 34487 | GTCN_3839 | 48546 |
| ATCN_1446 | 34488 | ATCN_4135 | 48547 |
| CTCN_2323 | 34489 | TTCN_5962 | 48548 |
| CTCN_2324 | 34490 | CTCN_7155 | 48549 |
| TTCN_1988 | 34491 | TTCN_5963 | 48550 |
| ATCN_1447 | 34492 | ATCN_4136 | 48551 |
| ATCN_1448 | 34493 | TTCN_5964 | 48552 |
| CTCN_2325 | 34494 | TTCN_5965 | 48553 |
| GTCN_1276 | 34495 | ATCN_4137 | 48554 |
| CTCN_2326 | 34496 | GTCN_3840 | 48555 |
| TTCN_1989 | 34497 | ATCN_4138 | 48556 |
| CTCN_2327 | 34498 | TTCN_5966 | 48557 |
| GTCN_1277 | 34499 | ATCN_4139 | 48558 |
| ATCN_1449 | 34500 | TTCN_5967 | 48559 |
| CTCN_2328 | 34501 | TTCN_5968 | 48560 |
| CTCN_2329 | 34502 | CTCN_7156 | 48561 |

FIG. 37 (continued)

| | | | |
|---|---|---|---|
| CTCN_2330 | 34503 | CTCN_7157 | 48562 |
| CTCN_2331 | 34504 | CTCN_7158 | 48563 |
| GTCN_1278 | 34505 | CTCN_7159 | 48564 |
| ATCN_1450 | 34506 | GTCN_3841 | 48565 |
| ATCN_1451 | 34507 | TTCN_5969 | 48566 |
| CTCN_2332 | 34508 | TTCN_5970 | 48567 |
| TTCN_1990 | 34509 | GTCN_3842 | 48568 |
| GTCN_1279 | 34510 | GTCN_3843 | 48569 |
| GTCN_1280 | 34511 | CTCN_7160 | 48570 |
| GTCN_1281 | 34512 | ATCN_4140 | 48571 |
| CTCN_2333 | 34513 | GTCN_3844 | 48572 |
| ATCN_1452 | 34514 | CTCN_7161 | 48573 |
| TTCN_1991 | 34515 | TTCN_5971 | 48574 |
| CTCN_2334 | 34516 | CTCN_7162 | 48575 |
| CTCN_2335 | 34517 | ATCN_4141 | 48576 |
| CTCN_2336 | 34518 | ATCN_4142 | 48577 |
| TTCN_1992 | 34519 | CTCN_7163 | 48578 |
| TTCN_1993 | 34520 | ATCN_4143 | 48579 |
| GTCN_1282 | 34521 | ATCN_4144 | 48580 |
| TTCN_1994 | 34522 | ATCN_4145 | 48581 |
| GTCN_1283 | 34523 | CTCN_7164 | 48582 |
| CTCN_2337 | 34524 | CTCN_7165 | 48583 |
| TTCN_1995 | 34525 | CTCN_7166 | 48584 |
| ATCN_1453 | 34526 | CTCN_7167 | 48585 |
| GTCN_1284 | 34527 | CTCN_7168 | 48586 |
| CTCN_2338 | 34528 | CTCN_7169 | 48587 |
| CTCN_2339 | 34529 | TTCN_5972 | 48588 |
| TTCN_1996 | 34530 | GTCN_3845 | 48589 |
| CTCN_2340 | 34531 | CTCN_7170 | 48590 |
| GTCN_1285 | 34532 | CTCN_7171 | 48591 |
| CTCN_2341 | 34533 | TTCN_5973 | 48592 |
| CTCN_2342 | 34534 | CTCN_7172 | 48593 |
| TTCN_1997 | 34535 | CTCN_7173 | 48594 |
| TTCN_1998 | 34536 | CTCN_7174 | 48595 |
| CTCN_2343 | 34537 | CTCN_7175 | 48596 |
| TTCN_1999 | 34538 | CTCN_7176 | 48597 |
| TTCN_2000 | 34539 | CTCN_7177 | 48598 |
| ATCN_1454 | 34540 | GTCN_3846 | 48599 |
| TTCN_2001 | 34541 | ATCN_4146 | 48600 |
| CTCN_2344 | 34542 | CTCN_7178 | 48601 |
| CTCN_2345 | 34543 | CTCN_7179 | 48602 |
| GTCN_1286 | 34544 | CTCN_7180 | 48603 |
| ATCN_1455 | 34545 | CTCN_7181 | 48604 |

| | | | |
|---|---|---|---|
| ATCN_1456 | 34546 | CTCN_7182 | 48605 |
| GTCN_1287 | 34547 | ATCN_4147 | 48606 |
| ATCN_1457 | 34548 | GTCN_3847 | 48607 |
| ATCN_1458 | 34549 | CTCN_7183 | 48608 |
| CTCN_2346 | 34550 | TTCN_5974 | 48609 |
| TTCN_2002 | 34551 | GTCN_3848 | 48610 |
| GTCN_1288 | 34552 | ATCN_4148 | 48611 |
| GTCN_1289 | 34553 | ATCN_4149 | 48612 |
| TTCN_2003 | 34554 | ATCN_4150 | 48613 |
| ATCN_1459 | 34555 | ATCN_4151 | 48614 |
| ATCN_1460 | 34556 | CTCN_7184 | 48615 |
| ATCN_1461 | 34557 | CTCN_7185 | 48616 |
| CTCN_2347 | 34558 | GTCN_3849 | 48617 |
| GTCN_1290 | 34559 | ATCN_4152 | 48618 |
| CTCN_2348 | 34560 | TTCN_5975 | 48619 |
| CTCN_2349 | 34561 | CTCN_7186 | 48620 |
| TTCN_2004 | 34562 | CTCN_7187 | 48621 |
| CTCN_2350 | 34563 | TTCN_5976 | 48622 |
| ATCN_1462 | 34564 | TTCN_5977 | 48623 |
| CTCN_2351 | 34565 | GTCN_3850 | 48624 |
| ATCN_1463 | 34566 | GTCN_3851 | 48625 |
| ATCN_1464 | 34567 | TTCN_5978 | 48626 |
| CTCN_2352 | 34568 | CTCN_7188 | 48627 |
| ATCN_1465 | 34569 | TTCN_5979 | 48628 |
| ATCN_1466 | 34570 | CTCN_7189 | 48629 |
| TTCN_2005 | 34571 | GTCN_3852 | 48630 |
| GTCN_1291 | 34572 | CTCN_7190 | 48631 |
| GTCN_1292 | 34573 | CTCN_7191 | 48632 |
| CTCN_2353 | 34574 | CTCN_7192 | 48633 |
| GTCN_1293 | 34575 | TTCN_5980 | 48634 |
| ATCN_1467 | 34576 | ATCN_4153 | 48635 |
| GTCN_1294 | 34577 | TTCN_5981 | 48636 |
| CTCN_2354 | 34578 | GTCN_3853 | 48637 |
| CTCN_2355 | 34579 | ATCN_4154 | 48638 |
| CTCN_2356 | 34580 | TTCN_5982 | 48639 |
| CTCN_2357 | 34581 | TTCN_5983 | 48640 |
| TTCN_2006 | 34582 | TTCN_5984 | 48641 |
| TTCN_2007 | 34583 | ATCN_4155 | 48642 |
| TTCN_2008 | 34584 | TTCN_5985 | 48643 |
| CTCN_2358 | 34585 | CTCN_7193 | 48644 |
| CTCN_2359 | 34586 | TTCN_5986 | 48645 |
| CTCN_2360 | 34587 | TTCN_5987 | 48646 |
| ATCN_1468 | 34588 | TTCN_5988 | 48647 |

FIG. 37 (continued)

| | | | |
|---|---|---|---|
| ATCN_1469 | 34589 | ATCN_4156 | 48648 |
| CTCN_2361 | 34590 | TTCN_5989 | 48649 |
| GTCN_1295 | 34591 | GTCN_3854 | 48650 |
| CTCN_2362 | 34592 | TTCN_5990 | 48651 |
| GTCN_1296 | 34593 | GTCN_3855 | 48652 |
| CTCN_2363 | 34594 | TTCN_5991 | 48653 |
| ATCN_1470 | 34595 | GTCN_3856 | 48654 |
| CTCN_2364 | 34596 | GTCN_3857 | 48655 |
| CTCN_2365 | 34597 | TTCN_5992 | 48656 |
| TTCN_2009 | 34598 | ATCN_4157 | 48657 |
| CTCN_2366 | 34599 | TTCN_5993 | 48658 |
| TTCN_2010 | 34600 | TTCN_5994 | 48659 |
| CTCN_2367 | 34601 | ATCN_4158 | 48660 |
| CTCN_2368 | 34602 | CTCN_7194 | 48661 |
| CTCN_2369 | 34603 | CTCN_7195 | 48662 |
| TTCN_2011 | 34604 | CTCN_7196 | 48663 |
| TTCN_2012 | 34605 | CTCN_7197 | 48664 |
| CTCN_2370 | 34606 | CTCN_7198 | 48665 |
| GTCN_1297 | 34607 | TTCN_5995 | 48666 |
| GTCN_1298 | 34608 | GTCN_3858 | 48667 |
| CTCN_2371 | 34609 | TTCN_5996 | 48668 |
| GTCN_1299 | 34610 | ATCN_4159 | 48669 |
| TTCN_2013 | 34611 | GTCN_3859 | 48670 |
| TTCN_2014 | 34612 | ATCN_4160 | 48671 |
| GTCN_1300 | 34613 | ATCN_4161 | 48672 |
| CTCN_2372 | 34614 | ATCN_4162 | 48673 |
| CTCN_2373 | 34615 | TTCN_5997 | 48674 |
| CTCN_2374 | 34616 | CTCN_7199 | 48675 |
| CTCN_2375 | 34617 | CTCN_7200 | 48676 |
| TTCN_2015 | 34618 | CTCN_7201 | 48677 |
| TTCN_2016 | 34619 | GTCN_3860 | 48678 |
| CTCN_2376 | 34620 | CTCN_7202 | 48679 |
| CTCN_2377 | 34621 | GTCN_3861 | 48680 |
| TTCN_2017 | 34622 | TTCN_5998 | 48681 |
| GTCN_1301 | 34623 | CTCN_7203 | 48682 |
| GTCN_1302 | 34624 | CTCN_7204 | 48683 |
| TTCN_2018 | 34625 | CTCN_7205 | 48684 |
| CTCN_2378 | 34626 | TTCN_5999 | 48685 |
| GTCN_1303 | 34627 | TTCN_6000 | 48686 |
| CTCN_2379 | 34628 | TTCN_6001 | 48687 |
| CTCN_2380 | 34629 | CTCN_7206 | 48688 |
| GTCN_1304 | 34630 | TTCN_6002 | 48689 |
| CTCN_2381 | 34631 | TTCN_6003 | 48690 |

| | | | |
|---|---|---|---|
| GTCN_1305 | 34632 | TTCN_6004 | 48691 |
| CTCN_2382 | 34633 | CTCN_7207 | 48692 |
| TTCN_2019 | 34634 | CTCN_7208 | 48693 |
| CTCN_2383 | 34635 | TTCN_6005 | 48694 |
| CTCN_2384 | 34636 | GTCN_3862 | 48695 |
| CTCN_2385 | 34637 | CTCN_7209 | 48696 |
| TTCN_2020 | 34638 | ATCN_4163 | 48697 |
| TTCN_2021 | 34639 | GTCN_3863 | 48698 |
| CTCN_2386 | 34640 | TTCN_6006 | 48699 |
| ATCN_1471 | 34641 | TTCN_6007 | 48700 |
| CTCN_2387 | 34642 | GTCN_3864 | 48701 |
| TTCN_2022 | 34643 | ATCN_4164 | 48702 |
| CTCN_2388 | 34644 | GTCN_3865 | 48703 |
| TTCN_2023 | 34645 | GTCN_3866 | 48704 |
| CTCN_2389 | 34646 | GTCN_3867 | 48705 |
| TTCN_2024 | 34647 | CTCN_7210 | 48706 |
| TTCN_2025 | 34648 | TTCN_6008 | 48707 |
| TTCN_2026 | 34649 | ATCN_4165 | 48708 |
| CTCN_2390 | 34650 | TTCN_6009 | 48709 |
| CTCN_2391 | 34651 | TTCN_6010 | 48710 |
| CTCN_2392 | 34652 | ATCN_4166 | 48711 |
| TTCN_2027 | 34653 | GTCN_3868 | 48712 |
| CTCN_2393 | 34654 | ATCN_4167 | 48713 |
| CTCN_2394 | 34655 | TTCN_6011 | 48714 |
| TTCN_2028 | 34656 | TTCN_6012 | 48715 |
| TTCN_2029 | 34657 | TTCN_6013 | 48716 |
| CTCN_2395 | 34658 | CTCN_7211 | 48717 |
| CTCN_2396 | 34659 | TTCN_6014 | 48718 |
| CTCN_2397 | 34660 | GTCN_3869 | 48719 |
| CTCN_2398 | 34661 | GTCN_3870 | 48720 |
| TTCN_2030 | 34662 | TTCN_6015 | 48721 |
| TTCN_2031 | 34663 | TTCN_6016 | 48722 |
| CTCN_2399 | 34664 | TTCN_6017 | 48723 |
| ATCN_1472 | 34665 | TTCN_6018 | 48724 |
| ATCN_1473 | 34666 | TTCN_6019 | 48725 |
| CTCN_2400 | 34667 | TTCN_6020 | 48726 |
| TTCN_2032 | 34668 | CTCN_7212 | 48727 |
| GTCN_1306 | 34669 | TTCN_6021 | 48728 |
| GTCN_1307 | 34670 | ATCN_4168 | 48729 |
| CTCN_2401 | 34671 | ATCN_4169 | 48730 |
| TTCN_2033 | 34672 | CTCN_7213 | 48731 |
| CTCN_2402 | 34673 | ATCN_4170 | 48732 |
| ATCN_1474 | 34674 | CTCN_7214 | 48733 |

FIG. 37 (continued)

| | | | | | | | |
|---|---|---|---|---|---|---|---|
| CTCN_2403 | 34675 | TTCN_6022 | 48734 | TTCN_2040 | 34718 | TTCN_6034 | 48777 |
| CTCN_2404 | 34676 | TTCN_6023 | 48735 | GTCN_1318 | 34719 | CTCN_7225 | 48778 |
| GTCN_1308 | 34677 | ATCN_4171 | 48736 | TTCN_2041 | 34720 | TTCN_6035 | 48779 |
| CTCN_2405 | 34678 | CTCN_7215 | 48737 | ATCN_1482 | 34721 | ATCN_4183 | 48780 |
| TTCN_2034 | 34679 | ATCN_4172 | 48738 | CTCN_2423 | 34722 | CTCN_7226 | 48781 |
| GTCN_1309 | 34680 | ATCN_4173 | 48739 | TTCN_2042 | 34723 | TTCN_6036 | 48782 |
| CTCN_2406 | 34681 | ATCN_4174 | 48740 | TTCN_2043 | 34724 | TTCN_6037 | 48783 |
| TTCN_2035 | 34682 | ATCN_4175 | 48741 | GTCN_1319 | 34725 | CTCN_7227 | 48784 |
| GTCN_1310 | 34683 | TTCN_6024 | 48742 | CTCN_2424 | 34726 | TTCN_6038 | 48785 |
| TTCN_2036 | 34684 | GTCN_3871 | 48743 | CTCN_2425 | 34727 | TTCN_6039 | 48786 |
| TTCN_2037 | 34685 | ATCN_4176 | 48744 | TTCN_2044 | 34728 | TTCN_6040 | 48787 |
| CTCN_2407 | 34686 | GTCN_3872 | 48745 | ATCN_1483 | 34729 | CTCN_7228 | 48788 |
| GTCN_1311 | 34687 | GTCN_3873 | 48746 | GTCN_1320 | 34730 | TTCN_6041 | 48789 |
| GTCN_1312 | 34688 | TTCN_6025 | 48747 | ATCN_1484 | 34731 | ATCN_4184 | 48790 |
| TTCN_2038 | 34689 | TTCN_6026 | 48748 | TTCN_2045 | 34732 | TTCN_6042 | 48791 |
| CTCN_2408 | 34690 | CTCN_7216 | 48749 | ATCN_1485 | 34733 | ATCN_4185 | 48792 |
| CTCN_2409 | 34691 | GTCN_3874 | 48750 | TTCN_2046 | 34734 | TTCN_6043 | 48793 |
| GTCN_1313 | 34692 | ATCN_4177 | 48751 | CTCN_2426 | 34735 | GTCN_3880 | 48794 |
| ATCN_1475 | 34693 | CTCN_7217 | 48752 | TTCN_2047 | 34736 | ATCN_4186 | 48795 |
| ATCN_1476 | 34694 | CTCN_7218 | 48753 | CTCN_2427 | 34737 | CTCN_7229 | 48796 |
| CTCN_2410 | 34695 | TTCN_6027 | 48754 | GTCN_1321 | 34738 | GTCN_3881 | 48797 |
| CTCN_2411 | 34696 | GTCN_3875 | 48755 | CTCN_2428 | 34739 | GTCN_3882 | 48798 |
| ATCN_1477 | 34697 | GTCN_3876 | 48756 | ATCN_1486 | 34740 | TTCN_6044 | 48799 |
| ATCN_1478 | 34698 | CTCN_7219 | 48757 | ATCN_1487 | 34741 | TTCN_6045 | 48800 |
| CTCN_2412 | 34699 | CTCN_7220 | 48758 | ATCN_1488 | 34742 | CTCN_7230 | 48801 |
| CTCN_2413 | 34700 | TTCN_6028 | 48759 | TTCN_2048 | 34743 | TTCN_6046 | 48802 |
| CTCN_2414 | 34701 | GTCN_3877 | 48760 | TTCN_2049 | 34744 | ATCN_4187 | 48803 |
| GTCN_1314 | 34702 | GTCN_3878 | 48761 | GTCN_1322 | 34745 | TTCN_6047 | 48804 |
| CTCN_2415 | 34703 | CTCN_7221 | 48762 | CTCN_2429 | 34746 | ATCN_4188 | 48805 |
| ATCN_1479 | 34704 | GTCN_3879 | 48763 | GTCN_1323 | 34747 | TTCN_6048 | 48806 |
| CTCN_2416 | 34705 | ATCN_4178 | 48764 | GTCN_1324 | 34748 | ATCN_4189 | 48807 |
| GTCN_1315 | 34706 | ATCN_4179 | 48765 | TTCN_2050 | 34749 | ATCN_4190 | 48808 |
| CTCN_2417 | 34707 | TTCN_6029 | 48766 | TTCN_2051 | 34750 | CTCN_7231 | 48809 |
| GTCN_1316 | 34708 | ATCN_4180 | 48767 | GTCN_1325 | 34751 | CTCN_7232 | 48810 |
| TTCN_2039 | 34709 | CTCN_7222 | 48768 | ATCN_1489 | 34752 | TTCN_6049 | 48811 |
| CTCN_2418 | 34710 | TTCN_6030 | 48769 | TTCN_2052 | 34753 | GTCN_3883 | 48812 |
| CTCN_2419 | 34711 | CTCN_7223 | 48770 | GTCN_1326 | 34754 | TTCN_6050 | 48813 |
| ATCN_1480 | 34712 | TTCN_6031 | 48771 | GTCN_1327 | 34755 | GTCN_3884 | 48814 |
| ATCN_1481 | 34713 | ATCN_4181 | 48772 | ATCN_1490 | 34756 | GTCN_3885 | 48815 |
| CTCN_2420 | 34714 | TTCN_6032 | 48773 | ATCN_1491 | 34757 | TTCN_6051 | 48816 |
| CTCN_2421 | 34715 | TTCN_6033 | 48774 | TTCN_2053 | 34758 | ATCN_4191 | 48817 |
| CTCN_2422 | 34716 | ATCN_4182 | 48775 | TTCN_2054 | 34759 | TTCN_6052 | 48818 |
| GTCN_1317 | 34717 | CTCN_7224 | 48776 | ATCN_1492 | 34760 | GTCN_3886 | 48819 |

FIG. 37 (continued)

| | | | |
|---|---|---|---|
| ATCN_1493 | 34761 | ATCN_4192 | 48820 |
| TTCN_2055 | 34762 | TTCN_6053 | 48821 |
| GTCN_1328 | 34763 | ATCN_4193 | 48822 |
| TTCN_2056 | 34764 | TTCN_6054 | 48823 |
| TTCN_2057 | 34765 | GTCN_3887 | 48824 |
| TTCN_2058 | 34766 | GTCN_3888 | 48825 |
| GTCN_1329 | 34767 | CTCN_7233 | 48826 |
| TTCN_2059 | 34768 | TTCN_6055 | 48827 |
| CTCN_2430 | 34769 | CTCN_7234 | 48828 |
| TTCN_2060 | 34770 | TTCN_6056 | 48829 |
| ATCN_1494 | 34771 | GTCN_3889 | 48830 |
| GTCN_1330 | 34772 | GTCN_3890 | 48831 |
| GTCN_1331 | 34773 | CTCN_7235 | 48832 |
| CTCN_2431 | 34774 | GTCN_3891 | 48833 |
| CTCN_2432 | 34775 | ATCN_4194 | 48834 |
| TTCN_2061 | 34776 | CTCN_7236 | 48835 |
| CTCN_2433 | 34777 | GTCN_3892 | 48836 |
| TTCN_2062 | 34778 | GTCN_3893 | 48837 |
| CTCN_2434 | 34779 | ATCN_4195 | 48838 |
| GTCN_1332 | 34780 | CTCN_7237 | 48839 |
| ATCN_1495 | 34781 | CTCN_7238 | 48840 |
| TTCN_2063 | 34782 | TTCN_6057 | 48841 |
| CTCN_2435 | 34783 | ATCN_4196 | 48842 |
| TTCN_2064 | 34784 | TTCN_6058 | 48843 |
| CTCN_2436 | 34785 | GTCN_3894 | 48844 |
| GTCN_1333 | 34786 | CTCN_7239 | 48845 |
| GTCN_1334 | 34787 | TTCN_6059 | 48846 |
| ATCN_1496 | 34788 | TTCN_6060 | 48847 |
| ATCN_1497 | 34789 | TTCN_6061 | 48848 |
| CTCN_2437 | 34790 | TTCN_6062 | 48849 |
| TTCN_2065 | 34791 | TTCN_6063 | 48850 |
| TTCN_2066 | 34792 | CTCN_7240 | 48851 |
| TTCN_2067 | 34793 | ATCN_4197 | 48852 |
| CTCN_2438 | 34794 | ATCN_4198 | 48853 |
| CTCN_2439 | 34795 | CTCN_7241 | 48854 |
| CTCN_2440 | 34796 | TTCN_6064 | 48855 |
| CTCN_2441 | 34797 | TTCN_6065 | 48856 |
| TTCN_2068 | 34798 | CTCN_7242 | 48857 |
| GTCN_1335 | 34799 | CTCN_7243 | 48858 |
| TTCN_2069 | 34800 | ATCN_4199 | 48859 |
| CTCN_2442 | 34801 | CTCN_7244 | 48860 |
| CTCN_2443 | 34802 | TTCN_6066 | 48861 |
| TTCN_2070 | 34803 | CTCN_7245 | 48862 |

| | | | |
|---|---|---|---|
| CTCN_2444 | 34804 | CTCN_7246 | 48863 |
| CTCN_2445 | 34805 | ATCN_4200 | 48864 |
| TTCN_2071 | 34806 | ATCN_4201 | 48865 |
| CTCN_2446 | 34807 | TTCN_6067 | 48866 |
| TTCN_2072 | 34808 | ATCN_4202 | 48867 |
| CTCN_2447 | 34809 | ATCN_4203 | 48868 |
| CTCN_2448 | 34810 | CTCN_7247 | 48869 |
| CTCN_2449 | 34811 | ATCN_4204 | 48870 |
| TTCN_2073 | 34812 | TTCN_6068 | 48871 |
| ATCN_1498 | 34813 | GTCN_3895 | 48872 |
| ATCN_1499 | 34814 | ATCN_4205 | 48873 |
| GTCN_1336 | 34815 | ATCN_4206 | 48874 |
| CTCN_2450 | 34816 | TTCN_6069 | 48875 |
| TTCN_2074 | 34817 | TTCN_6070 | 48876 |
| TTCN_2075 | 34818 | TTCN_6071 | 48877 |
| CTCN_2451 | 34819 | ATCN_4207 | 48878 |
| GTCN_1337 | 34820 | GTCN_3896 | 48879 |
| TTCN_2076 | 34821 | TTCN_6072 | 48880 |
| CTCN_2452 | 34822 | CTCN_7248 | 48881 |
| CTCN_2453 | 34823 | TTCN_6073 | 48882 |
| CTCN_2454 | 34824 | ATCN_4208 | 48883 |
| TTCN_2077 | 34825 | TTCN_6074 | 48884 |
| TTCN_2078 | 34826 | CTCN_7249 | 48885 |
| CTCN_2455 | 34827 | GTCN_3897 | 48886 |
| TTCN_2079 | 34828 | TTCN_6075 | 48887 |
| CTCN_2456 | 34829 | TTCN_6076 | 48888 |
| TTCN_2080 | 34830 | TTCN_6077 | 48889 |
| CTCN_2457 | 34831 | GTCN_3898 | 48890 |
| GTCN_1338 | 34832 | CTCN_7250 | 48891 |
| GTCN_1339 | 34833 | ATCN_4209 | 48892 |
| CTCN_2458 | 34834 | CTCN_7251 | 48893 |
| CTCN_2459 | 34835 | CTCN_7252 | 48894 |
| CTCN_2460 | 34836 | ATCN_4210 | 48895 |
| TTCN_2081 | 34837 | ATCN_4211 | 48896 |
| TTCN_2082 | 34838 | CTCN_7253 | 48897 |
| CTCN_2461 | 34839 | CTCN_7254 | 48898 |
| GTCN_1340 | 34840 | TTCN_6078 | 48899 |
| CTCN_2462 | 34841 | CTCN_7255 | 48900 |
| TTCN_2083 | 34842 | GTCN_3899 | 48901 |
| GTCN_1341 | 34843 | ATCN_4212 | 48902 |
| TTCN_2084 | 34844 | CTCN_7256 | 48903 |
| ATCN_1500 | 34845 | TTCN_6079 | 48904 |
| TTCN_2085 | 34846 | TTCN_6080 | 48905 |

FIG. 37 (continued)

| | | | |
|---|---|---|---|
| TTCN_2086 | 34847 | TTCN_6081 | 48906 |
| TTCN_2087 | 34848 | ATCN_4213 | 48907 |
| ATCN_1501 | 34849 | TTCN_6082 | 48908 |
| ATCN_1502 | 34850 | GTCN_3900 | 48909 |
| GTCN_1342 | 34851 | TTCN_6083 | 48910 |
| CTCN_2463 | 34852 | TTCN_6084 | 48911 |
| CTCN_2464 | 34853 | CTCN_7257 | 48912 |
| CTCN_2465 | 34854 | ATCN_4214 | 48913 |
| CTCN_2466 | 34855 | TTCN_6085 | 48914 |
| GTCN_1343 | 34856 | CTCN_7258 | 48915 |
| CTCN_2467 | 34857 | ATCN_4215 | 48916 |
| CTCN_2468 | 34858 | TTCN_6086 | 48917 |
| CTCN_2469 | 34859 | TTCN_6087 | 48918 |
| CTCN_2470 | 34860 | GTCN_3901 | 48919 |
| TTCN_2088 | 34861 | ATCN_4216 | 48920 |
| ATCN_1503 | 34862 | GTCN_3902 | 48921 |
| GTCN_1344 | 34863 | TTCN_6088 | 48922 |
| TTCN_2089 | 34864 | ATCN_4217 | 48923 |
| CTCN_2471 | 34865 | ATCN_4218 | 48924 |
| ATCN_1504 | 34866 | TTCN_6089 | 48925 |
| CTCN_2472 | 34867 | TTCN_6090 | 48926 |
| CTCN_2473 | 34868 | ATCN_4219 | 48927 |
| CTCN_2474 | 34869 | TTCN_6091 | 48928 |
| ATCN_1505 | 34870 | CTCN_7259 | 48929 |
| CTCN_2475 | 34871 | ATCN_4220 | 48930 |
| GTCN_1345 | 34872 | ATCN_4221 | 48931 |
| TTCN_2090 | 34873 | CTCN_7260 | 48932 |
| ATCN_1506 | 34874 | CTCN_7261 | 48933 |
| CTCN_2476 | 34875 | CTCN_7262 | 48934 |
| CTCN_2477 | 34876 | CTCN_7263 | 48935 |
| TTCN_2091 | 34877 | GTCN_3903 | 48936 |
| GTCN_1346 | 34878 | GTCN_3904 | 48937 |
| CTCN_2478 | 34879 | TTCN_6092 | 48938 |
| GTCN_1347 | 34880 | TTCN_6093 | 48939 |
| CTCN_2479 | 34881 | TTCN_6094 | 48940 |
| TTCN_2092 | 34882 | TTCN_6095 | 48941 |
| TTCN_2093 | 34883 | ATCN_4222 | 48942 |
| CTCN_2480 | 34884 | TTCN_6096 | 48943 |
| CTCN_2481 | 34885 | TTCN_6097 | 48944 |
| TTCN_2094 | 34886 | GTCN_3905 | 48945 |
| CTCN_2482 | 34887 | CTCN_7264 | 48946 |
| TTCN_2095 | 34888 | TTCN_6098 | 48947 |
| GTCN_1348 | 34889 | TTCN_6099 | 48948 |

| | | | |
|---|---|---|---|
| CTCN_2483 | 34890 | ATCN_4223 | 48949 |
| TTCN_2096 | 34891 | ATCN_4224 | 48950 |
| TTCN_2097 | 34892 | ATCN_4225 | 48951 |
| TTCN_2098 | 34893 | ATCN_4226 | 48952 |
| ATCN_1507 | 34894 | GTCN_3906 | 48953 |
| TTCN_2099 | 34895 | TTCN_6100 | 48954 |
| GTCN_1349 | 34896 | ATCN_4227 | 48955 |
| TTCN_2100 | 34897 | TTCN_6101 | 48956 |
| CTCN_2484 | 34898 | CTCN_7265 | 48957 |
| CTCN_2485 | 34899 | TTCN_6102 | 48958 |
| CTCN_2486 | 34900 | CTCN_7266 | 48959 |
| CTCN_2487 | 34901 | CTCN_7267 | 48960 |
| CTCN_2488 | 34902 | TTCN_6103 | 48961 |
| CTCN_2489 | 34903 | GTCN_3907 | 48962 |
| ATCN_1508 | 34904 | TTCN_6104 | 48963 |
| ATCN_1509 | 34905 | TTCN_6105 | 48964 |
| TTCN_2101 | 34906 | TTCN_6106 | 48965 |
| ATCN_1510 | 34907 | CTCN_7268 | 48966 |
| CTCN_2490 | 34908 | CTCN_7269 | 48967 |
| GTCN_1350 | 34909 | ATCN_4228 | 48968 |
| CTCN_2491 | 34910 | CTCN_7270 | 48969 |
| ATCN_1511 | 34911 | ATCN_4229 | 48970 |
| CTCN_2492 | 34912 | GTCN_3908 | 48971 |
| CTCN_2493 | 34913 | ATCN_4230 | 48972 |
| ATCN_1512 | 34914 | TTCN_6107 | 48973 |
| ATCN_1513 | 34915 | TTCN_6108 | 48974 |
| CTCN_2494 | 34916 | GTCN_3909 | 48975 |
| CTCN_2495 | 34917 | TTCN_6109 | 48976 |
| TTCN_2102 | 34918 | ATCN_4231 | 48977 |
| ATCN_1514 | 34919 | GTCN_3910 | 48978 |
| CTCN_2496 | 34920 | ATCN_4232 | 48979 |
| TTCN_2103 | 34921 | CTCN_7271 | 48980 |
| TTCN_2104 | 34922 | CTCN_7272 | 48981 |
| CTCN_2497 | 34923 | TTCN_6110 | 48982 |
| CTCN_2498 | 34924 | CTCN_7273 | 48983 |
| CTCN_2499 | 34925 | CTCN_7274 | 48984 |
| ATCN_1515 | 34926 | GTCN_3911 | 48985 |
| CTCN_2500 | 34927 | TTCN_6111 | 48986 |
| GTCN_1351 | 34928 | GTCN_3912 | 48987 |
| TTCN_2105 | 34929 | ATCN_4233 | 48988 |
| CTCN_2501 | 34930 | CTCN_7275 | 48989 |
| GTCN_1352 | 34931 | ATCN_4234 | 48990 |
| TTCN_2106 | 34932 | ATCN_4235 | 48991 |

FIG. 37 (continued)

| | | | |
|---|---|---|---|
| CTCN_2502 | 34933 | ATCN_4236 | 48992 |
| GTCN_1353 | 34934 | CTCN_7276 | 48993 |
| ATCN_1516 | 34935 | CTCN_7277 | 48994 |
| ATCN_1517 | 34936 | TTCN_6112 | 48995 |
| ATCN_1518 | 34937 | TTCN_6113 | 48996 |
| ATCN_1519 | 34938 | GTCN_3913 | 48997 |
| CTCN_2503 | 34939 | ATCN_4237 | 48998 |
| CTCN_2504 | 34940 | TTCN_6114 | 48999 |
| TTCN_2107 | 34941 | CTCN_7278 | 49000 |
| ATCN_1520 | 34942 | GTCN_3914 | 49001 |
| GTCN_1354 | 34943 | CTCN_7279 | 49002 |
| CTCN_2505 | 34944 | TTCN_6115 | 49003 |
| TTCN_2108 | 34945 | ATCN_4238 | 49004 |
| CTCN_2506 | 34946 | ATCN_4239 | 49005 |
| GTCN_1355 | 34947 | ATCN_4240 | 49006 |
| ATCN_1521 | 34948 | GTCN_3915 | 49007 |
| ATCN_1522 | 34949 | GTCN_3916 | 49008 |
| ATCN_1523 | 34950 | GTCN_3917 | 49009 |
| ATCN_1524 | 34951 | CTCN_7280 | 49010 |
| GTCN_1356 | 34952 | TTCN_6116 | 49011 |
| CTCN_2507 | 34953 | CTCN_7281 | 49012 |
| TTCN_2109 | 34954 | ATCN_4241 | 49013 |
| TTCN_2110 | 34955 | TTCN_6117 | 49014 |
| ATCN_1525 | 34956 | CTCN_7282 | 49015 |
| ATCN_1526 | 34957 | GTCN_3918 | 49016 |
| ATCN_1527 | 34958 | TTCN_6118 | 49017 |
| CTCN_2508 | 34959 | CTCN_7283 | 49018 |
| ATCN_1528 | 34960 | CTCN_7284 | 49019 |
| ATCN_1529 | 34961 | TTCN_6119 | 49020 |
| TTCN_2111 | 34962 | ATCN_4242 | 49021 |
| ATCN_1530 | 34963 | ATCN_4243 | 49022 |
| TTCN_2112 | 34964 | ATCN_4244 | 49023 |
| TTCN_2113 | 34965 | TTCN_6120 | 49024 |
| CTCN_2509 | 34966 | TTCN_6121 | 49025 |
| CTCN_2510 | 34967 | ATCN_4245 | 49026 |
| CTCN_2511 | 34968 | TTCN_6122 | 49027 |
| TTCN_2114 | 34969 | GTCN_3919 | 49028 |
| ATCN_1531 | 34970 | TTCN_6123 | 49029 |
| CTCN_2512 | 34971 | ATCN_4246 | 49030 |
| GTCN_1357 | 34972 | TTCN_6124 | 49031 |
| GTCN_1358 | 34973 | TTCN_6125 | 49032 |
| CTCN_2513 | 34974 | TTCN_6126 | 49033 |
| CTCN_2514 | 34975 | TTCN_6127 | 49034 |

| | | | |
|---|---|---|---|
| CTCN_2515 | 34976 | TTCN_6128 | 49035 |
| GTCN_1359 | 34977 | TTCN_6129 | 49036 |
| GTCN_1360 | 34978 | CTCN_7285 | 49037 |
| CTCN_2516 | 34979 | TTCN_6130 | 49038 |
| CTCN_2517 | 34980 | ATCN_4247 | 49039 |
| GTCN_1361 | 34981 | GTCN_3920 | 49040 |
| TTCN_2115 | 34982 | CTCN_7286 | 49041 |
| TTCN_2116 | 34983 | GTCN_3921 | 49042 |
| CTCN_2518 | 34984 | CTCN_7287 | 49043 |
| TTCN_2117 | 34985 | CTCN_7288 | 49044 |
| ATCN_1532 | 34986 | ATCN_4248 | 49045 |
| GTCN_1362 | 34987 | CTCN_7289 | 49046 |
| TTCN_2118 | 34988 | ATCN_4249 | 49047 |
| TTCN_2119 | 34989 | TTCN_6131 | 49048 |
| ATCN_1533 | 34990 | TTCN_6132 | 49049 |
| ATCN_1534 | 34991 | TTCN_6133 | 49050 |
| TTCN_2120 | 34992 | GTCN_3922 | 49051 |
| TTCN_2121 | 34993 | TTCN_6134 | 49052 |
| GTCN_1363 | 34994 | CTCN_7290 | 49053 |
| TTCN_2122 | 34995 | CTCN_7291 | 49054 |
| ATCN_1535 | 34996 | GTCN_3923 | 49055 |
| TTCN_2123 | 34997 | TTCN_6135 | 49056 |
| TTCN_2124 | 34998 | TTCN_6136 | 49057 |
| CTCN_2519 | 34999 | CTCN_7292 | 49058 |
| ATCN_1536 | 35000 | GTCN_3924 | 49059 |
| CTCN_2520 | 35001 | CTCN_7293 | 49060 |
| TTCN_2125 | 35002 | CTCN_7294 | 49061 |
| CTCN_2521 | 35003 | TTCN_6137 | 49062 |
| CTCN_2522 | 35004 | TTCN_6138 | 49063 |
| ATCN_1537 | 35005 | ATCN_4250 | 49064 |
| TTCN_2126 | 35006 | CTCN_7295 | 49065 |
| TTCN_2127 | 35007 | ATCN_4251 | 49066 |
| CTCN_2523 | 35008 | TTCN_6139 | 49067 |
| GTCN_1364 | 35009 | TTCN_6140 | 49068 |
| CTCN_2524 | 35010 | TTCN_6141 | 49069 |
| GTCN_1365 | 35011 | CTCN_7296 | 49070 |
| GTCN_1366 | 35012 | TTCN_6142 | 49071 |
| CTCN_2525 | 35013 | GTCN_3925 | 49072 |
| TTCN_2128 | 35014 | ATCN_4252 | 49073 |
| CTCN_2526 | 35015 | ATCN_4253 | 49074 |
| CTCN_2527 | 35016 | GTCN_3926 | 49075 |
| TTCN_2129 | 35017 | TTCN_6143 | 49076 |
| GTCN_1367 | 35018 | TTCN_6144 | 49077 |

FIG. 37 (continued)

| | | | |
|---|---|---|---|
| GTCN_1368 | 35019 | TTCN_6145 | 49078 |
| GTCN_1369 | 35020 | ATCN_4254 | 49079 |
| ATCN_1538 | 35021 | ATCN_4255 | 49080 |
| TTCN_2130 | 35022 | TTCN_6146 | 49081 |
| ATCN_1539 | 35023 | TTCN_6147 | 49082 |
| ATCN_1540 | 35024 | ATCN_4256 | 49083 |
| CTCN_2528 | 35025 | GTCN_3927 | 49084 |
| TTCN_2131 | 35026 | GTCN_3928 | 49085 |
| CTCN_2529 | 35027 | TTCN_6148 | 49086 |
| ATCN_1541 | 35028 | GTCN_3929 | 49087 |
| ATCN_1542 | 35029 | CTCN_7297 | 49088 |
| ATCN_1543 | 35030 | GTCN_3930 | 49089 |
| TTCN_2132 | 35031 | GTCN_3931 | 49090 |
| TTCN_2133 | 35032 | GTCN_3932 | 49091 |
| CTCN_2530 | 35033 | TTCN_6149 | 49092 |
| GTCN_1370 | 35034 | TTCN_6150 | 49093 |
| GTCN_1371 | 35035 | TTCN_6151 | 49094 |
| CTCN_2531 | 35036 | ATCN_4257 | 49095 |
| ATCN_1544 | 35037 | ATCN_4258 | 49096 |
| ATCN_1545 | 35038 | ATCN_4259 | 49097 |
| TTCN_2134 | 35039 | TTCN_6152 | 49098 |
| TTCN_2135 | 35040 | CTCN_7298 | 49099 |
| CTCN_2532 | 35041 | CTCN_7299 | 49100 |
| GTCN_1372 | 35042 | TTCN_6153 | 49101 |
| GTCN_1373 | 35043 | CTCN_7300 | 49102 |
| GTCN_1374 | 35044 | GTCN_3933 | 49103 |
| CTCN_2533 | 35045 | GTCN_3934 | 49104 |
| TTCN_2136 | 35046 | GTCN_3935 | 49105 |
| ATCN_1546 | 35047 | TTCN_6154 | 49106 |
| CTCN_2534 | 35048 | CTCN_7301 | 49107 |
| TTCN_2137 | 35049 | GTCN_3936 | 49108 |
| TTCN_2138 | 35050 | CTCN_7302 | 49109 |
| ATCN_1547 | 35051 | CTCN_7303 | 49110 |
| CTCN_2535 | 35052 | GTCN_3937 | 49111 |
| TTCN_2139 | 35053 | TTCN_6155 | 49112 |
| CTCN_2536 | 35054 | CTCN_7304 | 49113 |
| ATCN_1548 | 35055 | CTCN_7305 | 49114 |
| TTCN_2140 | 35056 | TTCN_6156 | 49115 |
| ATCN_1549 | 35057 | TTCN_6157 | 49116 |
| CTCN_2537 | 35058 | TTCN_6158 | 49117 |
| CTCN_2538 | 35059 | GTCN_3938 | 49118 |
| CTCN_2539 | 35060 | GTCN_3939 | 49119 |
| CTCN_2540 | 35061 | CTCN_7306 | 49120 |

| | | | |
|---|---|---|---|
| ATCN_1550 | 35062 | TTCN_6159 | 49121 |
| TTCN_2141 | 35063 | ATCN_4260 | 49122 |
| TTCN_2142 | 35064 | ATCN_4261 | 49123 |
| GTCN_1375 | 35065 | GTCN_3940 | 49124 |
| ATCN_1551 | 35066 | CTCN_7307 | 49125 |
| GTCN_1376 | 35067 | TTCN_6160 | 49126 |
| CTCN_2541 | 35068 | ATCN_4262 | 49127 |
| CTCN_2542 | 35069 | TTCN_6161 | 49128 |
| GTCN_1377 | 35070 | CTCN_7308 | 49129 |
| CTCN_2543 | 35071 | ATCN_4263 | 49130 |
| TTCN_2143 | 35072 | TTCN_6162 | 49131 |
| TTCN_2144 | 35073 | ATCN_4264 | 49132 |
| TTCN_2145 | 35074 | TTCN_6163 | 49133 |
| TTCN_2146 | 35075 | CTCN_7309 | 49134 |
| ATCN_1552 | 35076 | GTCN_3941 | 49135 |
| CTCN_2544 | 35077 | CTCN_7310 | 49136 |
| TTCN_2147 | 35078 | GTCN_3942 | 49137 |
| GTCN_1378 | 35079 | CTCN_7311 | 49138 |
| GTCN_1379 | 35080 | GTCN_3943 | 49139 |
| ATCN_1553 | 35081 | TTCN_6164 | 49140 |
| GTCN_1380 | 35082 | CTCN_7312 | 49141 |
| CTCN_2545 | 35083 | TTCN_6165 | 49142 |
| CTCN_2546 | 35084 | TTCN_6166 | 49143 |
| TTCN_2148 | 35085 | GTCN_3944 | 49144 |
| ATCN_1554 | 35086 | TTCN_6167 | 49145 |
| CTCN_2547 | 35087 | CTCN_7313 | 49146 |
| CTCN_2548 | 35088 | ATCN_4265 | 49147 |
| TTCN_2149 | 35089 | TTCN_6168 | 49148 |
| GTCN_1381 | 35090 | CTCN_7314 | 49149 |
| CTCN_2549 | 35091 | GTCN_3945 | 49150 |
| GTCN_1382 | 35092 | TTCN_6169 | 49151 |
| CTCN_2550 | 35093 | CTCN_7315 | 49152 |
| GTCN_1383 | 35094 | GTCN_3946 | 49153 |
| TTCN_2150 | 35095 | CTCN_7316 | 49154 |
| TTCN_2151 | 35096 | ATCN_4266 | 49155 |
| CTCN_2551 | 35097 | TTCN_6170 | 49156 |
| GTCN_1384 | 35098 | GTCN_3947 | 49157 |
| CTCN_2552 | 35099 | TTCN_6171 | 49158 |
| TTCN_2152 | 35100 | TTCN_6172 | 49159 |
| CTCN_2553 | 35101 | TTCN_6173 | 49160 |
| TTCN_2153 | 35102 | TTCN_6174 | 49161 |
| ATCN_1555 | 35103 | ATCN_4267 | 49162 |
| CTCN_2554 | 35104 | TTCN_6175 | 49163 |

FIG. 37 (continued)

| | | | |
|---|---|---|---|
| ATCN_1556 | 35105 | CTCN_7317 | 49164 |
| ATCN_1557 | 35106 | CTCN_7318 | 49165 |
| TTCN_2154 | 35107 | GTCN_3948 | 49166 |
| CTCN_2555 | 35108 | GTCN_3949 | 49167 |
| GTCN_1385 | 35109 | CTCN_7319 | 49168 |
| ATCN_1558 | 35110 | GTCN_3950 | 49169 |
| ATCN_1559 | 35111 | ATCN_4268 | 49170 |
| CTCN_2556 | 35112 | CTCN_7320 | 49171 |
| GTCN_1386 | 35113 | GTCN_3951 | 49172 |
| TTCN_2155 | 35114 | CTCN_7321 | 49173 |
| CTCN_2557 | 35115 | TTCN_6176 | 49174 |
| CTCN_2558 | 35116 | CTCN_7322 | 49175 |
| TTCN_2156 | 35117 | TTCN_6177 | 49176 |
| TTCN_2157 | 35118 | TTCN_6178 | 49177 |
| GTCN_1387 | 35119 | TTCN_6179 | 49178 |
| CTCN_2559 | 35120 | TTCN_6180 | 49179 |
| CTCN_2560 | 35121 | ATCN_4269 | 49180 |
| GTCN_1388 | 35122 | TTCN_6181 | 49181 |
| CTCN_2561 | 35123 | ATCN_4270 | 49182 |
| TTCN_2158 | 35124 | CTCN_7323 | 49183 |
| ATCN_1560 | 35125 | TTCN_6182 | 49184 |
| GTCN_1389 | 35126 | ATCN_4271 | 49185 |
| CTCN_2562 | 35127 | GTCN_3952 | 49186 |
| GTCN_1390 | 35128 | ATCN_4272 | 49187 |
| TTCN_2159 | 35129 | ATCN_4273 | 49188 |
| CTCN_2563 | 35130 | CTCN_7324 | 49189 |
| TTCN_2160 | 35131 | TTCN_6183 | 49190 |
| CTCN_2564 | 35132 | ATCN_4274 | 49191 |
| CTCN_2565 | 35133 | TTCN_6184 | 49192 |
| GTCN_1391 | 35134 | GTCN_3953 | 49193 |
| ATCN_1561 | 35135 | TTCN_6185 | 49194 |
| TTCN_2161 | 35136 | TTCN_6186 | 49195 |
| CTCN_2566 | 35137 | GTCN_3954 | 49196 |
| GTCN_1392 | 35138 | ATCN_4275 | 49197 |
| CTCN_2567 | 35139 | CTCN_7325 | 49198 |
| TTCN_2162 | 35140 | GTCN_3955 | 49199 |
| ATCN_1562 | 35141 | CTCN_7326 | 49200 |
| TTCN_2163 | 35142 | TTCN_6187 | 49201 |
| GTCN_1393 | 35143 | CTCN_7327 | 49202 |
| CTCN_2568 | 35144 | TTCN_6188 | 49203 |
| GTCN_1394 | 35145 | TTCN_6189 | 49204 |
| CTCN_2569 | 35146 | CTCN_7328 | 49205 |
| TTCN_2164 | 35147 | TTCN_6190 | 49206 |

| | | | |
|---|---|---|---|
| TTCN_2165 | 35148 | GTCN_3956 | 49207 |
| GTCN_1395 | 35149 | ATCN_4276 | 49208 |
| TTCN_2166 | 35150 | TTCN_6191 | 49209 |
| CTCN_2570 | 35151 | TTCN_6192 | 49210 |
| CTCN_2571 | 35152 | CTCN_7329 | 49211 |
| TTCN_2167 | 35153 | ATCN_4277 | 49212 |
| GTCN_1396 | 35154 | ATCN_4278 | 49213 |
| ATCN_1563 | 35155 | TTCN_6193 | 49214 |
| TTCN_2168 | 35156 | TTCN_6194 | 49215 |
| CTCN_2572 | 35157 | CTCN_7330 | 49216 |
| TTCN_2169 | 35158 | GTCN_3957 | 49217 |
| ATCN_1564 | 35159 | CTCN_7331 | 49218 |
| ATCN_1565 | 35160 | ATCN_4279 | 49219 |
| CTCN_2573 | 35161 | CTCN_7332 | 49220 |
| TTCN_2170 | 35162 | TTCN_6195 | 49221 |
| CTCN_2574 | 35163 | GTCN_3958 | 49222 |
| TTCN_2171 | 35164 | CTCN_7333 | 49223 |
| TTCN_2172 | 35165 | CTCN_7334 | 49224 |
| ATCN_1566 | 35166 | ATCN_4280 | 49225 |
| ATCN_1567 | 35167 | TTCN_6196 | 49226 |
| CTCN_2575 | 35168 | CTCN_7335 | 49227 |
| TTCN_2173 | 35169 | CTCN_7336 | 49228 |
| CTCN_2576 | 35170 | TTCN_6197 | 49229 |
| GTCN_1397 | 35171 | ATCN_4281 | 49230 |
| CTCN_2577 | 35172 | ATCN_4282 | 49231 |
| CTCN_2578 | 35173 | TTCN_6198 | 49232 |
| CTCN_2579 | 35174 | CTCN_7337 | 49233 |
| CTCN_2580 | 35175 | TTCN_6199 | 49234 |
| CTCN_2581 | 35176 | ATCN_4283 | 49235 |
| CTCN_2582 | 35177 | CTCN_7338 | 49236 |
| CTCN_2583 | 35178 | CTCN_7339 | 49237 |
| TTCN_2174 | 35179 | TTCN_6200 | 49238 |
| TTCN_2175 | 35180 | GTCN_3959 | 49239 |
| TTCN_2176 | 35181 | TTCN_6201 | 49240 |
| CTCN_2584 | 35182 | GTCN_3960 | 49241 |
| TTCN_2177 | 35183 | CTCN_7340 | 49242 |
| TTCN_2178 | 35184 | ATCN_4284 | 49243 |
| ATCN_1568 | 35185 | ATCN_4285 | 49244 |
| CTCN_2585 | 35186 | ATCN_4286 | 49245 |
| GTCN_1398 | 35187 | TTCN_6202 | 49246 |
| CTCN_2586 | 35188 | GTCN_3961 | 49247 |
| CTCN_2587 | 35189 | GTCN_3962 | 49248 |
| CTCN_2588 | 35190 | GTCN_3963 | 49249 |

FIG. 37 (continued)

| | | | |
|---|---|---|---|
| ATCN_1569 | 35191 | TTCN_6203 | 49250 |
| CTCN_2589 | 35192 | CTCN_7341 | 49251 |
| TTCN_2179 | 35193 | ATCN_4287 | 49252 |
| GTCN_1399 | 35194 | TTCN_6204 | 49253 |
| CTCN_2590 | 35195 | TTCN_6205 | 49254 |
| TTCN_2180 | 35196 | CTCN_7342 | 49255 |
| ATCN_1570 | 35197 | ATCN_4288 | 49256 |
| GTCN_1400 | 35198 | ATCN_4289 | 49257 |
| TTCN_2181 | 35199 | CTCN_7343 | 49258 |
| CTCN_2591 | 35200 | ATCN_4290 | 49259 |
| CTCN_2592 | 35201 | TTCN_6206 | 49260 |
| TTCN_2182 | 35202 | ATCN_4291 | 49261 |
| TTCN_2183 | 35203 | ATCN_4292 | 49262 |
| CTCN_2593 | 35204 | GTCN_3964 | 49263 |
| GTCN_1401 | 35205 | CTCN_7344 | 49264 |
| TTCN_2184 | 35206 | CTCN_7345 | 49265 |
| TTCN_2185 | 35207 | TTCN_6207 | 49266 |
| TTCN_2186 | 35208 | TTCN_6208 | 49267 |
| TTCN_2187 | 35209 | GTCN_3965 | 49268 |
| TTCN_2188 | 35210 | ATCN_4293 | 49269 |
| CTCN_2594 | 35211 | CTCN_7346 | 49270 |
| GTCN_1402 | 35212 | ATCN_4294 | 49271 |
| TTCN_2189 | 35213 | TTCN_6209 | 49272 |
| TTCN_2190 | 35214 | GTCN_3966 | 49273 |
| CTCN_2595 | 35215 | CTCN_7347 | 49274 |
| GTCN_1403 | 35216 | CTCN_7348 | 49275 |
| CTCN_2596 | 35217 | CTCN_7349 | 49276 |
| TTCN_2191 | 35218 | CTCN_7350 | 49277 |
| TTCN_2192 | 35219 | CTCN_7351 | 49278 |
| GTCN_1404 | 35220 | TTCN_6210 | 49279 |
| TTCN_2193 | 35221 | CTCN_7352 | 49280 |
| ATCN_1571 | 35222 | CTCN_7353 | 49281 |
| CTCN_2597 | 35223 | TTCN_6211 | 49282 |
| TTCN_2194 | 35224 | TTCN_6212 | 49283 |
| ATCN_1572 | 35225 | TTCN_6213 | 49284 |
| ATCN_1573 | 35226 | TTCN_6214 | 49285 |
| TTCN_2195 | 35227 | GTCN_3967 | 49286 |
| ATCN_1574 | 35228 | TTCN_6215 | 49287 |
| TTCN_2196 | 35229 | ATCN_4295 | 49288 |
| ATCN_1575 | 35230 | CTCN_7354 | 49289 |
| TTCN_2197 | 35231 | GTCN_3968 | 49290 |
| CTCN_2598 | 35232 | CTCN_7355 | 49291 |
| GTCN_1405 | 35233 | TTCN_6216 | 49292 |

| | | | |
|---|---|---|---|
| GTCN_1406 | 35234 | TTCN_6217 | 49293 |
| GTCN_1407 | 35235 | GTCN_3969 | 49294 |
| TTCN_2198 | 35236 | CTCN_7356 | 49295 |
| ATCN_1576 | 35237 | TTCN_6218 | 49296 |
| ATCN_1577 | 35238 | CTCN_7357 | 49297 |
| CTCN_2599 | 35239 | GTCN_3970 | 49298 |
| CTCN_2600 | 35240 | GTCN_3971 | 49299 |
| CTCN_2601 | 35241 | TTCN_6219 | 49300 |
| CTCN_2602 | 35242 | CTCN_7358 | 49301 |
| ATCN_1578 | 35243 | CTCN_7359 | 49302 |
| TTCN_2199 | 35244 | CTCN_7360 | 49303 |
| TTCN_2200 | 35245 | ATCN_4296 | 49304 |
| CTCN_2603 | 35246 | ATCN_4297 | 49305 |
| CTCN_2604 | 35247 | ATCN_4298 | 49306 |
| CTCN_2605 | 35248 | GTCN_3972 | 49307 |
| CTCN_2606 | 35249 | GTCN_3973 | 49308 |
| ATCN_1579 | 35250 | CTCN_7361 | 49309 |
| CTCN_2607 | 35251 | GTCN_3974 | 49310 |
| CTCN_2608 | 35252 | GTCN_3975 | 49311 |
| GTCN_1408 | 35253 | CTCN_7362 | 49312 |
| TTCN_2201 | 35254 | CTCN_7363 | 49313 |
| ATCN_1580 | 35255 | TTCN_6220 | 49314 |
| GTCN_1409 | 35256 | CTCN_7364 | 49315 |
| CTCN_2609 | 35257 | GTCN_3976 | 49316 |
| CTCN_2610 | 35258 | ATCN_4299 | 49317 |
| GTCN_1410 | 35259 | GTCN_3977 | 49318 |
| CTCN_2611 | 35260 | CTCN_7365 | 49319 |
| ATCN_1581 | 35261 | TTCN_6221 | 49320 |
| ATCN_1582 | 35262 | CTCN_7366 | 49321 |
| CTCN_2612 | 35263 | TTCN_6222 | 49322 |
| TTCN_2202 | 35264 | ATCN_4300 | 49323 |
| ATCN_1583 | 35265 | ATCN_4301 | 49324 |
| CTCN_2613 | 35266 | CTCN_7367 | 49325 |
| CTCN_2614 | 35267 | CTCN_7368 | 49326 |
| CTCN_2615 | 35268 | GTCN_3978 | 49327 |
| GTCN_1411 | 35269 | CTCN_7369 | 49328 |
| ATCN_1584 | 35270 | TTCN_6223 | 49329 |
| TTCN_2203 | 35271 | TTCN_6224 | 49330 |
| CTCN_2616 | 35272 | TTCN_6225 | 49331 |
| ATCN_1585 | 35273 | CTCN_7370 | 49332 |
| ATCN_1586 | 35274 | CTCN_7371 | 49333 |
| GTCN_1412 | 35275 | TTCN_6226 | 49334 |
| CTCN_2617 | 35276 | CTCN_7372 | 49335 |

FIG. 37 (continued)

| | | | |
|---|---|---|---|
| GTCN_1413 | 35277 | TTCN_6227 | 49336 |
| ATCN_1587 | 35278 | TTCN_6228 | 49337 |
| ATCN_1588 | 35279 | CTCN_7373 | 49338 |
| TTCN_2204 | 35280 | TTCN_6229 | 49339 |
| CTCN_2618 | 35281 | CTCN_7374 | 49340 |
| ATCN_1589 | 35282 | GTCN_3979 | 49341 |
| TTCN_2205 | 35283 | GTCN_3980 | 49342 |
| GTCN_1414 | 35284 | CTCN_7375 | 49343 |
| TTCN_2206 | 35285 | CTCN_7376 | 49344 |
| TTCN_2207 | 35286 | ATCN_4302 | 49345 |
| ATCN_1590 | 35287 | CTCN_7377 | 49346 |
| ATCN_1591 | 35288 | GTCN_3981 | 49347 |
| GTCN_1415 | 35289 | GTCN_3982 | 49348 |
| TTCN_2208 | 35290 | CTCN_7378 | 49349 |
| CTCN_2619 | 35291 | ATCN_4303 | 49350 |
| CTCN_2620 | 35292 | CTCN_7379 | 49351 |
| GTCN_1416 | 35293 | CTCN_7380 | 49352 |
| CTCN_2621 | 35294 | CTCN_7381 | 49353 |
| ATCN_1592 | 35295 | CTCN_7382 | 49354 |
| TTCN_2209 | 35296 | GTCN_3983 | 49355 |
| CTCN_2622 | 35297 | CTCN_7383 | 49356 |
| ATCN_1593 | 35298 | TTCN_6230 | 49357 |
| CTCN_2623 | 35299 | ATCN_4304 | 49358 |
| TTCN_2210 | 35300 | TTCN_6231 | 49359 |
| ATCN_1594 | 35301 | CTCN_7384 | 49360 |
| ATCN_1595 | 35302 | GTCN_3984 | 49361 |
| CTCN_2624 | 35303 | ATCN_4305 | 49362 |
| TTCN_2211 | 35304 | ATCN_4306 | 49363 |
| CTCN_2625 | 35305 | CTCN_7385 | 49364 |
| CTCN_2626 | 35306 | GTCN_3985 | 49365 |
| TTCN_2212 | 35307 | CTCN_7386 | 49366 |
| CTCN_2627 | 35308 | CTCN_7387 | 49367 |
| TTCN_2213 | 35309 | GTCN_3986 | 49368 |
| TTCN_2214 | 35310 | TTCN_6232 | 49369 |
| TTCN_2215 | 35311 | TTCN_6233 | 49370 |
| CTCN_2628 | 35312 | CTCN_7388 | 49371 |
| TTCN_2216 | 35313 | CTCN_7389 | 49372 |
| ATCN_1596 | 35314 | CTCN_7390 | 49373 |
| TTCN_2217 | 35315 | CTCN_7391 | 49374 |
| GTCN_1417 | 35316 | CTCN_7392 | 49375 |
| CTCN_2629 | 35317 | GTCN_3987 | 49376 |
| ATCN_1597 | 35318 | CTCN_7393 | 49377 |
| CTCN_2630 | 35319 | CTCN_7394 | 49378 |

| | | | |
|---|---|---|---|
| TTCN_2218 | 35320 | CTCN_7395 | 49379 |
| CTCN_2631 | 35321 | CTCN_7396 | 49380 |
| ATCN_1598 | 35322 | TTCN_6234 | 49381 |
| TTCN_2219 | 35323 | TTCN_6235 | 49382 |
| TTCN_2220 | 35324 | GTCN_3988 | 49383 |
| GTCN_1418 | 35325 | CTCN_7397 | 49384 |
| CTCN_2632 | 35326 | CTCN_7398 | 49385 |
| TTCN_2221 | 35327 | TTCN_6236 | 49386 |
| ATCN_1599 | 35328 | GTCN_3989 | 49387 |
| TTCN_2222 | 35329 | GTCN_3990 | 49388 |
| ATCN_1600 | 35330 | TTCN_6237 | 49389 |
| TTCN_2223 | 35331 | CTCN_7399 | 49390 |
| CTCN_2633 | 35332 | CTCN_7400 | 49391 |
| ATCN_1601 | 35333 | ATCN_4307 | 49392 |
| ATCN_1602 | 35334 | GTCN_3991 | 49393 |
| TTCN_2224 | 35335 | CTCN_7401 | 49394 |
| ATCN_1603 | 35336 | CTCN_7402 | 49395 |
| CTCN_2634 | 35337 | TTCN_6238 | 49396 |
| TTCN_2225 | 35338 | GTCN_3992 | 49397 |
| TTCN_2226 | 35339 | GTCN_3993 | 49398 |
| TTCN_2227 | 35340 | GTCN_3994 | 49399 |
| GTCN_1419 | 35341 | CTCN_7403 | 49400 |
| TTCN_2228 | 35342 | TTCN_6239 | 49401 |
| ATCN_1604 | 35343 | TTCN_6240 | 49402 |
| TTCN_2229 | 35344 | CTCN_7404 | 49403 |
| CTCN_2635 | 35345 | TTCN_6241 | 49404 |
| GTCN_1420 | 35346 | GTCN_3995 | 49405 |
| GTCN_1421 | 35347 | GTCN_3996 | 49406 |
| CTCN_2636 | 35348 | ATCN_4308 | 49407 |
| GTCN_1422 | 35349 | TTCN_6242 | 49408 |
| CTCN_2637 | 35350 | TTCN_6243 | 49409 |
| ATCN_1605 | 35351 | TTCN_6244 | 49410 |
| CTCN_2638 | 35352 | GTCN_3997 | 49411 |
| CTCN_2639 | 35353 | TTCN_6245 | 49412 |
| ATCN_1606 | 35354 | CTCN_7405 | 49413 |
| CTCN_2640 | 35355 | GTCN_3998 | 49414 |
| CTCN_2641 | 35356 | ATCN_4309 | 49415 |
| GTCN_1423 | 35357 | GTCN_3999 | 49416 |
| ATCN_1607 | 35358 | TTCN_6246 | 49417 |
| CTCN_2642 | 35359 | ATCN_4310 | 49418 |
| ATCN_1608 | 35360 | TTCN_6247 | 49419 |
| CTCN_2643 | 35361 | CTCN_7406 | 49420 |
| CTCN_2644 | 35362 | GTCN_4000 | 49421 |

FIG. 37 (continued)

| | | | |
|---|---|---|---|
| GTCN_1424 | 35363 | GTCN_4001 | 49422 |
| CTCN_2645 | 35364 | GTCN_4002 | 49423 |
| ATCN_1609 | 35365 | TTCN_6248 | 49424 |
| CTCN_2646 | 35366 | ATCN_4311 | 49425 |
| GTCN_1425 | 35367 | TTCN_6249 | 49426 |
| CTCN_2647 | 35368 | GTCN_4003 | 49427 |
| TTCN_2230 | 35369 | GTCN_4004 | 49428 |
| GTCN_1426 | 35370 | ATCN_4312 | 49429 |
| CTCN_2648 | 35371 | TTCN_6250 | 49430 |
| TTCN_2231 | 35372 | TTCN_6251 | 49431 |
| CTCN_2649 | 35373 | CTCN_7407 | 49432 |
| GTCN_1427 | 35374 | GTCN_4005 | 49433 |
| CTCN_2650 | 35375 | TTCN_6252 | 49434 |
| CTCN_2651 | 35376 | ATCN_4313 | 49435 |
| ATCN_1610 | 35377 | ATCN_4314 | 49436 |
| GTCN_1428 | 35378 | CTCN_7408 | 49437 |
| TTCN_2232 | 35379 | GTCN_4006 | 49438 |
| CTCN_2652 | 35380 | TTCN_6253 | 49439 |
| GTCN_1429 | 35381 | GTCN_4007 | 49440 |
| TTCN_2233 | 35382 | CTCN_7409 | 49441 |
| GTCN_1430 | 35383 | GTCN_4008 | 49442 |
| ATCN_1611 | 35384 | CTCN_7410 | 49443 |
| ATCN_1612 | 35385 | GTCN_4009 | 49444 |
| GTCN_1431 | 35386 | TTCN_6254 | 49445 |
| ATCN_1613 | 35387 | TTCN_6255 | 49446 |
| ATCN_1614 | 35388 | ATCN_4315 | 49447 |
| ATCN_1615 | 35389 | CTCN_7411 | 49448 |
| ATCN_1616 | 35390 | CTCN_7412 | 49449 |
| CTCN_2653 | 35391 | CTCN_7413 | 49450 |
| CTCN_2654 | 35392 | GTCN_4010 | 49451 |
| ATCN_1617 | 35393 | CTCN_7414 | 49452 |
| ATCN_1618 | 35394 | ATCN_4316 | 49453 |
| TTCN_2234 | 35395 | CTCN_7415 | 49454 |
| TTCN_2235 | 35396 | GTCN_4011 | 49455 |
| TTCN_2236 | 35397 | CTCN_7416 | 49456 |
| TTCN_2237 | 35398 | CTCN_7417 | 49457 |
| ATCN_1619 | 35399 | TTCN_6256 | 49458 |
| TTCN_2238 | 35400 | TTCN_6257 | 49459 |
| TTCN_2239 | 35401 | TTCN_6258 | 49460 |
| CTCN_2655 | 35402 | GTCN_4012 | 49461 |
| CTCN_2656 | 35403 | TTCN_6259 | 49462 |
| ATCN_1620 | 35404 | ATCN_4317 | 49463 |
| GTCN_1432 | 35405 | TTCN_6260 | 49464 |

| | | | |
|---|---|---|---|
| CTCN_2657 | 35406 | CTCN_7418 | 49465 |
| TTCN_2240 | 35407 | CTCN_7419 | 49466 |
| CTCN_2658 | 35408 | GTCN_4013 | 49467 |
| CTCN_2659 | 35409 | TTCN_6261 | 49468 |
| CTCN_2660 | 35410 | CTCN_7420 | 49469 |
| CTCN_2661 | 35411 | GTCN_4014 | 49470 |
| CTCN_2662 | 35412 | ATCN_4318 | 49471 |
| TTCN_2241 | 35413 | ATCN_4319 | 49472 |
| TTCN_2242 | 35414 | TTCN_6262 | 49473 |
| TTCN_2243 | 35415 | ATCN_4320 | 49474 |
| GTCN_1433 | 35416 | CTCN_7421 | 49475 |
| CTCN_2663 | 35417 | CTCN_7422 | 49476 |
| TTCN_2244 | 35418 | GTCN_4015 | 49477 |
| ATCN_1621 | 35419 | CTCN_7423 | 49478 |
| CTCN_2664 | 35420 | GTCN_4016 | 49479 |
| GTCN_1434 | 35421 | GTCN_4017 | 49480 |
| GTCN_1435 | 35422 | CTCN_7424 | 49481 |
| TTCN_2245 | 35423 | GTCN_4018 | 49482 |
| TTCN_2246 | 35424 | GTCN_4019 | 49483 |
| TTCN_2247 | 35425 | GTCN_4020 | 49484 |
| TTCN_2248 | 35426 | CTCN_7425 | 49485 |
| GTCN_1436 | 35427 | TTCN_6263 | 49486 |
| CTCN_2665 | 35428 | TTCN_6264 | 49487 |
| ATCN_1622 | 35429 | ATCN_4321 | 49488 |
| CTCN_2666 | 35430 | TTCN_6265 | 49489 |
| CTCN_2667 | 35431 | CTCN_7426 | 49490 |
| GTCN_1437 | 35432 | TTCN_6266 | 49491 |
| GTCN_1438 | 35433 | CTCN_7427 | 49492 |
| ATCN_1623 | 35434 | ATCN_4322 | 49493 |
| TTCN_2249 | 35435 | TTCN_6267 | 49494 |
| TTCN_2250 | 35436 | TTCN_6268 | 49495 |
| GTCN_1439 | 35437 | CTCN_7428 | 49496 |
| CTCN_2668 | 35438 | TTCN_6269 | 49497 |
| CTCN_2669 | 35439 | CTCN_7429 | 49498 |
| GTCN_1440 | 35440 | GTCN_4021 | 49499 |
| TTCN_2251 | 35441 | TTCN_6270 | 49500 |
| ATCN_1624 | 35442 | CTCN_7430 | 49501 |
| ATCN_1625 | 35443 | GTCN_4022 | 49502 |
| GTCN_1441 | 35444 | GTCN_4023 | 49503 |
| TTCN_2252 | 35445 | CTCN_7431 | 49504 |
| CTCN_2670 | 35446 | CTCN_7432 | 49505 |
| CTCN_2671 | 35447 | TTCN_6271 | 49506 |
| GTCN_1442 | 35448 | CTCN_7433 | 49507 |

FIG. 37 (continued)

| | | | |
|---|---|---|---|
| GTCN_1443 | 35449 | ATCN_4323 | 49508 |
| GTCN_1444 | 35450 | CTCN_7434 | 49509 |
| CTCN_2672 | 35451 | GTCN_4024 | 49510 |
| CTCN_2673 | 35452 | ATCN_4324 | 49511 |
| CTCN_2674 | 35453 | CTCN_7435 | 49512 |
| TTCN_2253 | 35454 | GTCN_4025 | 49513 |
| GTCN_1445 | 35455 | CTCN_7436 | 49514 |
| GTCN_1446 | 35456 | CTCN_7437 | 49515 |
| GTCN_1447 | 35457 | TTCN_6272 | 49516 |
| CTCN_2675 | 35458 | TTCN_6273 | 49517 |
| TTCN_2254 | 35459 | TTCN_6274 | 49518 |
| ATCN_1626 | 35460 | CTCN_7438 | 49519 |
| CTCN_2676 | 35461 | ATCN_4325 | 49520 |
| ATCN_1627 | 35462 | TTCN_6275 | 49521 |
| CTCN_2677 | 35463 | CTCN_7439 | 49522 |
| CTCN_2678 | 35464 | TTCN_6276 | 49523 |
| ATCN_1628 | 35465 | CTCN_7440 | 49524 |
| TTCN_2255 | 35466 | TTCN_6277 | 49525 |
| CTCN_2679 | 35467 | ATCN_4326 | 49526 |
| GTCN_1448 | 35468 | TTCN_6278 | 49527 |
| CTCN_2680 | 35469 | GTCN_4026 | 49528 |
| CTCN_2681 | 35470 | CTCN_7441 | 49529 |
| TTCN_2256 | 35471 | TTCN_6279 | 49530 |
| CTCN_2682 | 35472 | ATCN_4327 | 49531 |
| ATCN_1629 | 35473 | ATCN_4328 | 49532 |
| ATCN_1630 | 35474 | CTCN_7442 | 49533 |
| CTCN_2683 | 35475 | TTCN_6280 | 49534 |
| CTCN_2684 | 35476 | TTCN_6281 | 49535 |
| CTCN_2685 | 35477 | GTCN_4027 | 49536 |
| CTCN_2686 | 35478 | ATCN_4329 | 49537 |
| TTCN_2257 | 35479 | TTCN_6282 | 49538 |
| TTCN_2258 | 35480 | CTCN_7443 | 49539 |
| CTCN_2687 | 35481 | TTCN_6283 | 49540 |
| CTCN_2688 | 35482 | ATCN_4330 | 49541 |
| CTCN_2689 | 35483 | ATCN_4331 | 49542 |
| ATCN_1631 | 35484 | TTCN_6284 | 49543 |
| ATCN_1632 | 35485 | CTCN_7444 | 49544 |
| TTCN_2259 | 35486 | GTCN_4028 | 49545 |
| CTCN_2690 | 35487 | GTCN_4029 | 49546 |
| GTCN_1449 | 35488 | GTCN_4030 | 49547 |
| TTCN_2260 | 35489 | CTCN_7445 | 49548 |
| TTCN_2261 | 35490 | TTCN_6285 | 49549 |
| TTCN_2262 | 35491 | GTCN_4031 | 49550 |

| | | | |
|---|---|---|---|
| TTCN_2263 | 35492 | TTCN_6286 | 49551 |
| GTCN_1450 | 35493 | GTCN_4032 | 49552 |
| CTCN_2691 | 35494 | CTCN_7446 | 49553 |
| ATCN_1633 | 35495 | TTCN_6287 | 49554 |
| ATCN_1634 | 35496 | ATCN_4332 | 49555 |
| CTCN_2692 | 35497 | CTCN_7447 | 49556 |
| GTCN_1451 | 35498 | GTCN_4033 | 49557 |
| CTCN_2693 | 35499 | GTCN_4034 | 49558 |
| CTCN_2694 | 35500 | CTCN_7448 | 49559 |
| ATCN_1635 | 35501 | CTCN_7449 | 49560 |
| CTCN_2695 | 35502 | GTCN_4035 | 49561 |
| CTCN_2696 | 35503 | CTCN_7450 | 49562 |
| GTCN_1452 | 35504 | TTCN_6288 | 49563 |
| CTCN_2697 | 35505 | CTCN_7451 | 49564 |
| TTCN_2264 | 35506 | ATCN_4333 | 49565 |
| ATCN_1636 | 35507 | CTCN_7452 | 49566 |
| TTCN_2265 | 35508 | CTCN_7453 | 49567 |
| CTCN_2698 | 35509 | GTCN_4036 | 49568 |
| CTCN_2699 | 35510 | ATCN_4334 | 49569 |
| TTCN_2266 | 35511 | ATCN_4335 | 49570 |
| TTCN_2267 | 35512 | TTCN_6289 | 49571 |
| TTCN_2268 | 35513 | TTCN_6290 | 49572 |
| CTCN_2700 | 35514 | TTCN_6291 | 49573 |
| CTCN_2701 | 35515 | CTCN_7454 | 49574 |
| CTCN_2702 | 35516 | ATCN_4336 | 49575 |
| TTCN_2269 | 35517 | TTCN_6292 | 49576 |
| CTCN_2703 | 35518 | GTCN_4037 | 49577 |
| CTCN_2704 | 35519 | TTCN_6293 | 49578 |
| GTCN_1453 | 35520 | TTCN_6294 | 49579 |
| TTCN_2270 | 35521 | CTCN_7455 | 49580 |
| CTCN_2705 | 35522 | ATCN_4337 | 49581 |
| CTCN_2706 | 35523 | TTCN_6295 | 49582 |
| GTCN_1454 | 35524 | TTCN_6296 | 49583 |
| ATCN_1637 | 35525 | GTCN_4038 | 49584 |
| CTCN_2707 | 35526 | GTCN_4039 | 49585 |
| CTCN_2708 | 35527 | CTCN_7456 | 49586 |
| CTCN_2709 | 35528 | GTCN_4040 | 49587 |
| ATCN_1638 | 35529 | CTCN_7457 | 49588 |
| CTCN_2710 | 35530 | GTCN_4041 | 49589 |
| TTCN_2271 | 35531 | TTCN_6297 | 49590 |
| ATCN_1639 | 35532 | TTCN_6298 | 49591 |
| CTCN_2711 | 35533 | GTCN_4042 | 49592 |
| CTCN_2712 | 35534 | ATCN_4338 | 49593 |

FIG. 37 (continued)

| | | | |
|---|---|---|---|
| CTCN_2713 | 35535 | ATCN_4339 | 49594 |
| ATCN_1640 | 35536 | TTCN_6299 | 49595 |
| GTCN_1455 | 35537 | TTCN_6300 | 49596 |
| CTCN_2714 | 35538 | GTCN_4043 | 49597 |
| CTCN_2715 | 35539 | TTCN_6301 | 49598 |
| TTCN_2272 | 35540 | CTCN_7458 | 49599 |
| ATCN_1641 | 35541 | TTCN_6302 | 49600 |
| CTCN_2716 | 35542 | TTCN_6303 | 49601 |
| ATCN_1642 | 35543 | GTCN_4044 | 49602 |
| GTCN_1456 | 35544 | GTCN_4045 | 49603 |
| GTCN_1457 | 35545 | TTCN_6304 | 49604 |
| ATCN_1643 | 35546 | TTCN_6305 | 49605 |
| GTCN_1458 | 35547 | CTCN_7459 | 49606 |
| CTCN_2717 | 35548 | TTCN_6306 | 49607 |
| CTCN_2718 | 35549 | TTCN_6307 | 49608 |
| CTCN_2719 | 35550 | ATCN_4340 | 49609 |
| GTCN_1459 | 35551 | TTCN_6308 | 49610 |
| GTCN_1460 | 35552 | TTCN_6309 | 49611 |
| GTCN_1461 | 35553 | CTCN_7460 | 49612 |
| TTCN_2273 | 35554 | ATCN_4341 | 49613 |
| GTCN_1462 | 35555 | ATCN_4342 | 49614 |
| GTCN_1463 | 35556 | TTCN_6310 | 49615 |
| TTCN_2274 | 35557 | GTCN_4046 | 49616 |
| GTCN_1464 | 35558 | TTCN_6311 | 49617 |
| CTCN_2720 | 35559 | GTCN_4047 | 49618 |
| CTCN_2721 | 35560 | ATCN_4343 | 49619 |
| GTCN_1465 | 35561 | GTCN_4048 | 49620 |
| TTCN_2275 | 35562 | CTCN_7461 | 49621 |
| ATCN_1644 | 35563 | CTCN_7462 | 49622 |
| ATCN_1645 | 35564 | GTCN_4049 | 49623 |
| CTCN_2722 | 35565 | CTCN_7463 | 49624 |
| TTCN_2276 | 35566 | CTCN_7464 | 49625 |
| TTCN_2277 | 35567 | TTCN_6312 | 49626 |
| TTCN_2278 | 35568 | CTCN_7465 | 49627 |
| CTCN_2723 | 35569 | ATCN_4344 | 49628 |
| TTCN_2279 | 35570 | GTCN_4050 | 49629 |
| ATCN_1646 | 35571 | CTCN_7466 | 49630 |
| GTCN_1466 | 35572 | TTCN_6313 | 49631 |
| CTCN_2724 | 35573 | CTCN_7467 | 49632 |
| CTCN_2725 | 35574 | TTCN_6314 | 49633 |
| ATCN_1647 | 35575 | CTCN_7468 | 49634 |
| GTCN_1467 | 35576 | CTCN_7469 | 49635 |
| TTCN_2280 | 35577 | TTCN_6315 | 49636 |

| | | | |
|---|---|---|---|
| TTCN_2281 | 35578 | GTCN_4051 | 49637 |
| ATCN_1648 | 35579 | GTCN_4052 | 49638 |
| GTCN_1468 | 35580 | GTCN_4053 | 49639 |
| CTCN_2726 | 35581 | CTCN_7470 | 49640 |
| ATCN_1649 | 35582 | GTCN_4054 | 49641 |
| GTCN_1469 | 35583 | CTCN_7471 | 49642 |
| ATCN_1650 | 35584 | GTCN_4055 | 49643 |
| TTCN_2282 | 35585 | TTCN_6316 | 49644 |
| GTCN_1470 | 35586 | TTCN_6317 | 49645 |
| CTCN_2727 | 35587 | TTCN_6318 | 49646 |
| CTCN_2728 | 35588 | CTCN_7472 | 49647 |
| TTCN_2283 | 35589 | CTCN_7473 | 49648 |
| GTCN_1471 | 35590 | GTCN_4056 | 49649 |
| GTCN_1472 | 35591 | CTCN_7474 | 49650 |
| CTCN_2729 | 35592 | GTCN_4057 | 49651 |
| GTCN_1473 | 35593 | CTCN_7475 | 49652 |
| CTCN_2730 | 35594 | ATCN_4345 | 49653 |
| GTCN_1474 | 35595 | GTCN_4058 | 49654 |
| CTCN_2731 | 35596 | CTCN_7476 | 49655 |
| CTCN_2732 | 35597 | CTCN_7477 | 49656 |
| CTCN_2733 | 35598 | ATCN_4346 | 49657 |
| GTCN_1475 | 35599 | GTCN_4059 | 49658 |
| ATCN_1651 | 35600 | ATCN_4347 | 49659 |
| CTCN_2734 | 35601 | CTCN_7478 | 49660 |
| GTCN_1476 | 35602 | CTCN_7479 | 49661 |
| TTCN_2284 | 35603 | CTCN_7480 | 49662 |
| TTCN_2285 | 35604 | GTCN_4060 | 49663 |
| TTCN_2286 | 35605 | GTCN_4061 | 49664 |
| TTCN_2287 | 35606 | CTCN_7481 | 49665 |
| TTCN_2288 | 35607 | CTCN_7482 | 49666 |
| CTCN_2735 | 35608 | TTCN_6319 | 49667 |
| GTCN_1477 | 35609 | GTCN_4062 | 49668 |
| CTCN_2736 | 35610 | ATCN_4348 | 49669 |
| GTCN_1478 | 35611 | CTCN_7483 | 49670 |
| CTCN_2737 | 35612 | TTCN_6320 | 49671 |
| CTCN_2738 | 35613 | TTCN_6321 | 49672 |
| GTCN_1479 | 35614 | TTCN_6322 | 49673 |
| CTCN_2739 | 35615 | ATCN_4349 | 49674 |
| ATCN_1652 | 35616 | CTCN_7484 | 49675 |
| CTCN_2740 | 35617 | TTCN_6323 | 49676 |
| CTCN_2741 | 35618 | TTCN_6324 | 49677 |
| CTCN_2742 | 35619 | TTCN_6325 | 49678 |
| TTCN_2289 | 35620 | CTCN_7485 | 49679 |

FIG. 37 (continued)

| | | | |
|---|---|---|---|
| ATCN_1653 | 35621 | CTCN_7486 | 49680 |
| TTCN_2290 | 35622 | TTCN_6326 | 49681 |
| CTCN_2743 | 35623 | TTCN_6327 | 49682 |
| ATCN_1654 | 35624 | TTCN_6328 | 49683 |
| CTCN_2744 | 35625 | TTCN_6329 | 49684 |
| GTCN_1480 | 35626 | TTCN_6330 | 49685 |
| CTCN_2745 | 35627 | TTCN_6331 | 49686 |
| CTCN_2746 | 35628 | TTCN_6332 | 49687 |
| ATCN_1655 | 35629 | TTCN_6333 | 49688 |
| CTCN_2747 | 35630 | TTCN_6334 | 49689 |
| TTCN_2291 | 35631 | TTCN_6335 | 49690 |
| ATCN_1656 | 35632 | ATCN_4350 | 49691 |
| GTCN_1481 | 35633 | TTCN_6336 | 49692 |
| TTCN_2292 | 35634 | CTCN_7487 | 49693 |
| CTCN_2748 | 35635 | ATCN_4351 | 49694 |
| GTCN_1482 | 35636 | GTCN_4063 | 49695 |
| CTCN_2749 | 35637 | GTCN_4064 | 49696 |
| ATCN_1657 | 35638 | CTCN_7488 | 49697 |
| ATCN_1658 | 35639 | CTCN_7489 | 49698 |
| CTCN_2750 | 35640 | ATCN_4352 | 49699 |
| CTCN_2751 | 35641 | ATCN_4353 | 49700 |
| GTCN_1483 | 35642 | CTCN_7490 | 49701 |
| ATCN_1659 | 35643 | CTCN_7491 | 49702 |
| CTCN_2752 | 35644 | CTCN_7492 | 49703 |
| GTCN_1484 | 35645 | GTCN_4065 | 49704 |
| TTCN_2293 | 35646 | ATCN_4354 | 49705 |
| TTCN_2294 | 35647 | ATCN_4355 | 49706 |
| TTCN_2295 | 35648 | GTCN_4066 | 49707 |
| GTCN_1485 | 35649 | GTCN_4067 | 49708 |
| TTCN_2296 | 35650 | GTCN_4068 | 49709 |
| ATCN_1660 | 35651 | CTCN_7493 | 49710 |
| TTCN_2297 | 35652 | CTCN_7494 | 49711 |
| GTCN_1486 | 35653 | CTCN_7495 | 49712 |
| CTCN_2753 | 35654 | ATCN_4356 | 49713 |
| TTCN_2298 | 35655 | CTCN_7496 | 49714 |
| GTCN_1487 | 35656 | CTCN_7497 | 49715 |
| TTCN_2299 | 35657 | ATCN_4357 | 49716 |
| CTCN_2754 | 35658 | CTCN_7498 | 49717 |
| CTCN_2755 | 35659 | TTCN_6337 | 49718 |
| GTCN_1488 | 35660 | TTCN_6338 | 49719 |
| TTCN_2300 | 35661 | CTCN_7499 | 49720 |
| TTCN_2301 | 35662 | CTCN_7500 | 49721 |
| TTCN_2302 | 35663 | TTCN_6339 | 49722 |

| | | | |
|---|---|---|---|
| TTCN_2303 | 35664 | CTCN_7501 | 49723 |
| ATCN_1661 | 35665 | ATCN_4358 | 49724 |
| TTCN_2304 | 35666 | TTCN_6340 | 49725 |
| ATCN_1662 | 35667 | CTCN_7502 | 49726 |
| ATCN_1663 | 35668 | TTCN_6341 | 49727 |
| CTCN_2756 | 35669 | ATCN_4359 | 49728 |
| TTCN_2305 | 35670 | ATCN_4360 | 49729 |
| TTCN_2306 | 35671 | ATCN_4361 | 49730 |
| CTCN_2757 | 35672 | ATCN_4362 | 49731 |
| GTCN_1489 | 35673 | TTCN_6342 | 49732 |
| CTCN_2758 | 35674 | ATCN_4363 | 49733 |
| CTCN_2759 | 35675 | TTCN_6343 | 49734 |
| TTCN_2307 | 35676 | TTCN_6344 | 49735 |
| CTCN_2760 | 35677 | CTCN_7503 | 49736 |
| GTCN_1490 | 35678 | ATCN_4364 | 49737 |
| TTCN_2308 | 35679 | TTCN_6345 | 49738 |
| GTCN_1491 | 35680 | ATCN_4365 | 49739 |
| CTCN_2761 | 35681 | TTCN_6346 | 49740 |
| TTCN_2309 | 35682 | CTCN_7504 | 49741 |
| CTCN_2762 | 35683 | GTCN_4069 | 49742 |
| GTCN_1492 | 35684 | GTCN_4070 | 49743 |
| TTCN_2310 | 35685 | CTCN_7505 | 49744 |
| TTCN_2311 | 35686 | CTCN_7506 | 49745 |
| TTCN_2312 | 35687 | GTCN_4071 | 49746 |
| TTCN_2313 | 35688 | CTCN_7507 | 49747 |
| ATCN_1664 | 35689 | TTCN_6347 | 49748 |
| TTCN_2314 | 35690 | TTCN_6348 | 49749 |
| GTCN_1493 | 35691 | TTCN_6349 | 49750 |
| CTCN_2763 | 35692 | ATCN_4366 | 49751 |
| ATCN_1665 | 35693 | GTCN_4072 | 49752 |
| TTCN_2315 | 35694 | TTCN_6350 | 49753 |
| TTCN_2316 | 35695 | CTCN_7508 | 49754 |
| TTCN_2317 | 35696 | TTCN_6351 | 49755 |
| CTCN_2764 | 35697 | TTCN_6352 | 49756 |
| CTCN_2765 | 35698 | GTCN_4073 | 49757 |
| ATCN_1666 | 35699 | TTCN_6353 | 49758 |
| ATCN_1667 | 35700 | GTCN_4074 | 49759 |
| CTCN_2766 | 35701 | TTCN_6354 | 49760 |
| CTCN_2767 | 35702 | TTCN_6355 | 49761 |
| CTCN_2768 | 35703 | ATCN_4367 | 49762 |
| TTCN_2318 | 35704 | TTCN_6356 | 49763 |
| ATCN_1668 | 35705 | CTCN_7509 | 49764 |
| ATCN_1669 | 35706 | GTCN_4075 | 49765 |

FIG. 37 (continued)

| | | | |
|---|---|---|---|
| CTCN_2769 | 35707 | TTCN_6357 | 49766 |
| CTCN_2770 | 35708 | CTCN_7510 | 49767 |
| CTCN_2771 | 35709 | GTCN_4076 | 49768 |
| CTCN_2772 | 35710 | TTCN_6358 | 49769 |
| ATCN_1670 | 35711 | CTCN_7511 | 49770 |
| ATCN_1671 | 35712 | GTCN_4077 | 49771 |
| CTCN_2773 | 35713 | TTCN_6359 | 49772 |
| TTCN_2319 | 35714 | GTCN_4078 | 49773 |
| CTCN_2774 | 35715 | GTCN_4079 | 49774 |
| CTCN_2775 | 35716 | CTCN_7512 | 49775 |
| GTCN_1494 | 35717 | ATCN_4368 | 49776 |
| ATCN_1672 | 35718 | GTCN_4080 | 49777 |
| ATCN_1673 | 35719 | TTCN_6360 | 49778 |
| TTCN_2320 | 35720 | CTCN_7513 | 49779 |
| ATCN_1674 | 35721 | ATCN_4369 | 49780 |
| CTCN_2776 | 35722 | CTCN_7514 | 49781 |
| TTCN_2321 | 35723 | CTCN_7515 | 49782 |
| TTCN_2322 | 35724 | TTCN_6361 | 49783 |
| CTCN_2777 | 35725 | CTCN_7516 | 49784 |
| CTCN_2778 | 35726 | ATCN_4370 | 49785 |
| CTCN_2779 | 35727 | TTCN_6362 | 49786 |
| ATCN_1675 | 35728 | TTCN_6363 | 49787 |
| GTCN_1495 | 35729 | CTCN_7517 | 49788 |
| TTCN_2323 | 35730 | CTCN_7518 | 49789 |
| CTCN_2780 | 35731 | CTCN_7519 | 49790 |
| GTCN_1496 | 35732 | CTCN_7520 | 49791 |
| CTCN_2781 | 35733 | ATCN_4371 | 49792 |
| GTCN_1497 | 35734 | ATCN_4372 | 49793 |
| CTCN_2782 | 35735 | CTCN_7521 | 49794 |
| TTCN_2324 | 35736 | TTCN_6364 | 49795 |
| TTCN_2325 | 35737 | GTCN_4081 | 49796 |
| TTCN_2326 | 35738 | ATCN_4373 | 49797 |
| TTCN_2327 | 35739 | CTCN_7522 | 49798 |
| GTCN_1498 | 35740 | ATCN_4374 | 49799 |
| ATCN_1676 | 35741 | CTCN_7523 | 49800 |
| CTCN_2783 | 35742 | CTCN_7524 | 49801 |
| CTCN_2784 | 35743 | CTCN_7525 | 49802 |
| CTCN_2785 | 35744 | CTCN_7526 | 49803 |
| CTCN_2786 | 35745 | GTCN_4082 | 49804 |
| TTCN_2328 | 35746 | CTCN_7527 | 49805 |
| ATCN_1677 | 35747 | GTCN_4083 | 49806 |
| TTCN_2329 | 35748 | CTCN_7528 | 49807 |
| TTCN_2330 | 35749 | CTCN_7529 | 49808 |

| | | | |
|---|---|---|---|
| CTCN_2787 | 35750 | GTCN_4084 | 49809 |
| CTCN_2788 | 35751 | GTCN_4085 | 49810 |
| CTCN_2789 | 35752 | CTCN_7530 | 49811 |
| ATCN_1678 | 35753 | TTCN_6365 | 49812 |
| ATCN_1679 | 35754 | TTCN_6366 | 49813 |
| CTCN_2790 | 35755 | GTCN_4086 | 49814 |
| CTCN_2791 | 35756 | CTCN_7531 | 49815 |
| TTCN_2331 | 35757 | TTCN_6367 | 49816 |
| CTCN_2792 | 35758 | CTCN_7532 | 49817 |
| GTCN_1499 | 35759 | GTCN_4087 | 49818 |
| GTCN_1500 | 35760 | GTCN_4088 | 49819 |
| GTCN_1501 | 35761 | CTCN_7533 | 49820 |
| CTCN_2793 | 35762 | CTCN_7534 | 49821 |
| CTCN_2794 | 35763 | CTCN_7535 | 49822 |
| TTCN_2332 | 35764 | CTCN_7536 | 49823 |
| ATCN_1680 | 35765 | ATCN_4375 | 49824 |
| CTCN_2795 | 35766 | TTCN_6368 | 49825 |
| TTCN_2333 | 35767 | CTCN_7537 | 49826 |
| CTCN_2796 | 35768 | GTCN_4089 | 49827 |
| TTCN_2334 | 35769 | TTCN_6369 | 49828 |
| ATCN_1681 | 35770 | TTCN_6370 | 49829 |
| TTCN_2335 | 35771 | CTCN_7538 | 49830 |
| GTCN_1502 | 35772 | TTCN_6371 | 49831 |
| TTCN_2336 | 35773 | CTCN_7539 | 49832 |
| CTCN_2797 | 35774 | CTCN_7540 | 49833 |
| TTCN_2337 | 35775 | CTCN_7541 | 49834 |
| CTCN_2798 | 35776 | TTCN_6372 | 49835 |
| ATCN_1682 | 35777 | CTCN_7542 | 49836 |
| ATCN_1683 | 35778 | GTCN_4090 | 49837 |
| ATCN_1684 | 35779 | ATCN_4376 | 49838 |
| GTCN_1503 | 35780 | ATCN_4377 | 49839 |
| TTCN_2338 | 35781 | TTCN_6373 | 49840 |
| CTCN_2799 | 35782 | CTCN_7543 | 49841 |
| CTCN_2800 | 35783 | CTCN_7544 | 49842 |
| CTCN_2801 | 35784 | GTCN_4091 | 49843 |
| CTCN_2802 | 35785 | CTCN_7545 | 49844 |
| TTCN_2339 | 35786 | CTCN_7546 | 49845 |
| CTCN_2803 | 35787 | CTCN_7547 | 49846 |
| ATCN_1685 | 35788 | CTCN_7548 | 49847 |
| ATCN_1686 | 35789 | CTCN_7549 | 49848 |
| TTCN_2340 | 35790 | TTCN_6374 | 49849 |
| CTCN_2804 | 35791 | TTCN_6375 | 49850 |
| GTCN_1504 | 35792 | ATCN_4378 | 49851 |

FIG. 37 (continued)

| | | | |
|---|---|---|---|
| TTCN_2341 | 35793 | ATCN_4379 | 49852 |
| CTCN_2805 | 35794 | CTCN_7550 | 49853 |
| GTCN_1505 | 35795 | GTCN_4092 | 49854 |
| TTCN_2342 | 35796 | CTCN_7551 | 49855 |
| CTCN_2806 | 35797 | CTCN_7552 | 49856 |
| ATCN_1687 | 35798 | ATCN_4380 | 49857 |
| CTCN_2807 | 35799 | CTCN_7553 | 49858 |
| ATCN_1688 | 35800 | CTCN_7554 | 49859 |
| CTCN_2808 | 35801 | ATCN_4381 | 49860 |
| GTCN_1506 | 35802 | ATCN_4382 | 49861 |
| TTCN_2343 | 35803 | CTCN_7555 | 49862 |
| GTCN_1507 | 35804 | ATCN_4383 | 49863 |
| TTCN_2344 | 35805 | ATCN_4384 | 49864 |
| CTCN_2809 | 35806 | CTCN_7556 | 49865 |
| CTCN_2810 | 35807 | GTCN_4093 | 49866 |
| GTCN_1508 | 35808 | TTCN_6376 | 49867 |
| ATCN_1689 | 35809 | GTCN_4094 | 49868 |
| GTCN_1509 | 35810 | CTCN_7557 | 49869 |
| ATCN_1690 | 35811 | TTCN_6377 | 49870 |
| GTCN_1510 | 35812 | GTCN_4095 | 49871 |
| CTCN_2811 | 35813 | CTCN_7558 | 49872 |
| GTCN_1511 | 35814 | GTCN_4096 | 49873 |
| GTCN_1512 | 35815 | TTCN_6378 | 49874 |
| ATCN_1691 | 35816 | ATCN_4385 | 49875 |
| TTCN_2345 | 35817 | TTCN_6379 | 49876 |
| GTCN_1513 | 35818 | CTCN_7559 | 49877 |
| ATCN_1692 | 35819 | TTCN_6380 | 49878 |
| ATCN_1693 | 35820 | CTCN_7560 | 49879 |
| CTCN_2812 | 35821 | CTCN_7561 | 49880 |
| CTCN_2813 | 35822 | GTCN_4097 | 49881 |
| TTCN_2346 | 35823 | CTCN_7562 | 49882 |
| TTCN_2347 | 35824 | ATCN_4386 | 49883 |
| CTCN_2814 | 35825 | CTCN_7563 | 49884 |
| CTCN_2815 | 35826 | TTCN_6381 | 49885 |
| CTCN_2816 | 35827 | TTCN_6382 | 49886 |
| CTCN_2817 | 35828 | CTCN_7564 | 49887 |
| ATCN_1694 | 35829 | GTCN_4098 | 49888 |
| TTCN_2348 | 35830 | GTCN_4099 | 49889 |
| GTCN_1514 | 35831 | GTCN_4100 | 49890 |
| CTCN_2818 | 35832 | TTCN_6383 | 49891 |
| CTCN_2819 | 35833 | GTCN_4101 | 49892 |
| CTCN_2820 | 35834 | ATCN_4387 | 49893 |
| GTCN_1515 | 35835 | CTCN_7565 | 49894 |

| | | | |
|---|---|---|---|
| CTCN_2821 | 35836 | GTCN_4102 | 49895 |
| ATCN_1695 | 35837 | TTCN_6384 | 49896 |
| CTCN_2822 | 35838 | CTCN_7566 | 49897 |
| ATCN_1696 | 35839 | GTCN_4103 | 49898 |
| ATCN_1697 | 35840 | GTCN_4104 | 49899 |
| TTCN_2349 | 35841 | TTCN_6385 | 49900 |
| ATCN_1698 | 35842 | CTCN_7567 | 49901 |
| TTCN_2350 | 35843 | GTCN_4105 | 49902 |
| ATCN_1699 | 35844 | TTCN_6386 | 49903 |
| ATCN_1700 | 35845 | CTCN_7568 | 49904 |
| ATCN_1701 | 35846 | GTCN_4106 | 49905 |
| TTCN_2351 | 35847 | GTCN_4107 | 49906 |
| TTCN_2352 | 35848 | ATCN_4388 | 49907 |
| GTCN_1516 | 35849 | CTCN_7569 | 49908 |
| GTCN_1517 | 35850 | GTCN_4108 | 49909 |
| TTCN_2353 | 35851 | CTCN_7570 | 49910 |
| TTCN_2354 | 35852 | CTCN_7571 | 49911 |
| GTCN_1518 | 35853 | GTCN_4109 | 49912 |
| TTCN_2355 | 35854 | TTCN_6387 | 49913 |
| TTCN_2356 | 35855 | TTCN_6388 | 49914 |
| GTCN_1519 | 35856 | TTCN_6389 | 49915 |
| TTCN_2357 | 35857 | GTCN_4110 | 49916 |
| TTCN_2358 | 35858 | CTCN_7572 | 49917 |
| GTCN_1520 | 35859 | ATCN_4389 | 49918 |
| TTCN_2359 | 35860 | TTCN_6390 | 49919 |
| TTCN_2360 | 35861 | TTCN_6391 | 49920 |
| TTCN_2361 | 35862 | ATCN_4390 | 49921 |
| CTCN_2823 | 35863 | TTCN_6392 | 49922 |
| CTCN_2824 | 35864 | TTCN_6393 | 49923 |
| CTCN_2825 | 35865 | TTCN_6394 | 49924 |
| CTCN_2826 | 35866 | GTCN_4111 | 49925 |
| TTCN_2362 | 35867 | CTCN_7573 | 49926 |
| TTCN_2363 | 35868 | CTCN_7574 | 49927 |
| TTCN_2364 | 35869 | TTCN_6395 | 49928 |
| ATCN_1702 | 35870 | ATCN_4391 | 49929 |
| GTCN_1521 | 35871 | ATCN_4392 | 49930 |
| CTCN_2827 | 35872 | CTCN_7575 | 49931 |
| CTCN_2828 | 35873 | CTCN_7576 | 49932 |
| ATCN_1703 | 35874 | TTCN_6396 | 49933 |
| ATCN_1704 | 35875 | CTCN_7577 | 49934 |
| ATCN_1705 | 35876 | TTCN_6397 | 49935 |
| CTCN_2829 | 35877 | CTCN_7578 | 49936 |
| TTCN_2365 | 35878 | TTCN_6398 | 49937 |

FIG. 37 (continued)

| | | | |
|---|---|---|---|
| CTCN_2830 | 35879 | CTCN_7579 | 49938 |
| GTCN_1522 | 35880 | ATCN_4393 | 49939 |
| ATCN_1706 | 35881 | ATCN_4394 | 49940 |
| CTCN_2831 | 35882 | GTCN_4112 | 49941 |
| ATCN_1707 | 35883 | TTCN_6399 | 49942 |
| CTCN_2832 | 35884 | CTCN_7580 | 49943 |
| TTCN_2366 | 35885 | CTCN_7581 | 49944 |
| CTCN_2833 | 35886 | CTCN_7582 | 49945 |
| ATCN_1708 | 35887 | GTCN_4113 | 49946 |
| TTCN_2367 | 35888 | ATCN_4395 | 49947 |
| ATCN_1709 | 35889 | ATCN_4396 | 49948 |
| TTCN_2368 | 35890 | ATCN_4397 | 49949 |
| CTCN_2834 | 35891 | ATCN_4398 | 49950 |
| CTCN_2835 | 35892 | ATCN_4399 | 49951 |
| CTCN_2836 | 35893 | TTCN_6400 | 49952 |
| GTCN_1523 | 35894 | CTCN_7583 | 49953 |
| CTCN_2837 | 35895 | ATCN_4400 | 49954 |
| CTCN_2838 | 35896 | ATCN_4401 | 49955 |
| ATCN_1710 | 35897 | CTCN_7584 | 49956 |
| TTCN_2369 | 35898 | CTCN_7585 | 49957 |
| CTCN_2839 | 35899 | CTCN_7586 | 49958 |
| GTCN_1524 | 35900 | GTCN_4114 | 49959 |
| GTCN_1525 | 35901 | GTCN_4115 | 49960 |
| CTCN_2840 | 35902 | CTCN_7587 | 49961 |
| TTCN_2370 | 35903 | CTCN_7588 | 49962 |
| ATCN_1711 | 35904 | GTCN_4116 | 49963 |
| GTCN_1526 | 35905 | CTCN_7589 | 49964 |
| CTCN_2841 | 35906 | ATCN_4402 | 49965 |
| GTCN_1527 | 35907 | CTCN_7590 | 49966 |
| TTCN_2371 | 35908 | CTCN_7591 | 49967 |
| ATCN_1712 | 35909 | CTCN_7592 | 49968 |
| CTCN_2842 | 35910 | CTCN_7593 | 49969 |
| TTCN_2372 | 35911 | GTCN_4117 | 49970 |
| TTCN_2373 | 35912 | CTCN_7594 | 49971 |
| TTCN_2374 | 35913 | CTCN_7595 | 49972 |
| ATCN_1713 | 35914 | TTCN_6401 | 49973 |
| CTCN_2843 | 35915 | GTCN_4118 | 49974 |
| ATCN_1714 | 35916 | ATCN_4403 | 49975 |
| TTCN_2375 | 35917 | CTCN_7596 | 49976 |
| CTCN_2844 | 35918 | CTCN_7597 | 49977 |
| GTCN_1528 | 35919 | GTCN_4119 | 49978 |
| GTCN_1529 | 35920 | CTCN_7598 | 49979 |
| TTCN_2376 | 35921 | ATCN_4404 | 49980 |

| | | | |
|---|---|---|---|
| ATCN_1715 | 35922 | GTCN_4120 | 49981 |
| TTCN_2377 | 35923 | CTCN_7599 | 49982 |
| CTCN_2845 | 35924 | TTCN_6402 | 49983 |
| GTCN_1530 | 35925 | CTCN_7600 | 49984 |
| TTCN_2378 | 35926 | CTCN_7601 | 49985 |
| TTCN_2379 | 35927 | CTCN_7602 | 49986 |
| CTCN_2846 | 35928 | ATCN_4405 | 49987 |
| CTCN_2847 | 35929 | CTCN_7603 | 49988 |
| GTCN_1531 | 35930 | CTCN_7604 | 49989 |
| TTCN_2380 | 35931 | CTCN_7605 | 49990 |
| GTCN_1532 | 35932 | ATCN_4406 | 49991 |
| GTCN_1533 | 35933 | ATCN_4407 | 49992 |
| CTCN_2848 | 35934 | ATCN_4408 | 49993 |
| TTCN_2381 | 35935 | CTCN_7606 | 49994 |
| ATCN_1716 | 35936 | TTCN_6403 | 49995 |
| TTCN_2382 | 35937 | CTCN_7607 | 49996 |
| TTCN_2383 | 35938 | GTCN_4121 | 49997 |
| TTCN_2384 | 35939 | GTCN_4122 | 49998 |
| GTCN_1534 | 35940 | CTCN_7608 | 49999 |
| GTCN_1535 | 35941 | GTCN_4123 | 50000 |
| TTCN_2385 | 35942 | CTCN_7609 | 50001 |
| GTCN_1536 | 35943 | TTCN_6404 | 50002 |
| CTCN_2849 | 35944 | CTCN_7610 | 50003 |
| CTCN_2850 | 35945 | TTCN_6405 | 50004 |
| CTCN_2851 | 35946 | ATCN_4409 | 50005 |
| GTCN_1537 | 35947 | ATCN_4410 | 50006 |
| TTCN_2386 | 35948 | CTCN_7611 | 50007 |
| CTCN_2852 | 35949 | CTCN_7612 | 50008 |
| CTCN_2853 | 35950 | TTCN_6406 | 50009 |
| CTCN_2854 | 35951 | TTCN_6407 | 50010 |
| CTCN_2855 | 35952 | ATCN_4411 | 50011 |
| GTCN_1538 | 35953 | CTCN_7613 | 50012 |
| GTCN_1539 | 35954 | CTCN_7614 | 50013 |
| CTCN_2856 | 35955 | TTCN_6408 | 50014 |
| GTCN_1540 | 35956 | ATCN_4412 | 50015 |
| CTCN_2857 | 35957 | TTCN_6409 | 50016 |
| CTCN_2858 | 35958 | CTCN_7615 | 50017 |
| CTCN_2859 | 35959 | TTCN_6410 | 50018 |
| TTCN_2387 | 35960 | ATCN_4413 | 50019 |
| TTCN_2388 | 35961 | ATCN_4414 | 50020 |
| CTCN_2860 | 35962 | TTCN_6411 | 50021 |
| GTCN_1541 | 35963 | TTCN_6412 | 50022 |
| CTCN_2861 | 35964 | TTCN_6413 | 50023 |

FIG. 37 (continued)

| | | | |
|---|---|---|---|
| CTCN_2862 | 35965 | CTCN_7616 | 50024 |
| CTCN_2863 | 35966 | CTCN_7617 | 50025 |
| CTCN_2864 | 35967 | CTCN_7618 | 50026 |
| CTCN_2865 | 35968 | CTCN_7619 | 50027 |
| ATCN_1717 | 35969 | TTCN_6414 | 50028 |
| CTCN_2866 | 35970 | CTCN_7620 | 50029 |
| TTCN_2389 | 35971 | CTCN_7621 | 50030 |
| GTCN_1542 | 35972 | TTCN_6415 | 50031 |
| GTCN_1543 | 35973 | CTCN_7622 | 50032 |
| TTCN_2390 | 35974 | TTCN_6416 | 50033 |
| ATCN_1718 | 35975 | ATCN_4415 | 50034 |
| TTCN_2391 | 35976 | CTCN_7623 | 50035 |
| CTCN_2867 | 35977 | CTCN_7624 | 50036 |
| GTCN_1544 | 35978 | TTCN_6417 | 50037 |
| CTCN_2868 | 35979 | TTCN_6418 | 50038 |
| TTCN_2392 | 35980 | GTCN_4124 | 50039 |
| TTCN_2393 | 35981 | CTCN_7625 | 50040 |
| TTCN_2394 | 35982 | TTCN_6419 | 50041 |
| TTCN_2395 | 35983 | ATCN_4416 | 50042 |
| GTCN_1545 | 35984 | TTCN_6420 | 50043 |
| TTCN_2396 | 35985 | CTCN_7626 | 50044 |
| CTCN_2869 | 35986 | TTCN_6421 | 50045 |
| CTCN_2870 | 35987 | GTCN_4125 | 50046 |
| GTCN_1546 | 35988 | ATCN_4417 | 50047 |
| TTCN_2397 | 35989 | ATCN_4418 | 50048 |
| CTCN_2871 | 35990 | TTCN_6422 | 50049 |
| GTCN_1547 | 35991 | TTCN_6423 | 50050 |
| TTCN_2398 | 35992 | ATCN_4419 | 50051 |
| TTCN_2399 | 35993 | GTCN_4126 | 50052 |
| ATCN_1719 | 35994 | CTCN_7627 | 50053 |
| CTCN_2872 | 35995 | CTCN_7628 | 50054 |
| GTCN_1548 | 35996 | GTCN_4127 | 50055 |
| GTCN_1549 | 35997 | GTCN_4128 | 50056 |
| TTCN_2400 | 35998 | ATCN_4420 | 50057 |
| TTCN_2401 | 35999 | TTCN_6424 | 50058 |
| CTCN_2873 | 36000 | GTCN_4129 | 50059 |
| CTCN_2874 | 36001 | CTCN_7629 | 50060 |
| CTCN_2875 | 36002 | CTCN_7630 | 50061 |
| CTCN_2876 | 36003 | ATCN_4421 | 50062 |
| ATCN_1720 | 36004 | CTCN_7631 | 50063 |
| ATCN_1721 | 36005 | TTCN_6425 | 50064 |
| TTCN_2402 | 36006 | TTCN_6426 | 50065 |
| CTCN_2877 | 36007 | GTCN_4130 | 50066 |

| | | | |
|---|---|---|---|
| GTCN_1550 | 36008 | ATCN_4422 | 50067 |
| CTCN_2878 | 36009 | TTCN_6427 | 50068 |
| TTCN_2403 | 36010 | TTCN_6428 | 50069 |
| TTCN_2404 | 36011 | TTCN_6429 | 50070 |
| CTCN_2879 | 36012 | CTCN_7632 | 50071 |
| GTCN_1551 | 36013 | CTCN_7633 | 50072 |
| ATCN_1722 | 36014 | TTCN_6430 | 50073 |
| GTCN_1552 | 36015 | ATCN_4423 | 50074 |
| GTCN_1553 | 36016 | TTCN_6431 | 50075 |
| TTCN_2405 | 36017 | GTCN_4131 | 50076 |
| CTCN_2880 | 36018 | ATCN_4424 | 50077 |
| CTCN_2881 | 36019 | CTCN_7634 | 50078 |
| TTCN_2406 | 36020 | TTCN_6432 | 50079 |
| GTCN_1554 | 36021 | ATCN_4425 | 50080 |
| CTCN_2882 | 36022 | ATCN_4426 | 50081 |
| CTCN_2883 | 36023 | TTCN_6433 | 50082 |
| CTCN_2884 | 36024 | TTCN_6434 | 50083 |
| TTCN_2407 | 36025 | ATCN_4427 | 50084 |
| ATCN_1723 | 36026 | CTCN_7635 | 50085 |
| CTCN_2885 | 36027 | TTCN_6435 | 50086 |
| TTCN_2408 | 36028 | CTCN_7636 | 50087 |
| TTCN_2409 | 36029 | CTCN_7637 | 50088 |
| TTCN_2410 | 36030 | CTCN_7638 | 50089 |
| TTCN_2411 | 36031 | TTCN_6436 | 50090 |
| GTCN_1555 | 36032 | CTCN_7639 | 50091 |
| CTCN_2886 | 36033 | CTCN_7640 | 50092 |
| GTCN_1556 | 36034 | TTCN_6437 | 50093 |
| CTCN_2887 | 36035 | TTCN_6438 | 50094 |
| CTCN_2888 | 36036 | CTCN_7641 | 50095 |
| GTCN_1557 | 36037 | CTCN_7642 | 50096 |
| TTCN_2412 | 36038 | CTCN_7643 | 50097 |
| ATCN_1724 | 36039 | ATCN_4428 | 50098 |
| GTCN_1558 | 36040 | GTCN_4132 | 50099 |
| CTCN_2889 | 36041 | ATCN_4429 | 50100 |
| TTCN_2413 | 36042 | ATCN_4430 | 50101 |
| GTCN_1559 | 36043 | CTCN_7644 | 50102 |
| CTCN_2890 | 36044 | ATCN_4431 | 50103 |
| GTCN_1560 | 36045 | ATCN_4432 | 50104 |
| TTCN_2414 | 36046 | GTCN_4133 | 50105 |
| ATCN_1725 | 36047 | CTCN_7645 | 50106 |
| TTCN_2415 | 36048 | GTCN_4134 | 50107 |
| CTCN_2891 | 36049 | ATCN_4433 | 50108 |
| ATCN_1726 | 36050 | ATCN_4434 | 50109 |

FIG. 37 (continued)

| | | | |
|---|---|---|---|
| TTCN_2416 | 36051 | GTCN_4135 | 50110 |
| CTCN_2892 | 36052 | TTCN_6439 | 50111 |
| TTCN_2417 | 36053 | CTCN_7646 | 50112 |
| CTCN_2893 | 36054 | GTCN_4136 | 50113 |
| ATCN_1727 | 36055 | CTCN_7647 | 50114 |
| CTCN_2894 | 36056 | TTCN_6440 | 50115 |
| CTCN_2895 | 36057 | TTCN_6441 | 50116 |
| TTCN_2418 | 36058 | GTCN_4137 | 50117 |
| CTCN_2896 | 36059 | TTCN_6442 | 50118 |
| CTCN_2897 | 36060 | TTCN_6443 | 50119 |
| ATCN_1728 | 36061 | TTCN_6444 | 50120 |
| CTCN_2898 | 36062 | CTCN_7648 | 50121 |
| CTCN_2899 | 36063 | TTCN_6445 | 50122 |
| CTCN_2900 | 36064 | CTCN_7649 | 50123 |
| TTCN_2419 | 36065 | TTCN_6446 | 50124 |
| GTCN_1561 | 36066 | CTCN_7650 | 50125 |
| CTCN_2901 | 36067 | ATCN_4435 | 50126 |
| CTCN_2902 | 36068 | GTCN_4138 | 50127 |
| CTCN_2903 | 36069 | TTCN_6447 | 50128 |
| TTCN_2420 | 36070 | GTCN_4139 | 50129 |
| CTCN_2904 | 36071 | CTCN_7651 | 50130 |
| GTCN_1562 | 36072 | CTCN_7652 | 50131 |
| GTCN_1563 | 36073 | TTCN_6448 | 50132 |
| CTCN_2905 | 36074 | GTCN_4140 | 50133 |
| CTCN_2906 | 36075 | TTCN_6449 | 50134 |
| GTCN_1564 | 36076 | CTCN_7653 | 50135 |
| ATCN_1729 | 36077 | TTCN_6450 | 50136 |
| ATCN_1730 | 36078 | CTCN_7654 | 50137 |
| CTCN_2907 | 36079 | ATCN_4436 | 50138 |
| CTCN_2908 | 36080 | CTCN_7655 | 50139 |
| CTCN_2909 | 36081 | TTCN_6451 | 50140 |
| GTCN_1565 | 36082 | CTCN_7656 | 50141 |
| CTCN_2910 | 36083 | TTCN_6452 | 50142 |
| CTCN_2911 | 36084 | CTCN_7657 | 50143 |
| TTCN_2421 | 36085 | GTCN_4141 | 50144 |
| CTCN_2912 | 36086 | GTCN_4142 | 50145 |
| TTCN_2422 | 36087 | TTCN_6453 | 50146 |
| GTCN_1566 | 36088 | ATCN_4437 | 50147 |
| CTCN_2913 | 36089 | TTCN_6454 | 50148 |
| GTCN_1567 | 36090 | GTCN_4143 | 50149 |
| CTCN_2914 | 36091 | TTCN_6455 | 50150 |
| ATCN_1731 | 36092 | TTCN_6456 | 50151 |
| ATCN_1732 | 36093 | GTCN_4144 | 50152 |
| TTCN_2423 | 36094 | CTCN_7658 | 50153 |
| ATCN_1733 | 36095 | GTCN_4145 | 50154 |
| CTCN_2915 | 36096 | TTCN_6457 | 50155 |
| CTCN_2916 | 36097 | CTCN_7659 | 50156 |
| CTCN_2917 | 36098 | CTCN_7660 | 50157 |
| TTCN_2424 | 36099 | TTCN_6458 | 50158 |
| TTCN_2425 | 36100 | TTCN_6459 | 50159 |
| TTCN_2426 | 36101 | TTCN_6460 | 50160 |
| TTCN_2427 | 36102 | TTCN_6461 | 50161 |
| TTCN_2428 | 36103 | GTCN_4146 | 50162 |
| CTCN_2918 | 36104 | CTCN_7661 | 50163 |
| CTCN_2919 | 36105 | CTCN_7662 | 50164 |
| ATCN_1734 | 36106 | TTCN_6462 | 50165 |
| GTCN_1568 | 36107 | CTCN_7663 | 50166 |
| GTCN_1569 | 36108 | ATCN_4438 | 50167 |
| CTCN_2920 | 36109 | CTCN_7664 | 50168 |
| GTCN_1570 | 36110 | CTCN_7665 | 50169 |
| CTCN_2921 | 36111 | TTCN_6463 | 50170 |
| CTCN_2922 | 36112 | CTCN_7666 | 50171 |
| CTCN_2923 | 36113 | TTCN_6464 | 50172 |
| CTCN_2924 | 36114 | TTCN_6465 | 50173 |
| CTCN_2925 | 36115 | CTCN_7667 | 50174 |
| TTCN_2429 | 36116 | GTCN_4147 | 50175 |
| GTCN_1571 | 36117 | GTCN_4148 | 50176 |
| GTCN_1572 | 36118 | TTCN_6466 | 50177 |
| CTCN_2926 | 36119 | CTCN_7668 | 50178 |
| CTCN_2927 | 36120 | ATCN_4439 | 50179 |
| GTCN_1573 | 36121 | CTCN_7669 | 50180 |
| CTCN_2928 | 36122 | CTCN_7670 | 50181 |
| TTCN_2430 | 36123 | GTCN_4149 | 50182 |
| ATCN_1735 | 36124 | ATCN_4440 | 50183 |
| CTCN_2929 | 36125 | ATCN_4441 | 50184 |
| CTCN_2930 | 36126 | CTCN_7671 | 50185 |
| CTCN_2931 | 36127 | ATCN_4442 | 50186 |
| GTCN_1574 | 36128 | CTCN_7672 | 50187 |
| GTCN_1575 | 36129 | ATCN_4443 | 50188 |
| CTCN_2932 | 36130 | GTCN_4150 | 50189 |
| GTCN_1576 | 36131 | CTCN_7673 | 50190 |
| GTCN_1577 | 36132 | CTCN_7674 | 50191 |
| CTCN_2933 | 36133 | CTCN_7675 | 50192 |
| ATCN_1736 | 36134 | GTCN_4151 | 50193 |
| ATCN_1737 | 36135 | TTCN_6467 | 50194 |
| TTCN_2431 | 36136 | ATCN_4444 | 50195 |

FIG. 37 (continued)

| | | | |
|---|---|---|---|
| TTCN_2432 | 36137 | TTCN_6468 | 50196 |
| CTCN_2934 | 36138 | CTCN_7676 | 50197 |
| TTCN_2433 | 36139 | CTCN_7677 | 50198 |
| ATCN_1738 | 36140 | ATCN_4445 | 50199 |
| GTCN_1578 | 36141 | TTCN_6469 | 50200 |
| CTCN_2935 | 36142 | TTCN_6470 | 50201 |
| TTCN_2434 | 36143 | CTCN_7678 | 50202 |
| CTCN_2936 | 36144 | GTCN_4152 | 50203 |
| TTCN_2435 | 36145 | CTCN_7679 | 50204 |
| CTCN_2937 | 36146 | CTCN_7680 | 50205 |
| CTCN_2938 | 36147 | ATCN_4446 | 50206 |
| CTCN_2939 | 36148 | CTCN_7681 | 50207 |
| TTCN_2436 | 36149 | TTCN_6471 | 50208 |
| TTCN_2437 | 36150 | TTCN_6472 | 50209 |
| CTCN_2940 | 36151 | ATCN_4447 | 50210 |
| TTCN_2438 | 36152 | TTCN_6473 | 50211 |
| CTCN_2941 | 36153 | TTCN_6474 | 50212 |
| GTCN_1579 | 36154 | ATCN_4448 | 50213 |
| CTCN_2942 | 36155 | ATCN_4449 | 50214 |
| CTCN_2943 | 36156 | TTCN_6475 | 50215 |
| GTCN_1580 | 36157 | ATCN_4450 | 50216 |
| CTCN_2944 | 36158 | ATCN_4451 | 50217 |
| GTCN_1581 | 36159 | ATCN_4452 | 50218 |
| CTCN_2945 | 36160 | GTCN_4153 | 50219 |
| ATCN_1739 | 36161 | ATCN_4453 | 50220 |
| ATCN_1740 | 36162 | ATCN_4454 | 50221 |
| CTCN_2946 | 36163 | CTCN_7682 | 50222 |
| TTCN_2439 | 36164 | TTCN_6476 | 50223 |
| GTCN_1582 | 36165 | CTCN_7683 | 50224 |
| GTCN_1583 | 36166 | ATCN_4455 | 50225 |
| TTCN_2440 | 36167 | TTCN_6477 | 50226 |
| CTCN_2947 | 36168 | GTCN_4154 | 50227 |
| TTCN_2441 | 36169 | GTCN_4155 | 50228 |
| TTCN_2442 | 36170 | GTCN_4156 | 50229 |
| GTCN_1584 | 36171 | ATCN_4456 | 50230 |
| TTCN_2443 | 36172 | TTCN_6478 | 50231 |
| ATCN_1741 | 36173 | TTCN_6479 | 50232 |
| CTCN_2948 | 36174 | TTCN_6480 | 50233 |
| CTCN_2949 | 36175 | GTCN_4157 | 50234 |
| TTCN_2444 | 36176 | TTCN_6481 | 50235 |
| ATCN_1742 | 36177 | TTCN_6482 | 50236 |
| CTCN_2950 | 36178 | TTCN_6483 | 50237 |
| CTCN_2951 | 36179 | TTCN_6484 | 50238 |

| | | | |
|---|---|---|---|
| CTCN_2952 | 36180 | TTCN_6485 | 50239 |
| CTCN_2953 | 36181 | TTCN_6486 | 50240 |
| CTCN_2954 | 36182 | CTCN_7684 | 50241 |
| CTCN_2955 | 36183 | GTCN_4158 | 50242 |
| ATCN_1743 | 36184 | GTCN_4159 | 50243 |
| ATCN_1744 | 36185 | ATCN_4457 | 50244 |
| GTCN_1585 | 36186 | ATCN_4458 | 50245 |
| CTCN_2956 | 36187 | ATCN_4459 | 50246 |
| CTCN_2957 | 36188 | CTCN_7685 | 50247 |
| CTCN_2958 | 36189 | CTCN_7686 | 50248 |
| TTCN_2445 | 36190 | CTCN_7687 | 50249 |
| ATCN_1745 | 36191 | GTCN_4160 | 50250 |
| TTCN_2446 | 36192 | CTCN_7688 | 50251 |
| CTCN_2959 | 36193 | CTCN_7689 | 50252 |
| CTCN_2960 | 36194 | CTCN_7690 | 50253 |
| ATCN_1746 | 36195 | CTCN_7691 | 50254 |
| ATCN_1747 | 36196 | ATCN_4460 | 50255 |
| GTCN_1586 | 36197 | ATCN_4461 | 50256 |
| TTCN_2447 | 36198 | CTCN_7692 | 50257 |
| ATCN_1748 | 36199 | TTCN_6487 | 50258 |
| ATCN_1749 | 36200 | TTCN_6488 | 50259 |
| CTCN_2961 | 36201 | ATCN_4462 | 50260 |
| ATCN_1750 | 36202 | CTCN_7693 | 50261 |
| ATCN_1751 | 36203 | TTCN_6489 | 50262 |
| CTCN_2962 | 36204 | ATCN_4463 | 50263 |
| CTCN_2963 | 36205 | GTCN_4161 | 50264 |
| TTCN_2448 | 36206 | CTCN_7694 | 50265 |
| CTCN_2964 | 36207 | ATCN_4464 | 50266 |
| CTCN_2965 | 36208 | GTCN_4162 | 50267 |
| CTCN_2966 | 36209 | ATCN_4465 | 50268 |
| GTCN_1587 | 36210 | GTCN_4163 | 50269 |
| CTCN_2967 | 36211 | CTCN_7695 | 50270 |
| CTCN_2968 | 36212 | ATCN_4466 | 50271 |
| CTCN_2969 | 36213 | ATCN_4467 | 50272 |
| CTCN_2970 | 36214 | ATCN_4468 | 50273 |
| TTCN_2449 | 36215 | GTCN_4164 | 50274 |
| TTCN_2450 | 36216 | TTCN_6490 | 50275 |
| CTCN_2971 | 36217 | ATCN_4469 | 50276 |
| CTCN_2972 | 36218 | CTCN_7696 | 50277 |
| ATCN_1752 | 36219 | TTCN_6491 | 50278 |
| ATCN_1753 | 36220 | ATCN_4470 | 50279 |
| ATCN_1754 | 36221 | CTCN_7697 | 50280 |
| CTCN_2973 | 36222 | GTCN_4165 | 50281 |

FIG. 37 (continued)

| | | | |
|---|---|---|---|
| GTCN_1588 | 36223 | TTCN_6492 | 50282 |
| TTCN_2451 | 36224 | CTCN_7698 | 50283 |
| TTCN_2452 | 36225 | CTCN_7699 | 50284 |
| ATCN_1755 | 36226 | CTCN_7700 | 50285 |
| CTCN_2974 | 36227 | CTCN_7701 | 50286 |
| GTCN_1589 | 36228 | CTCN_7702 | 50287 |
| TTCN_2453 | 36229 | ATCN_4471 | 50288 |
| CTCN_2975 | 36230 | TTCN_6493 | 50289 |
| GTCN_1590 | 36231 | TTCN_6494 | 50290 |
| CTCN_2976 | 36232 | GTCN_4166 | 50291 |
| CTCN_2977 | 36233 | TTCN_6495 | 50292 |
| GTCN_1591 | 36234 | GTCN_4167 | 50293 |
| CTCN_2978 | 36235 | ATCN_4472 | 50294 |
| CTCN_2979 | 36236 | CTCN_7703 | 50295 |
| CTCN_2980 | 36237 | CTCN_7704 | 50296 |
| CTCN_2981 | 36238 | CTCN_7705 | 50297 |
| TTCN_2454 | 36239 | CTCN_7706 | 50298 |
| TTCN_2455 | 36240 | CTCN_7707 | 50299 |
| CTCN_2982 | 36241 | GTCN_4168 | 50300 |
| CTCN_2983 | 36242 | TTCN_6496 | 50301 |
| CTCN_2984 | 36243 | ATCN_4473 | 50302 |
| GTCN_1592 | 36244 | GTCN_4169 | 50303 |
| TTCN_2456 | 36245 | TTCN_6497 | 50304 |
| GTCN_1593 | 36246 | CTCN_7708 | 50305 |
| TTCN_2457 | 36247 | GTCN_4170 | 50306 |
| TTCN_2458 | 36248 | CTCN_7709 | 50307 |
| CTCN_2985 | 36249 | CTCN_7710 | 50308 |
| CTCN_2986 | 36250 | CTCN_7711 | 50309 |
| CTCN_2987 | 36251 | ATCN_4474 | 50310 |
| TTCN_2459 | 36252 | CTCN_7712 | 50311 |
| TTCN_2460 | 36253 | GTCN_4171 | 50312 |
| CTCN_2988 | 36254 | TTCN_6498 | 50313 |
| CTCN_2989 | 36255 | CTCN_7713 | 50314 |
| CTCN_2990 | 36256 | ATCN_4475 | 50315 |
| ATCN_1756 | 36257 | ATCN_4476 | 50316 |
| TTCN_2461 | 36258 | TTCN_6499 | 50317 |
| TTCN_2462 | 36259 | TTCN_6500 | 50318 |
| TTCN_2463 | 36260 | ATCN_4477 | 50319 |
| CTCN_2991 | 36261 | TTCN_6501 | 50320 |
| CTCN_2992 | 36262 | CTCN_7714 | 50321 |
| TTCN_2464 | 36263 | CTCN_7715 | 50322 |
| CTCN_2993 | 36264 | CTCN_7716 | 50323 |
| CTCN_2994 | 36265 | GTCN_4172 | 50324 |

| | | | |
|---|---|---|---|
| TTCN_2465 | 36266 | CTCN_7717 | 50325 |
| GTCN_1594 | 36267 | GTCN_4173 | 50326 |
| CTCN_2995 | 36268 | CTCN_7718 | 50327 |
| ATCN_1757 | 36269 | CTCN_7719 | 50328 |
| ATCN_1758 | 36270 | GTCN_4174 | 50329 |
| CTCN_2996 | 36271 | CTCN_7720 | 50330 |
| ATCN_1759 | 36272 | TTCN_6502 | 50331 |
| GTCN_1595 | 36273 | GTCN_4175 | 50332 |
| GTCN_1596 | 36274 | CTCN_7721 | 50333 |
| CTCN_2997 | 36275 | CTCN_7722 | 50334 |
| ATCN_1760 | 36276 | GTCN_4176 | 50335 |
| CTCN_2998 | 36277 | CTCN_7723 | 50336 |
| CTCN_2999 | 36278 | CTCN_7724 | 50337 |
| CTCN_3000 | 36279 | CTCN_7725 | 50338 |
| GTCN_1597 | 36280 | TTCN_6503 | 50339 |
| CTCN_3001 | 36281 | TTCN_6504 | 50340 |
| ATCN_1761 | 36282 | CTCN_7726 | 50341 |
| GTCN_1598 | 36283 | GTCN_4177 | 50342 |
| CTCN_3002 | 36284 | GTCN_4178 | 50343 |
| TTCN_2466 | 36285 | TTCN_6505 | 50344 |
| ATCN_1762 | 36286 | CTCN_7727 | 50345 |
| CTCN_3003 | 36287 | GTCN_4179 | 50346 |
| TTCN_2467 | 36288 | GTCN_4180 | 50347 |
| ATCN_1763 | 36289 | ATCN_4478 | 50348 |
| ATCN_1764 | 36290 | TTCN_6506 | 50349 |
| ATCN_1765 | 36291 | ATCN_4479 | 50350 |
| ATCN_1766 | 36292 | GTCN_4181 | 50351 |
| TTCN_2468 | 36293 | CTCN_7728 | 50352 |
| ATCN_1767 | 36294 | CTCN_7729 | 50353 |
| TTCN_2469 | 36295 | TTCN_6507 | 50354 |
| CTCN_3004 | 36296 | CTCN_7730 | 50355 |
| CTCN_3005 | 36297 | TTCN_6508 | 50356 |
| CTCN_3006 | 36298 | CTCN_7731 | 50357 |
| ATCN_1768 | 36299 | CTCN_7732 | 50358 |
| ATCN_1769 | 36300 | CTCN_7733 | 50359 |
| ATCN_1770 | 36301 | TTCN_6509 | 50360 |
| ATCN_1771 | 36302 | CTCN_7734 | 50361 |
| GTCN_1599 | 36303 | CTCN_7735 | 50362 |
| CTCN_3007 | 36304 | CTCN_7736 | 50363 |
| TTCN_2470 | 36305 | GTCN_4182 | 50364 |
| GTCN_1600 | 36306 | TTCN_6510 | 50365 |
| CTCN_3008 | 36307 | CTCN_7737 | 50366 |
| GTCN_1601 | 36308 | TTCN_6511 | 50367 |

FIG. 37 (continued)

| | | | |
|---|---|---|---|
| CTCN_3009 | 36309 | GTCN_4183 | 50368 |
| GTCN_1602 | 36310 | CTCN_7738 | 50369 |
| CTCN_3010 | 36311 | GTCN_4184 | 50370 |
| ATCN_1772 | 36312 | TTCN_6512 | 50371 |
| GTCN_1603 | 36313 | GTCN_4185 | 50372 |
| CTCN_3011 | 36314 | CTCN_7739 | 50373 |
| ATCN_1773 | 36315 | TTCN_6513 | 50374 |
| CTCN_3012 | 36316 | TTCN_6514 | 50375 |
| CTCN_3013 | 36317 | GTCN_4186 | 50376 |
| CTCN_3014 | 36318 | ATCN_4480 | 50377 |
| CTCN_3015 | 36319 | CTCN_7740 | 50378 |
| CTCN_3016 | 36320 | GTCN_4187 | 50379 |
| ATCN_1774 | 36321 | CTCN_7741 | 50380 |
| TTCN_2471 | 36322 | ATCN_4481 | 50381 |
| CTCN_3017 | 36323 | ATCN_4482 | 50382 |
| CTCN_3018 | 36324 | ATCN_4483 | 50383 |
| GTCN_1604 | 36325 | ATCN_4484 | 50384 |
| ATCN_1775 | 36326 | ATCN_4485 | 50385 |
| TTCN_2472 | 36327 | TTCN_6515 | 50386 |
| GTCN_1605 | 36328 | GTCN_4188 | 50387 |
| CTCN_3019 | 36329 | TTCN_6516 | 50388 |
| CTCN_3020 | 36330 | TTCN_6517 | 50389 |
| ATCN_1776 | 36331 | TTCN_6518 | 50390 |
| TTCN_2473 | 36332 | ATCN_4486 | 50391 |
| CTCN_3021 | 36333 | TTCN_6519 | 50392 |
| GTCN_1606 | 36334 | TTCN_6520 | 50393 |
| GTCN_1607 | 36335 | CTCN_7742 | 50394 |
| CTCN_3022 | 36336 | CTCN_7743 | 50395 |
| CTCN_3023 | 36337 | CTCN_7744 | 50396 |
| TTCN_2474 | 36338 | CTCN_7745 | 50397 |
| ATCN_1777 | 36339 | GTCN_4189 | 50398 |
| GTCN_1608 | 36340 | CTCN_7746 | 50399 |
| GTCN_1609 | 36341 | TTCN_6521 | 50400 |
| ATCN_1778 | 36342 | CTCN_7747 | 50401 |
| TTCN_2475 | 36343 | CTCN_7748 | 50402 |
| GTCN_1610 | 36344 | CTCN_7749 | 50403 |
| GTCN_1611 | 36345 | CTCN_7750 | 50404 |
| CTCN_3024 | 36346 | GTCN_4190 | 50405 |
| ATCN_1779 | 36347 | TTCN_6522 | 50406 |
| CTCN_3025 | 36348 | CTCN_7751 | 50407 |
| TTCN_2476 | 36349 | CTCN_7752 | 50408 |
| CTCN_3026 | 36350 | TTCN_6523 | 50409 |
| TTCN_2477 | 36351 | TTCN_6524 | 50410 |

| | | | |
|---|---|---|---|
| ATCN_1780 | 36352 | GTCN_4191 | 50411 |
| TTCN_2478 | 36353 | GTCN_4192 | 50412 |
| TTCN_2479 | 36354 | GTCN_4193 | 50413 |
| CTCN_3027 | 36355 | ATCN_4487 | 50414 |
| ATCN_1781 | 36356 | CTCN_7753 | 50415 |
| TTCN_2480 | 36357 | ATCN_4488 | 50416 |
| ATCN_1782 | 36358 | ATCN_4489 | 50417 |
| TTCN_2481 | 36359 | ATCN_4490 | 50418 |
| CTCN_3028 | 36360 | TTCN_6525 | 50419 |
| CTCN_3029 | 36361 | ATCN_4491 | 50420 |
| TTCN_2482 | 36362 | TTCN_6526 | 50421 |
| TTCN_2483 | 36363 | CTCN_7754 | 50422 |
| GTCN_1612 | 36364 | GTCN_4194 | 50423 |
| CTCN_3030 | 36365 | ATCN_4492 | 50424 |
| ATCN_1783 | 36366 | TTCN_6527 | 50425 |
| CTCN_3031 | 36367 | CTCN_7755 | 50426 |
| GTCN_1613 | 36368 | CTCN_7756 | 50427 |
| GTCN_1614 | 36369 | TTCN_6528 | 50428 |
| GTCN_1615 | 36370 | CTCN_7757 | 50429 |
| TTCN_2484 | 36371 | CTCN_7758 | 50430 |
| CTCN_3032 | 36372 | ATCN_4493 | 50431 |
| CTCN_3033 | 36373 | TTCN_6529 | 50432 |
| CTCN_3034 | 36374 | GTCN_4195 | 50433 |
| TTCN_2485 | 36375 | GTCN_4196 | 50434 |
| ATCN_1784 | 36376 | CTCN_7759 | 50435 |
| ATCN_1785 | 36377 | CTCN_7760 | 50436 |
| CTCN_3035 | 36378 | GTCN_4197 | 50437 |
| CTCN_3036 | 36379 | CTCN_7761 | 50438 |
| ATCN_1786 | 36380 | GTCN_4198 | 50439 |
| ATCN_1787 | 36381 | GTCN_4199 | 50440 |
| GTCN_1616 | 36382 | CTCN_7762 | 50441 |
| ATCN_1788 | 36383 | TTCN_6530 | 50442 |
| TTCN_2486 | 36384 | TTCN_6531 | 50443 |
| TTCN_2487 | 36385 | CTCN_7763 | 50444 |
| TTCN_2488 | 36386 | CTCN_7764 | 50445 |
| TTCN_2489 | 36387 | CTCN_7765 | 50446 |
| TTCN_2490 | 36388 | CTCN_7766 | 50447 |
| ATCN_1789 | 36389 | GTCN_4200 | 50448 |
| ATCN_1790 | 36390 | CTCN_7767 | 50449 |
| ATCN_1791 | 36391 | ATCN_4494 | 50450 |
| TTCN_2491 | 36392 | ATCN_4495 | 50451 |
| ATCN_1792 | 36393 | TTCN_6532 | 50452 |
| ATCN_1793 | 36394 | CTCN_7768 | 50453 |

FIG. 37 (continued)

| | | | | | | | |
|---|---|---|---|---|---|---|---|
| CTCN_3037 | 36395 | CTCN_7769 | 50454 | CTCN_3064 | 36438 | CTCN_7784 | 50497 |
| CTCN_3038 | 36396 | ATCN_4496 | 50455 | TTCN_2499 | 36439 | GTCN_4208 | 50498 |
| CTCN_3039 | 36397 | ATCN_4497 | 50456 | ATCN_1799 | 36440 | TTCN_6544 | 50499 |
| TTCN_2492 | 36398 | TTCN_6533 | 50457 | CTCN_3065 | 36441 | TTCN_6545 | 50500 |
| ATCN_1794 | 36399 | GTCN_4201 | 50458 | TTCN_2500 | 36442 | GTCN_4209 | 50501 |
| CTCN_3040 | 36400 | TTCN_6534 | 50459 | GTCN_1621 | 36443 | CTCN_7785 | 50502 |
| CTCN_3041 | 36401 | TTCN_6535 | 50460 | GTCN_1622 | 36444 | CTCN_7786 | 50503 |
| ATCN_1795 | 36402 | CTCN_7770 | 50461 | GTCN_1623 | 36445 | TTCN_6546 | 50504 |
| CTCN_3042 | 36403 | TTCN_6536 | 50462 | GTCN_1624 | 36446 | CTCN_7787 | 50505 |
| CTCN_3043 | 36404 | TTCN_6537 | 50463 | TTCN_2501 | 36447 | GTCN_4210 | 50506 |
| TTCN_2493 | 36405 | GTCN_4202 | 50464 | TTCN_2502 | 36448 | CTCN_7788 | 50507 |
| GTCN_1617 | 36406 | CTCN_7771 | 50465 | ATCN_1800 | 36449 | CTCN_7789 | 50508 |
| CTCN_3044 | 36407 | CTCN_7772 | 50466 | TTCN_2503 | 36450 | ATCN_4506 | 50509 |
| TTCN_2494 | 36408 | TTCN_6538 | 50467 | CTCN_3066 | 36451 | ATCN_4507 | 50510 |
| CTCN_3045 | 36409 | GTCN_4203 | 50468 | TTCN_2504 | 36452 | TTCN_6547 | 50511 |
| ATCN_1796 | 36410 | TTCN_6539 | 50469 | GTCN_1625 | 36453 | ATCN_4508 | 50512 |
| CTCN_3046 | 36411 | TTCN_6540 | 50470 | ATCN_1801 | 36454 | CTCN_7790 | 50513 |
| CTCN_3047 | 36412 | ATCN_4498 | 50471 | TTCN_2505 | 36455 | CTCN_7791 | 50514 |
| CTCN_3048 | 36413 | GTCN_4204 | 50472 | ATCN_1802 | 36456 | TTCN_6548 | 50515 |
| CTCN_3049 | 36414 | ATCN_4499 | 50473 | TTCN_2506 | 36457 | TTCN_6549 | 50516 |
| TTCN_2495 | 36415 | ATCN_4500 | 50474 | TTCN_2507 | 36458 | CTCN_7792 | 50517 |
| ATCN_1797 | 36416 | GTCN_4205 | 50475 | ATCN_1803 | 36459 | CTCN_7793 | 50518 |
| TTCN_2496 | 36417 | ATCN_4501 | 50476 | TTCN_2508 | 36460 | ATCN_4509 | 50519 |
| CTCN_3050 | 36418 | CTCN_7773 | 50477 | GTCN_1626 | 36461 | ATCN_4510 | 50520 |
| CTCN_3051 | 36419 | GTCN_4206 | 50478 | ATCN_1804 | 36462 | GTCN_4211 | 50521 |
| CTCN_3052 | 36420 | TTCN_6541 | 50479 | GTCN_1627 | 36463 | ATCN_4511 | 50522 |
| CTCN_3053 | 36421 | ATCN_4502 | 50480 | GTCN_1628 | 36464 | ATCN_4512 | 50523 |
| CTCN_3054 | 36422 | ATCN_4503 | 50481 | CTCN_3067 | 36465 | CTCN_7794 | 50524 |
| CTCN_3055 | 36423 | GTCN_4207 | 50482 | ATCN_1805 | 36466 | GTCN_4212 | 50525 |
| CTCN_3056 | 36424 | TTCN_6542 | 50483 | TTCN_2509 | 36467 | CTCN_7795 | 50526 |
| CTCN_3057 | 36425 | TTCN_6543 | 50484 | ATCN_1806 | 36468 | CTCN_7796 | 50527 |
| ATCN_1798 | 36426 | ATCN_4504 | 50485 | GTCN_1629 | 36469 | GTCN_4213 | 50528 |
| CTCN_3058 | 36427 | CTCN_7774 | 50486 | ATCN_1807 | 36470 | GTCN_4214 | 50529 |
| GTCN_1618 | 36428 | CTCN_7775 | 50487 | TTCN_2510 | 36471 | CTCN_7797 | 50530 |
| GTCN_1619 | 36429 | CTCN_7776 | 50488 | TTCN_2511 | 36472 | CTCN_7798 | 50531 |
| CTCN_3059 | 36430 | CTCN_7777 | 50489 | CTCN_3068 | 36473 | CTCN_7799 | 50532 |
| TTCN_2497 | 36431 | CTCN_7778 | 50490 | ATCN_1808 | 36474 | TTCN_6550 | 50533 |
| CTCN_3060 | 36432 | CTCN_7779 | 50491 | TTCN_2512 | 36475 | CTCN_7800 | 50534 |
| CTCN_3061 | 36433 | ATCN_4505 | 50492 | TTCN_2513 | 36476 | CTCN_7801 | 50535 |
| CTCN_3062 | 36434 | CTCN_7780 | 50493 | ATCN_1809 | 36477 | TTCN_6551 | 50536 |
| TTCN_2498 | 36435 | CTCN_7781 | 50494 | TTCN_2514 | 36478 | CTCN_7802 | 50537 |
| GTCN_1620 | 36436 | CTCN_7782 | 50495 | TTCN_2515 | 36479 | CTCN_7803 | 50538 |
| CTCN_3063 | 36437 | CTCN_7783 | 50496 | TTCN_2516 | 36480 | ATCN_4513 | 50539 |

FIG. 37 (continued)

| | | | |
|---|---|---|---|
| ATCN_1810 | 36481 | GTCN_4215 | 50540 |
| TTCN_2517 | 36482 | TTCN_6552 | 50541 |
| TTCN_2518 | 36483 | TTCN_6553 | 50542 |
| TTCN_2519 | 36484 | CTCN_7804 | 50543 |
| CTCN_3069 | 36485 | CTCN_7805 | 50544 |
| ATCN_1811 | 36486 | CTCN_7806 | 50545 |
| ATCN_1812 | 36487 | GTCN_4216 | 50546 |
| CTCN_3070 | 36488 | TTCN_6554 | 50547 |
| TTCN_2520 | 36489 | TTCN_6555 | 50548 |
| TTCN_2521 | 36490 | GTCN_4217 | 50549 |
| ATCN_1813 | 36491 | TTCN_6556 | 50550 |
| CTCN_3071 | 36492 | GTCN_4218 | 50551 |
| TTCN_2522 | 36493 | CTCN_7807 | 50552 |
| CTCN_3072 | 36494 | GTCN_4219 | 50553 |
| CTCN_3073 | 36495 | CTCN_7808 | 50554 |
| TTCN_2523 | 36496 | ATCN_4514 | 50555 |
| CTCN_3074 | 36497 | TTCN_6557 | 50556 |
| CTCN_3075 | 36498 | TTCN_6558 | 50557 |
| TTCN_2524 | 36499 | CTCN_7809 | 50558 |
| GTCN_1630 | 36500 | GTCN_4220 | 50559 |
| CTCN_3076 | 36501 | GTCN_4221 | 50560 |
| CTCN_3077 | 36502 | CTCN_7810 | 50561 |
| GTCN_1631 | 36503 | ATCN_4515 | 50562 |
| TTCN_2525 | 36504 | TTCN_6559 | 50563 |
| ATCN_1814 | 36505 | TTCN_6560 | 50564 |
| GTCN_1632 | 36506 | CTCN_7811 | 50565 |
| TTCN_2526 | 36507 | TTCN_6561 | 50566 |
| TTCN_2527 | 36508 | CTCN_7812 | 50567 |
| GTCN_1633 | 36509 | GTCN_4222 | 50568 |
| TTCN_2528 | 36510 | CTCN_7813 | 50569 |
| TTCN_2529 | 36511 | TTCN_6562 | 50570 |
| ATCN_1815 | 36512 | GTCN_4223 | 50571 |
| GTCN_1634 | 36513 | GTCN_4224 | 50572 |
| TTCN_2530 | 36514 | CTCN_7814 | 50573 |
| TTCN_2531 | 36515 | TTCN_6563 | 50574 |
| TTCN_2532 | 36516 | TTCN_6564 | 50575 |
| TTCN_2533 | 36517 | CTCN_7815 | 50576 |
| ATCN_1816 | 36518 | TTCN_6565 | 50577 |
| ATCN_1817 | 36519 | CTCN_7816 | 50578 |
| TTCN_2534 | 36520 | CTCN_7817 | 50579 |
| ATCN_1818 | 36521 | GTCN_4225 | 50580 |
| TTCN_2535 | 36522 | ATCN_4516 | 50581 |
| ATCN_1819 | 36523 | CTCN_7818 | 50582 |

| | | | |
|---|---|---|---|
| GTCN_1635 | 36524 | ATCN_4517 | 50583 |
| TTCN_2536 | 36525 | CTCN_7819 | 50584 |
| CTCN_3078 | 36526 | GTCN_4226 | 50585 |
| GTCN_1636 | 36527 | GTCN_4227 | 50586 |
| TTCN_2537 | 36528 | CTCN_7820 | 50587 |
| ATCN_1820 | 36529 | TTCN_6566 | 50588 |
| GTCN_1637 | 36530 | CTCN_7821 | 50589 |
| ATCN_1821 | 36531 | CTCN_7822 | 50590 |
| GTCN_1638 | 36532 | TTCN_6567 | 50591 |
| GTCN_1639 | 36533 | GTCN_4228 | 50592 |
| CTCN_3079 | 36534 | CTCN_7823 | 50593 |
| TTCN_2538 | 36535 | TTCN_6568 | 50594 |
| CTCN_3080 | 36536 | TTCN_6569 | 50595 |
| TTCN_2539 | 36537 | CTCN_7824 | 50596 |
| TTCN_2540 | 36538 | TTCN_6570 | 50597 |
| ATCN_1822 | 36539 | TTCN_6571 | 50598 |
| GTCN_1640 | 36540 | ATCN_4518 | 50599 |
| TTCN_2541 | 36541 | TTCN_6572 | 50600 |
| TTCN_2542 | 36542 | TTCN_6573 | 50601 |
| TTCN_2543 | 36543 | GTCN_4229 | 50602 |
| ATCN_1823 | 36544 | TTCN_6574 | 50603 |
| GTCN_1641 | 36545 | CTCN_7825 | 50604 |
| GTCN_1642 | 36546 | GTCN_4230 | 50605 |
| ATCN_1824 | 36547 | GTCN_4231 | 50606 |
| TTCN_2544 | 36548 | GTCN_4232 | 50607 |
| GTCN_1643 | 36549 | CTCN_7826 | 50608 |
| TTCN_2545 | 36550 | ATCN_4519 | 50609 |
| TTCN_2546 | 36551 | ATCN_4520 | 50610 |
| ATCN_1825 | 36552 | GTCN_4233 | 50611 |
| CTCN_3081 | 36553 | ATCN_4521 | 50612 |
| CTCN_3082 | 36554 | ATCN_4522 | 50613 |
| TTCN_2547 | 36555 | ATCN_4523 | 50614 |
| GTCN_1644 | 36556 | TTCN_6575 | 50615 |
| TTCN_2548 | 36557 | GTCN_4234 | 50616 |
| ATCN_1826 | 36558 | GTCN_4235 | 50617 |
| CTCN_3083 | 36559 | CTCN_7827 | 50618 |
| GTCN_1645 | 36560 | CTCN_7828 | 50619 |
| GTCN_1646 | 36561 | ATCN_4524 | 50620 |
| GTCN_1647 | 36562 | ATCN_4525 | 50621 |
| CTCN_3084 | 36563 | GTCN_4236 | 50622 |
| TTCN_2549 | 36564 | CTCN_7829 | 50623 |
| GTCN_1648 | 36565 | GTCN_4237 | 50624 |
| TTCN_2550 | 36566 | CTCN_7830 | 50625 |

FIG. 37 (continued)

| | | | |
|---|---|---|---|
| TTCN_2551 | 36567 | TTCN_6576 | 50626 |
| TTCN_2552 | 36568 | TTCN_6577 | 50627 |
| ATCN_1827 | 36569 | TTCN_6578 | 50628 |
| TTCN_2553 | 36570 | ATCN_4526 | 50629 |
| TTCN_2554 | 36571 | GTCN_4238 | 50630 |
| CTCN_3085 | 36572 | CTCN_7831 | 50631 |
| TTCN_2555 | 36573 | GTCN_4239 | 50632 |
| ATCN_1828 | 36574 | TTCN_6579 | 50633 |
| CTCN_3086 | 36575 | TTCN_6580 | 50634 |
| GTCN_1649 | 36576 | CTCN_7832 | 50635 |
| ATCN_1829 | 36577 | TTCN_6581 | 50636 |
| ATCN_1830 | 36578 | GTCN_4240 | 50637 |
| CTCN_3087 | 36579 | GTCN_4241 | 50638 |
| GTCN_1650 | 36580 | TTCN_6582 | 50639 |
| CTCN_3088 | 36581 | GTCN_4242 | 50640 |
| TTCN_2556 | 36582 | CTCN_7833 | 50641 |
| GTCN_1651 | 36583 | CTCN_7834 | 50642 |
| CTCN_3089 | 36584 | CTCN_7835 | 50643 |
| GTCN_1652 | 36585 | ATCN_4527 | 50644 |
| TTCN_2557 | 36586 | ATCN_4528 | 50645 |
| TTCN_2558 | 36587 | ATCN_4529 | 50646 |
| ATCN_1831 | 36588 | ATCN_4530 | 50647 |
| TTCN_2559 | 36589 | CTCN_7836 | 50648 |
| CTCN_3090 | 36590 | CTCN_7837 | 50649 |
| CTCN_3091 | 36591 | CTCN_7838 | 50650 |
| CTCN_3092 | 36592 | ATCN_4531 | 50651 |
| ATCN_1832 | 36593 | TTCN_6583 | 50652 |
| ATCN_1833 | 36594 | TTCN_6584 | 50653 |
| ATCN_1834 | 36595 | GTCN_4243 | 50654 |
| ATCN_1835 | 36596 | TTCN_6585 | 50655 |
| CTCN_3093 | 36597 | GTCN_4244 | 50656 |
| TTCN_2560 | 36598 | CTCN_7839 | 50657 |
| CTCN_3094 | 36599 | GTCN_4245 | 50658 |
| GTCN_1653 | 36600 | TTCN_6586 | 50659 |
| TTCN_2561 | 36601 | ATCN_4532 | 50660 |
| GTCN_1654 | 36602 | ATCN_4533 | 50661 |
| CTCN_3095 | 36603 | TTCN_6587 | 50662 |
| CTCN_3096 | 36604 | ATCN_4534 | 50663 |
| ATCN_1836 | 36605 | GTCN_4246 | 50664 |
| CTCN_3097 | 36606 | CTCN_7840 | 50665 |
| CTCN_3098 | 36607 | GTCN_4247 | 50666 |
| CTCN_3099 | 36608 | TTCN_6588 | 50667 |
| TTCN_2562 | 36609 | ATCN_4535 | 50668 |

| | | | |
|---|---|---|---|
| ATCN_1837 | 36610 | ATCN_4536 | 50669 |
| TTCN_2563 | 36611 | CTCN_7841 | 50670 |
| CTCN_3100 | 36612 | ATCN_4537 | 50671 |
| CTCN_3101 | 36613 | GTCN_4248 | 50672 |
| ATCN_1838 | 36614 | CTCN_7842 | 50673 |
| CTCN_3102 | 36615 | CTCN_7843 | 50674 |
| CTCN_3103 | 36616 | TTCN_6589 | 50675 |
| ATCN_1839 | 36617 | TTCN_6590 | 50676 |
| ATCN_1840 | 36618 | CTCN_7844 | 50677 |
| CTCN_3104 | 36619 | GTCN_4249 | 50678 |
| CTCN_3105 | 36620 | TTCN_6591 | 50679 |
| TTCN_2564 | 36621 | CTCN_7845 | 50680 |
| CTCN_3106 | 36622 | TTCN_6592 | 50681 |
| GTCN_1655 | 36623 | ATCN_4538 | 50682 |
| CTCN_3107 | 36624 | TTCN_6593 | 50683 |
| TTCN_2565 | 36625 | GTCN_4250 | 50684 |
| TTCN_2566 | 36626 | TTCN_6594 | 50685 |
| ATCN_1841 | 36627 | GTCN_4251 | 50686 |
| TTCN_2567 | 36628 | TTCN_6595 | 50687 |
| GTCN_1656 | 36629 | GTCN_4252 | 50688 |
| CTCN_3108 | 36630 | CTCN_7846 | 50689 |
| TTCN_2568 | 36631 | TTCN_6596 | 50690 |
| TTCN_2569 | 36632 | TTCN_6597 | 50691 |
| ATCN_1842 | 36633 | TTCN_6598 | 50692 |
| CTCN_3109 | 36634 | CTCN_7847 | 50693 |
| GTCN_1657 | 36635 | ATCN_4539 | 50694 |
| TTCN_2570 | 36636 | CTCN_7848 | 50695 |
| TTCN_2571 | 36637 | CTCN_7849 | 50696 |
| CTCN_3110 | 36638 | ATCN_4540 | 50697 |
| CTCN_3111 | 36639 | ATCN_4541 | 50698 |
| ATCN_1843 | 36640 | CTCN_7850 | 50699 |
| GTCN_1658 | 36641 | GTCN_4253 | 50700 |
| CTCN_3112 | 36642 | CTCN_7851 | 50701 |
| GTCN_1659 | 36643 | TTCN_6599 | 50702 |
| ATCN_1844 | 36644 | GTCN_4254 | 50703 |
| ATCN_1845 | 36645 | GTCN_4255 | 50704 |
| CTCN_3113 | 36646 | TTCN_6600 | 50705 |
| GTCN_1660 | 36647 | ATCN_4542 | 50706 |
| CTCN_3114 | 36648 | CTCN_7852 | 50707 |
| TTCN_2572 | 36649 | ATCN_4543 | 50708 |
| ATCN_1846 | 36650 | CTCN_7853 | 50709 |
| GTCN_1661 | 36651 | CTCN_7854 | 50710 |
| CTCN_3115 | 36652 | CTCN_7855 | 50711 |

FIG. 37 (continued)

| | | | | | | | |
|---|---|---|---|---|---|---|---|
| CTCN_3116 | 36653 | TTCN_6601 | 50712 | TTCN_2583 | 36696 | CTCN_7880 | 50755 |
| GTCN_1662 | 36654 | ATCN_4544 | 50713 | CTCN_3129 | 36697 | CTCN_7881 | 50756 |
| CTCN_3117 | 36655 | TTCN_6602 | 50714 | ATCN_1854 | 36698 | CTCN_7882 | 50757 |
| ATCN_1847 | 36656 | CTCN_7856 | 50715 | GTCN_1675 | 36699 | CTCN_7883 | 50758 |
| GTCN_1663 | 36657 | ATCN_4545 | 50716 | CTCN_3130 | 36700 | CTCN_7884 | 50759 |
| GTCN_1664 | 36658 | CTCN_7857 | 50717 | CTCN_3131 | 36701 | CTCN_7885 | 50760 |
| CTCN_3118 | 36659 | TTCN_6603 | 50718 | ATCN_1855 | 36702 | CTCN_7886 | 50761 |
| GTCN_1665 | 36660 | CTCN_7858 | 50719 | ATCN_1856 | 36703 | CTCN_7887 | 50762 |
| ATCN_1848 | 36661 | ATCN_4546 | 50720 | TTCN_2584 | 36704 | CTCN_7888 | 50763 |
| ATCN_1849 | 36662 | ATCN_4547 | 50721 | CTCN_3132 | 36705 | CTCN_7889 | 50764 |
| CTCN_3119 | 36663 | TTCN_6604 | 50722 | ATCN_1857 | 36706 | CTCN_7890 | 50765 |
| ATCN_1850 | 36664 | TTCN_6605 | 50723 | TTCN_2585 | 36707 | CTCN_7891 | 50766 |
| CTCN_3120 | 36665 | CTCN_7859 | 50724 | CTCN_3133 | 36708 | CTCN_7892 | 50767 |
| GTCN_1666 | 36666 | GTCN_4256 | 50725 | GTCN_1676 | 36709 | CTCN_7893 | 50768 |
| TTCN_2573 | 36667 | CTCN_7860 | 50726 | GTCN_1677 | 36710 | CTCN_7894 | 50769 |
| TTCN_2574 | 36668 | CTCN_7861 | 50727 | CTCN_3134 | 36711 | CTCN_7895 | 50770 |
| TTCN_2575 | 36669 | GTCN_4257 | 50728 | ATCN_1858 | 36712 | CTCN_7896 | 50771 |
| GTCN_1667 | 36670 | CTCN_7862 | 50729 | GTCN_1678 | 36713 | TTCN_6614 | 50772 |
| CTCN_3121 | 36671 | CTCN_7863 | 50730 | CTCN_3135 | 36714 | TTCN_6615 | 50773 |
| TTCN_2576 | 36672 | CTCN_7864 | 50731 | TTCN_2586 | 36715 | TTCN_6616 | 50774 |
| GTCN_1668 | 36673 | CTCN_7865 | 50732 | ATCN_1859 | 36716 | TTCN_6617 | 50775 |
| GTCN_1669 | 36674 | CTCN_7866 | 50733 | TTCN_2587 | 36717 | CTCN_7897 | 50776 |
| CTCN_3122 | 36675 | CTCN_7867 | 50734 | TTCN_2588 | 36718 | TTCN_6618 | 50777 |
| TTCN_2577 | 36676 | CTCN_7868 | 50735 | CTCN_3136 | 36719 | TTCN_6619 | 50778 |
| CTCN_3123 | 36677 | TTCN_6606 | 50736 | ATCN_1860 | 36720 | TTCN_6620 | 50779 |
| ATCN_1851 | 36678 | TTCN_6607 | 50737 | GTCN_1679 | 36721 | TTCN_6621 | 50780 |
| CTCN_3124 | 36679 | TTCN_6608 | 50738 | GTCN_1680 | 36722 | CTCN_7898 | 50781 |
| GTCN_1670 | 36680 | TTCN_6609 | 50739 | ATCN_1861 | 36723 | TTCN_6622 | 50782 |
| GTCN_1671 | 36681 | TTCN_6610 | 50740 | TTCN_2589 | 36724 | TTCN_6623 | 50783 |
| TTCN_2578 | 36682 | TTCN_6611 | 50741 | GTCN_1681 | 36725 | TTCN_6624 | 50784 |
| TTCN_2579 | 36683 | TTCN_6612 | 50742 | CTCN_3137 | 36726 | TTCN_6625 | 50785 |
| CTCN_3125 | 36684 | TTCN_6613 | 50743 | CTCN_3138 | 36727 | TTCN_6626 | 50786 |
| ATCN_1852 | 36685 | CTCN_7869 | 50744 | TTCN_2590 | 36728 | TTCN_6627 | 50787 |
| TTCN_2580 | 36686 | CTCN_7870 | 50745 | TTCN_2591 | 36729 | TTCN_6628 | 50788 |
| GTCN_1672 | 36687 | CTCN_7871 | 50746 | GTCN_1682 | 36730 | TTCN_6629 | 50789 |
| GTCN_1673 | 36688 | CTCN_7872 | 50747 | CTCN_3139 | 36731 | TTCN_6630 | 50790 |
| TTCN_2581 | 36689 | CTCN_7873 | 50748 | GTCN_1683 | 36732 | TTCN_6631 | 50791 |
| GTCN_1674 | 36690 | CTCN_7874 | 50749 | ATCN_1862 | 36733 | TTCN_6632 | 50792 |
| CTCN_3126 | 36691 | CTCN_7875 | 50750 | GTCN_1684 | 36734 | TTCN_6633 | 50793 |
| CTCN_3127 | 36692 | CTCN_7876 | 50751 | TTCN_2592 | 36735 | GTCN_4258 | 50794 |
| CTCN_3128 | 36693 | CTCN_7877 | 50752 | CTCN_3140 | 36736 | CTCN_7899 | 50795 |
| ATCN_1853 | 36694 | CTCN_7878 | 50753 | ATCN_1863 | 36737 | ATCN_4548 | 50796 |
| TTCN_2582 | 36695 | CTCN_7879 | 50754 | CTCN_3141 | 36738 | TTCN_6634 | 50797 |

FIG. 37 (continued)

| | | | |
|---|---|---|---|
| ATCN_1864 | 36739 | GTCN_4259 | 50798 |
| CTCN_3142 | 36740 | TTCN_6635 | 50799 |
| GTCN_1685 | 36741 | TTCN_6636 | 50800 |
| TTCN_2593 | 36742 | TTCN_6637 | 50801 |
| CTCN_3143 | 36743 | TTCN_6638 | 50802 |
| TTCN_2594 | 36744 | TTCN_6639 | 50803 |
| TTCN_2595 | 36745 | CTCN_7900 | 50804 |
| TTCN_2596 | 36746 | ATCN_4549 | 50805 |
| TTCN_2597 | 36747 | CTCN_7901 | 50806 |
| TTCN_2598 | 36748 | ATCN_4550 | 50807 |
| TTCN_2599 | 36749 | CTCN_7902 | 50808 |
| CTCN_3144 | 36750 | CTCN_7903 | 50809 |
| CTCN_3145 | 36751 | ATCN_4551 | 50810 |
| GTCN_1686 | 36752 | TTCN_6640 | 50811 |
| CTCN_3146 | 36753 | CTCN_7904 | 50812 |
| GTCN_1687 | 36754 | GTCN_4260 | 50813 |
| ATCN_1865 | 36755 | CTCN_7905 | 50814 |
| CTCN_3147 | 36756 | GTCN_4261 | 50815 |
| CTCN_3148 | 36757 | ATCN_4552 | 50816 |
| GTCN_1688 | 36758 | GTCN_4262 | 50817 |
| TTCN_2600 | 36759 | GTCN_4263 | 50818 |
| GTCN_1689 | 36760 | CTCN_7906 | 50819 |
| TTCN_2601 | 36761 | ATCN_4553 | 50820 |
| ATCN_1866 | 36762 | TTCN_6641 | 50821 |
| CTCN_3149 | 36763 | CTCN_7907 | 50822 |
| ATCN_1867 | 36764 | TTCN_6642 | 50823 |
| CTCN_3150 | 36765 | TTCN_6643 | 50824 |
| GTCN_1690 | 36766 | CTCN_7908 | 50825 |
| CTCN_3151 | 36767 | TTCN_6644 | 50826 |
| CTCN_3152 | 36768 | TTCN_6645 | 50827 |
| ATCN_1868 | 36769 | ATCN_4554 | 50828 |
| TTCN_2602 | 36770 | ATCN_4555 | 50829 |
| CTCN_3153 | 36771 | CTCN_7909 | 50830 |
| GTCN_1691 | 36772 | ATCN_4556 | 50831 |
| ATCN_1869 | 36773 | TTCN_6646 | 50832 |
| ATCN_1870 | 36774 | CTCN_7910 | 50833 |
| TTCN_2603 | 36775 | TTCN_6647 | 50834 |
| ATCN_1871 | 36776 | CTCN_7911 | 50835 |
| ATCN_1872 | 36777 | GTCN_4264 | 50836 |
| GTCN_1692 | 36778 | TTCN_6648 | 50837 |
| CTCN_3154 | 36779 | TTCN_6649 | 50838 |
| CTCN_3155 | 36780 | CTCN_7912 | 50839 |
| TTCN_2604 | 36781 | CTCN_7913 | 50840 |

| | | | |
|---|---|---|---|
| GTCN_1693 | 36782 | CTCN_7914 | 50841 |
| ATCN_1873 | 36783 | CTCN_7915 | 50842 |
| ATCN_1874 | 36784 | TTCN_6650 | 50843 |
| GTCN_1694 | 36785 | GTCN_4265 | 50844 |
| ATCN_1875 | 36786 | GTCN_4266 | 50845 |
| GTCN_1695 | 36787 | ATCN_4557 | 50846 |
| CTCN_3156 | 36788 | TTCN_6651 | 50847 |
| TTCN_2605 | 36789 | TTCN_6652 | 50848 |
| GTCN_1696 | 36790 | CTCN_7916 | 50849 |
| CTCN_3157 | 36791 | CTCN_7917 | 50850 |
| GTCN_1697 | 36792 | CTCN_7918 | 50851 |
| TTCN_2606 | 36793 | TTCN_6653 | 50852 |
| TTCN_2607 | 36794 | TTCN_6654 | 50853 |
| CTCN_3158 | 36795 | CTCN_7919 | 50854 |
| CTCN_3159 | 36796 | CTCN_7920 | 50855 |
| TTCN_2608 | 36797 | GTCN_4267 | 50856 |
| ATCN_1876 | 36798 | GTCN_4268 | 50857 |
| TTCN_2609 | 36799 | ATCN_4558 | 50858 |
| TTCN_2610 | 36800 | GTCN_4269 | 50859 |
| CTCN_3160 | 36801 | CTCN_7921 | 50860 |
| TTCN_2611 | 36802 | GTCN_4270 | 50861 |
| CTCN_3161 | 36803 | TTCN_6655 | 50862 |
| TTCN_2612 | 36804 | CTCN_7922 | 50863 |
| CTCN_3162 | 36805 | TTCN_6656 | 50864 |
| TTCN_2613 | 36806 | ATCN_4559 | 50865 |
| ATCN_1877 | 36807 | TTCN_6657 | 50866 |
| TTCN_2614 | 36808 | TTCN_6658 | 50867 |
| TTCN_2615 | 36809 | CTCN_7923 | 50868 |
| ATCN_1878 | 36810 | CTCN_7924 | 50869 |
| CTCN_3163 | 36811 | GTCN_4271 | 50870 |
| GTCN_1698 | 36812 | TTCN_6659 | 50871 |
| CTCN_3164 | 36813 | TTCN_6660 | 50872 |
| CTCN_3165 | 36814 | GTCN_4272 | 50873 |
| ATCN_1879 | 36815 | GTCN_4273 | 50874 |
| TTCN_2616 | 36816 | TTCN_6661 | 50875 |
| CTCN_3166 | 36817 | CTCN_7925 | 50876 |
| TTCN_2617 | 36818 | CTCN_7926 | 50877 |
| TTCN_2618 | 36819 | CTCN_7927 | 50878 |
| TTCN_2619 | 36820 | GTCN_4274 | 50879 |
| TTCN_2620 | 36821 | ATCN_4560 | 50880 |
| TTCN_2621 | 36822 | CTCN_7928 | 50881 |
| ATCN_1880 | 36823 | GTCN_4275 | 50882 |
| TTCN_2622 | 36824 | GTCN_4276 | 50883 |

FIG. 37 (continued)

| | | | |
|---|---|---|---|
| CTCN_3167 | 36825 | TTCN_6662 | 50884 |
| GTCN_1699 | 36826 | CTCN_7929 | 50885 |
| GTCN_1700 | 36827 | CTCN_7930 | 50886 |
| CTCN_3168 | 36828 | CTCN_7931 | 50887 |
| CTCN_3169 | 36829 | CTCN_7932 | 50888 |
| CTCN_3170 | 36830 | GTCN_4277 | 50889 |
| GTCN_1701 | 36831 | CTCN_7933 | 50890 |
| CTCN_3171 | 36832 | CTCN_7934 | 50891 |
| CTCN_3172 | 36833 | CTCN_7935 | 50892 |
| CTCN_3173 | 36834 | ATCN_4561 | 50893 |
| CTCN_3174 | 36835 | TTCN_6663 | 50894 |
| CTCN_3175 | 36836 | GTCN_4278 | 50895 |
| ATCN_1881 | 36837 | TTCN_6664 | 50896 |
| CTCN_3176 | 36838 | TTCN_6665 | 50897 |
| CTCN_3177 | 36839 | CTCN_7936 | 50898 |
| CTCN_3178 | 36840 | TTCN_6666 | 50899 |
| CTCN_3179 | 36841 | TTCN_6667 | 50900 |
| GTCN_1702 | 36842 | TTCN_6668 | 50901 |
| CTCN_3180 | 36843 | CTCN_7937 | 50902 |
| ATCN_1882 | 36844 | GTCN_4279 | 50903 |
| TTCN_2623 | 36845 | ATCN_4562 | 50904 |
| TTCN_2624 | 36846 | GTCN_4280 | 50905 |
| CTCN_3181 | 36847 | ATCN_4563 | 50906 |
| ATCN_1883 | 36848 | CTCN_7938 | 50907 |
| TTCN_2625 | 36849 | CTCN_7939 | 50908 |
| GTCN_1703 | 36850 | CTCN_7940 | 50909 |
| CTCN_3182 | 36851 | CTCN_7941 | 50910 |
| CTCN_3183 | 36852 | TTCN_6669 | 50911 |
| CTCN_3184 | 36853 | TTCN_6670 | 50912 |
| GTCN_1704 | 36854 | GTCN_4281 | 50913 |
| ATCN_1884 | 36855 | CTCN_7942 | 50914 |
| CTCN_3185 | 36856 | ATCN_4564 | 50915 |
| CTCN_3186 | 36857 | CTCN_7943 | 50916 |
| CTCN_3187 | 36858 | CTCN_7944 | 50917 |
| CTCN_3188 | 36859 | ATCN_4565 | 50918 |
| ATCN_1885 | 36860 | ATCN_4566 | 50919 |
| ATCN_1886 | 36861 | CTCN_7945 | 50920 |
| ATCN_1887 | 36862 | GTCN_4282 | 50921 |
| CTCN_3189 | 36863 | CTCN_7946 | 50922 |
| GTCN_1705 | 36864 | TTCN_6671 | 50923 |
| CTCN_3190 | 36865 | CTCN_7947 | 50924 |
| ATCN_1888 | 36866 | GTCN_4283 | 50925 |
| TTCN_2626 | 36867 | TTCN_6672 | 50926 |

| | | | |
|---|---|---|---|
| ATCN_1889 | 36868 | ATCN_4567 | 50927 |
| CTCN_3191 | 36869 | GTCN_4284 | 50928 |
| CTCN_3192 | 36870 | CTCN_7948 | 50929 |
| TTCN_2627 | 36871 | ATCN_4568 | 50930 |
| ATCN_1890 | 36872 | CTCN_7949 | 50931 |
| TTCN_2628 | 36873 | CTCN_7950 | 50932 |
| CTCN_3193 | 36874 | CTCN_7951 | 50933 |
| TTCN_2629 | 36875 | TTCN_6673 | 50934 |
| CTCN_3194 | 36876 | ATCN_4569 | 50935 |
| TTCN_2630 | 36877 | TTCN_6674 | 50936 |
| GTCN_1706 | 36878 | CTCN_7952 | 50937 |
| CTCN_3195 | 36879 | CTCN_7953 | 50938 |
| GTCN_1707 | 36880 | CTCN_7954 | 50939 |
| CTCN_3196 | 36881 | CTCN_7955 | 50940 |
| TTCN_2631 | 36882 | CTCN_7956 | 50941 |
| GTCN_1708 | 36883 | TTCN_6675 | 50942 |
| CTCN_3197 | 36884 | CTCN_7957 | 50943 |
| TTCN_2632 | 36885 | GTCN_4285 | 50944 |
| GTCN_1709 | 36886 | CTCN_7958 | 50945 |
| GTCN_1710 | 36887 | CTCN_7959 | 50946 |
| TTCN_2633 | 36888 | ATCN_4570 | 50947 |
| ATCN_1891 | 36889 | TTCN_6676 | 50948 |
| CTCN_3198 | 36890 | ATCN_4571 | 50949 |
| CTCN_3199 | 36891 | TTCN_6677 | 50950 |
| GTCN_1711 | 36892 | TTCN_6678 | 50951 |
| ATCN_1892 | 36893 | TTCN_6679 | 50952 |
| CTCN_3200 | 36894 | TTCN_6680 | 50953 |
| ATCN_1893 | 36895 | TTCN_6681 | 50954 |
| GTCN_1712 | 36896 | TTCN_6682 | 50955 |
| CTCN_3201 | 36897 | TTCN_6683 | 50956 |
| ATCN_1894 | 36898 | ATCN_4572 | 50957 |
| ATCN_1895 | 36899 | CTCN_7960 | 50958 |
| GTCN_1713 | 36900 | TTCN_6684 | 50959 |
| TTCN_2634 | 36901 | ATCN_4573 | 50960 |
| CTCN_3202 | 36902 | GTCN_4286 | 50961 |
| CTCN_3203 | 36903 | CTCN_7961 | 50962 |
| CTCN_3204 | 36904 | CTCN_7962 | 50963 |
| CTCN_3205 | 36905 | ATCN_4574 | 50964 |
| GTCN_1714 | 36906 | ATCN_4575 | 50965 |
| ATCN_1896 | 36907 | ATCN_4576 | 50966 |
| ATCN_1897 | 36908 | TTCN_6685 | 50967 |
| GTCN_1715 | 36909 | TTCN_6686 | 50968 |
| TTCN_2635 | 36910 | GTCN_4287 | 50969 |

FIG. 37 (continued)

| | | | |
|---|---|---|---|
| ATCN_1898 | 36911 | TTCN_6687 | 50970 |
| GTCN_1716 | 36912 | ATCN_4577 | 50971 |
| ATCN_1899 | 36913 | CTCN_7963 | 50972 |
| TTCN_2636 | 36914 | TTCN_6688 | 50973 |
| ATCN_1900 | 36915 | CTCN_7964 | 50974 |
| CTCN_3206 | 36916 | CTCN_7965 | 50975 |
| CTCN_3207 | 36917 | CTCN_7966 | 50976 |
| GTCN_1717 | 36918 | TTCN_6689 | 50977 |
| TTCN_2637 | 36919 | CTCN_7967 | 50978 |
| ATCN_1901 | 36920 | TTCN_6690 | 50979 |
| CTCN_3208 | 36921 | ATCN_4578 | 50980 |
| ATCN_1902 | 36922 | CTCN_7968 | 50981 |
| CTCN_3209 | 36923 | ATCN_4579 | 50982 |
| GTCN_1718 | 36924 | GTCN_4288 | 50983 |
| CTCN_3210 | 36925 | CTCN_7969 | 50984 |
| CTCN_3211 | 36926 | ATCN_4580 | 50985 |
| GTCN_1719 | 36927 | GTCN_4289 | 50986 |
| TTCN_2638 | 36928 | TTCN_6691 | 50987 |
| CTCN_3212 | 36929 | CTCN_7970 | 50988 |
| ATCN_1903 | 36930 | TTCN_6692 | 50989 |
| GTCN_1720 | 36931 | TTCN_6693 | 50990 |
| CTCN_3213 | 36932 | TTCN_6694 | 50991 |
| GTCN_1721 | 36933 | GTCN_4290 | 50992 |
| TTCN_2639 | 36934 | CTCN_7971 | 50993 |
| GTCN_1722 | 36935 | CTCN_7972 | 50994 |
| CTCN_3214 | 36936 | ATCN_4581 | 50995 |
| CTCN_3215 | 36937 | CTCN_7973 | 50996 |
| GTCN_1723 | 36938 | CTCN_7974 | 50997 |
| ATCN_1904 | 36939 | CTCN_7975 | 50998 |
| ATCN_1905 | 36940 | TTCN_6695 | 50999 |
| ATCN_1906 | 36941 | TTCN_6696 | 51000 |
| ATCN_1907 | 36942 | GTCN_4291 | 51001 |
| TTCN_2640 | 36943 | ATCN_4582 | 51002 |
| CTCN_3216 | 36944 | ATCN_4583 | 51003 |
| TTCN_2641 | 36945 | TTCN_6697 | 51004 |
| CTCN_3217 | 36946 | CTCN_7976 | 51005 |
| CTCN_3218 | 36947 | TTCN_6698 | 51006 |
| GTCN_1724 | 36948 | TTCN_6699 | 51007 |
| CTCN_3219 | 36949 | CTCN_7977 | 51008 |
| GTCN_1725 | 36950 | TTCN_6700 | 51009 |
| CTCN_3220 | 36951 | TTCN_6701 | 51010 |
| CTCN_3221 | 36952 | TTCN_6702 | 51011 |
| CTCN_3222 | 36953 | GTCN_4292 | 51012 |
| TTCN_2642 | 36954 | GTCN_4293 | 51013 |
| TTCN_2643 | 36955 | GTCN_4294 | 51014 |
| GTCN_1726 | 36956 | CTCN_7978 | 51015 |
| CTCN_3223 | 36957 | CTCN_7979 | 51016 |
| CTCN_3224 | 36958 | CTCN_7980 | 51017 |
| GTCN_1727 | 36959 | TTCN_6703 | 51018 |
| TTCN_2644 | 36960 | CTCN_7981 | 51019 |
| CTCN_3225 | 36961 | CTCN_7982 | 51020 |
| GTCN_1728 | 36962 | TTCN_6704 | 51021 |
| CTCN_3226 | 36963 | ATCN_4584 | 51022 |
| CTCN_3227 | 36964 | CTCN_7983 | 51023 |
| CTCN_3228 | 36965 | TTCN_6705 | 51024 |
| GTCN_1729 | 36966 | CTCN_7984 | 51025 |
| CTCN_3229 | 36967 | TTCN_6706 | 51026 |
| TTCN_2645 | 36968 | GTCN_4295 | 51027 |
| CTCN_3230 | 36969 | CTCN_7985 | 51028 |
| ATCN_1908 | 36970 | TTCN_6707 | 51029 |
| ATCN_1909 | 36971 | ATCN_4585 | 51030 |
| CTCN_3231 | 36972 | CTCN_7986 | 51031 |
| CTCN_3232 | 36973 | GTCN_4296 | 51032 |
| CTCN_3233 | 36974 | ATCN_4586 | 51033 |
| TTCN_2646 | 36975 | TTCN_6708 | 51034 |
| TTCN_2647 | 36976 | GTCN_4297 | 51035 |
| CTCN_3234 | 36977 | TTCN_6709 | 51036 |
| ATCN_1910 | 36978 | CTCN_7987 | 51037 |
| CTCN_3235 | 36979 | ATCN_4587 | 51038 |
| CTCN_3236 | 36980 | ATCN_4588 | 51039 |
| ATCN_1911 | 36981 | CTCN_7988 | 51040 |
| CTCN_3237 | 36982 | ATCN_4589 | 51041 |
| GTCN_1730 | 36983 | CTCN_7989 | 51042 |
| TTCN_2648 | 36984 | TTCN_6710 | 51043 |
| ATCN_1912 | 36985 | CTCN_7990 | 51044 |
| CTCN_3238 | 36986 | GTCN_4298 | 51045 |
| TTCN_2649 | 36987 | GTCN_4299 | 51046 |
| GTCN_1731 | 36988 | CTCN_7991 | 51047 |
| CTCN_3239 | 36989 | GTCN_4300 | 51048 |
| ATCN_1913 | 36990 | TTCN_6711 | 51049 |
| ATCN_1914 | 36991 | CTCN_7992 | 51050 |
| GTCN_1732 | 36992 | CTCN_7993 | 51051 |
| CTCN_3240 | 36993 | ATCN_4590 | 51052 |
| CTCN_3241 | 36994 | ATCN_4591 | 51053 |
| TTCN_2650 | 36995 | CTCN_7994 | 51054 |
| TTCN_2651 | 36996 | CTCN_7995 | 51055 |

FIG. 37 (continued)

| | | | |
|---|---|---|---|
| ATCN_1915 | 36997 | ATCN_4592 | 51056 |
| CTCN_3242 | 36998 | CTCN_7996 | 51057 |
| CTCN_3243 | 36999 | ATCN_4593 | 51058 |
| CTCN_3244 | 37000 | ATCN_4594 | 51059 |
| CTCN_3245 | 37001 | CTCN_7997 | 51060 |
| TTCN_2652 | 37002 | ATCN_4595 | 51061 |
| ATCN_1916 | 37003 | CTCN_7998 | 51062 |
| CTCN_3246 | 37004 | ATCN_4596 | 51063 |
| TTCN_2653 | 37005 | ATCN_4597 | 51064 |
| TTCN_2654 | 37006 | GTCN_4301 | 51065 |
| TTCN_2655 | 37007 | CTCN_7999 | 51066 |
| TTCN_2656 | 37008 | TTCN_6712 | 51067 |
| ATCN_1917 | 37009 | TTCN_6713 | 51068 |
| GTCN_1733 | 37010 | ATCN_4598 | 51069 |
| ATCN_1918 | 37011 | CTCN_8000 | 51070 |
| ATCN_1919 | 37012 | CTCN_8001 | 51071 |
| TTCN_2657 | 37013 | GTCN_4302 | 51072 |
| CTCN_3247 | 37014 | TTCN_6714 | 51073 |
| TTCN_2658 | 37015 | CTCN_8002 | 51074 |
| CTCN_3248 | 37016 | GTCN_4303 | 51075 |
| TTCN_2659 | 37017 | ATCN_4599 | 51076 |
| GTCN_1734 | 37018 | TTCN_6715 | 51077 |
| TTCN_2660 | 37019 | CTCN_8003 | 51078 |
| TTCN_2661 | 37020 | TTCN_6716 | 51079 |
| TTCN_2662 | 37021 | TTCN_6717 | 51080 |
| ATCN_1920 | 37022 | GTCN_4304 | 51081 |
| TTCN_2663 | 37023 | CTCN_8004 | 51082 |
| CTCN_3249 | 37024 | GTCN_4305 | 51083 |
| ATCN_1921 | 37025 | CTCN_8005 | 51084 |
| CTCN_3250 | 37026 | CTCN_8006 | 51085 |
| GTCN_1735 | 37027 | ATCN_4600 | 51086 |
| CTCN_3251 | 37028 | TTCN_6718 | 51087 |
| CTCN_3252 | 37029 | ATCN_4601 | 51088 |
| GTCN_1736 | 37030 | ATCN_4602 | 51089 |
| CTCN_3253 | 37031 | CTCN_8007 | 51090 |
| TTCN_2664 | 37032 | TTCN_6719 | 51091 |
| CTCN_3254 | 37033 | GTCN_4306 | 51092 |
| ATCN_1922 | 37034 | TTCN_6720 | 51093 |
| GTCN_1737 | 37035 | CTCN_8008 | 51094 |
| CTCN_3255 | 37036 | TTCN_6721 | 51095 |
| CTCN_3256 | 37037 | ATCN_4603 | 51096 |
| GTCN_1738 | 37038 | CTCN_8009 | 51097 |
| CTCN_3257 | 37039 | CTCN_8010 | 51098 |

| | | | |
|---|---|---|---|
| ATCN_1923 | 37040 | CTCN_8011 | 51099 |
| ATCN_1924 | 37041 | CTCN_8012 | 51100 |
| CTCN_3258 | 37042 | TTCN_6722 | 51101 |
| CTCN_3259 | 37043 | GTCN_4307 | 51102 |
| TTCN_2665 | 37044 | CTCN_8013 | 51103 |
| CTCN_3260 | 37045 | CTCN_8014 | 51104 |
| GTCN_1739 | 37046 | CTCN_8015 | 51105 |
| TTCN_2666 | 37047 | CTCN_8016 | 51106 |
| TTCN_2667 | 37048 | ATCN_4604 | 51107 |
| ATCN_1925 | 37049 | CTCN_8017 | 51108 |
| ATCN_1926 | 37050 | ATCN_4605 | 51109 |
| TTCN_2668 | 37051 | CTCN_8018 | 51110 |
| ATCN_1927 | 37052 | ATCN_4606 | 51111 |
| ATCN_1928 | 37053 | ATCN_4607 | 51112 |
| ATCN_1929 | 37054 | ATCN_4608 | 51113 |
| TTCN_2669 | 37055 | GTCN_4308 | 51114 |
| ATCN_1930 | 37056 | ATCN_4609 | 51115 |
| GTCN_1740 | 37057 | GTCN_4309 | 51116 |
| TTCN_2670 | 37058 | CTCN_8019 | 51117 |
| CTCN_3261 | 37059 | ATCN_4610 | 51118 |
| CTCN_3262 | 37060 | CTCN_8020 | 51119 |
| TTCN_2671 | 37061 | CTCN_8021 | 51120 |
| GTCN_1741 | 37062 | GTCN_4310 | 51121 |
| ATCN_1931 | 37063 | GTCN_4311 | 51122 |
| GTCN_1742 | 37064 | CTCN_8022 | 51123 |
| GTCN_1743 | 37065 | TTCN_6723 | 51124 |
| CTCN_3263 | 37066 | GTCN_4312 | 51125 |
| CTCN_3264 | 37067 | GTCN_4313 | 51126 |
| CTCN_3265 | 37068 | TTCN_6724 | 51127 |
| GTCN_1744 | 37069 | GTCN_4314 | 51128 |
| ATCN_1932 | 37070 | CTCN_8023 | 51129 |
| CTCN_3266 | 37071 | ATCN_4611 | 51130 |
| ATCN_1933 | 37072 | GTCN_4315 | 51131 |
| TTCN_2672 | 37073 | ATCN_4612 | 51132 |
| CTCN_3267 | 37074 | TTCN_6725 | 51133 |
| CTCN_3268 | 37075 | ATCN_4613 | 51134 |
| TTCN_2673 | 37076 | CTCN_8024 | 51135 |
| TTCN_2674 | 37077 | CTCN_8025 | 51136 |
| TTCN_2675 | 37078 | GTCN_4316 | 51137 |
| ATCN_1934 | 37079 | TTCN_6726 | 51138 |
| GTCN_1745 | 37080 | GTCN_4317 | 51139 |
| CTCN_3269 | 37081 | CTCN_8026 | 51140 |
| TTCN_2676 | 37082 | ATCN_4614 | 51141 |

FIG. 37 (continued)

| | | | |
|---|---|---|---|
| ATCN_1935 | 37083 | CTCN_8027 | 51142 |
| ATCN_1936 | 37084 | CTCN_8028 | 51143 |
| ATCN_1937 | 37085 | CTCN_8029 | 51144 |
| ATCN_1938 | 37086 | CTCN_8030 | 51145 |
| TTCN_2677 | 37087 | ATCN_4615 | 51146 |
| ATCN_1939 | 37088 | ATCN_4616 | 51147 |
| GTCN_1746 | 37089 | ATCN_4617 | 51148 |
| TTCN_2678 | 37090 | CTCN_8031 | 51149 |
| CTCN_3270 | 37091 | CTCN_8032 | 51150 |
| CTCN_3271 | 37092 | CTCN_8033 | 51151 |
| ATCN_1940 | 37093 | GTCN_4318 | 51152 |
| ATCN_1941 | 37094 | CTCN_8034 | 51153 |
| TTCN_2679 | 37095 | CTCN_8035 | 51154 |
| TTCN_2680 | 37096 | CTCN_8036 | 51155 |
| ATCN_1942 | 37097 | ATCN_4618 | 51156 |
| GTCN_1747 | 37098 | TTCN_6727 | 51157 |
| ATCN_1943 | 37099 | CTCN_8037 | 51158 |
| GTCN_1748 | 37100 | ATCN_4619 | 51159 |
| CTCN_3272 | 37101 | CTCN_8038 | 51160 |
| ATCN_1944 | 37102 | CTCN_8039 | 51161 |
| CTCN_3273 | 37103 | CTCN_8040 | 51162 |
| GTCN_1749 | 37104 | CTCN_8041 | 51163 |
| GTCN_1750 | 37105 | GTCN_4319 | 51164 |
| GTCN_1751 | 37106 | ATCN_4620 | 51165 |
| GTCN_1752 | 37107 | GTCN_4320 | 51166 |
| ATCN_1945 | 37108 | CTCN_8042 | 51167 |
| TTCN_2681 | 37109 | GTCN_4321 | 51168 |
| GTCN_1753 | 37110 | CTCN_8043 | 51169 |
| CTCN_3274 | 37111 | TTCN_6728 | 51170 |
| CTCN_3275 | 37112 | CTCN_8044 | 51171 |
| CTCN_3276 | 37113 | GTCN_4322 | 51172 |
| CTCN_3277 | 37114 | GTCN_4323 | 51173 |
| GTCN_1754 | 37115 | CTCN_8045 | 51174 |
| TTCN_2682 | 37116 | TTCN_6729 | 51175 |
| ATCN_1946 | 37117 | ATCN_4621 | 51176 |
| TTCN_2683 | 37118 | TTCN_6730 | 51177 |
| CTCN_3278 | 37119 | GTCN_4324 | 51178 |
| GTCN_1755 | 37120 | GTCN_4325 | 51179 |
| CTCN_3279 | 37121 | TTCN_6731 | 51180 |
| CTCN_3280 | 37122 | CTCN_8046 | 51181 |
| CTCN_3281 | 37123 | TTCN_6732 | 51182 |
| ATCN_1947 | 37124 | TTCN_6733 | 51183 |
| ATCN_1948 | 37125 | CTCN_8047 | 51184 |

| | | | |
|---|---|---|---|
| GTCN_1756 | 37126 | TTCN_6734 | 51185 |
| CTCN_3282 | 37127 | CTCN_8048 | 51186 |
| GTCN_1757 | 37128 | CTCN_8049 | 51187 |
| CTCN_3283 | 37129 | GTCN_4326 | 51188 |
| TTCN_2684 | 37130 | GTCN_4327 | 51189 |
| CTCN_3284 | 37131 | TTCN_6735 | 51190 |
| CTCN_3285 | 37132 | TTCN_6736 | 51191 |
| GTCN_1758 | 37133 | TTCN_6737 | 51192 |
| TTCN_2685 | 37134 | GTCN_4328 | 51193 |
| CTCN_3286 | 37135 | TTCN_6738 | 51194 |
| TTCN_2686 | 37136 | TTCN_6739 | 51195 |
| ATCN_1949 | 37137 | ATCN_4622 | 51196 |
| CTCN_3287 | 37138 | ATCN_4623 | 51197 |
| TTCN_2687 | 37139 | TTCN_6740 | 51198 |
| CTCN_3288 | 37140 | CTCN_8050 | 51199 |
| CTCN_3289 | 37141 | TTCN_6741 | 51200 |
| ATCN_1950 | 37142 | TTCN_6742 | 51201 |
| TTCN_2688 | 37143 | ATCN_4624 | 51202 |
| CTCN_3290 | 37144 | GTCN_4329 | 51203 |
| ATCN_1951 | 37145 | ATCN_4625 | 51204 |
| CTCN_3291 | 37146 | TTCN_6743 | 51205 |
| GTCN_1759 | 37147 | CTCN_8051 | 51206 |
| CTCN_3292 | 37148 | CTCN_8052 | 51207 |
| TTCN_2689 | 37149 | TTCN_6744 | 51208 |
| CTCN_3293 | 37150 | TTCN_6745 | 51209 |
| CTCN_3294 | 37151 | CTCN_8053 | 51210 |
| TTCN_2690 | 37152 | CTCN_8054 | 51211 |
| GTCN_1760 | 37153 | CTCN_8055 | 51212 |
| GTCN_1761 | 37154 | CTCN_8056 | 51213 |
| ATCN_1952 | 37155 | ATCN_4626 | 51214 |
| TTCN_2691 | 37156 | GTCN_4330 | 51215 |
| TTCN_2692 | 37157 | CTCN_8057 | 51216 |
| TTCN_2693 | 37158 | GTCN_4331 | 51217 |
| GTCN_1762 | 37159 | GTCN_4332 | 51218 |
| CTCN_3295 | 37160 | GTCN_4333 | 51219 |
| CTCN_3296 | 37161 | GTCN_4334 | 51220 |
| TTCN_2694 | 37162 | GTCN_4335 | 51221 |
| TTCN_2695 | 37163 | CTCN_8058 | 51222 |
| CTCN_3297 | 37164 | GTCN_4336 | 51223 |
| TTCN_2696 | 37165 | ATCN_4627 | 51224 |
| GTCN_1763 | 37166 | ATCN_4628 | 51225 |
| CTCN_3298 | 37167 | ATCN_4629 | 51226 |
| TTCN_2697 | 37168 | CTCN_8059 | 51227 |

FIG. 37 (continued)

| | | | |
|---|---|---|---|
| ATCN_1953 | 37169 | GTCN_4337 | 51228 |
| TTCN_2698 | 37170 | ATCN_4630 | 51229 |
| ATCN_1954 | 37171 | CTCN_8060 | 51230 |
| CTCN_3299 | 37172 | CTCN_8061 | 51231 |
| GTCN_1764 | 37173 | CTCN_8062 | 51232 |
| CTCN_3300 | 37174 | GTCN_4338 | 51233 |
| TTCN_2699 | 37175 | CTCN_8063 | 51234 |
| CTCN_3301 | 37176 | CTCN_8064 | 51235 |
| CTCN_3302 | 37177 | GTCN_4339 | 51236 |
| TTCN_2700 | 37178 | GTCN_4340 | 51237 |
| CTCN_3303 | 37179 | CTCN_8065 | 51238 |
| CTCN_3304 | 37180 | GTCN_4341 | 51239 |
| CTCN_3305 | 37181 | ATCN_4631 | 51240 |
| CTCN_3306 | 37182 | GTCN_4342 | 51241 |
| ATCN_1955 | 37183 | ATCN_4632 | 51242 |
| ATCN_1956 | 37184 | ATCN_4633 | 51243 |
| CTCN_3307 | 37185 | TTCN_6746 | 51244 |
| TTCN_2701 | 37186 | TTCN_6747 | 51245 |
| CTCN_3308 | 37187 | CTCN_8066 | 51246 |
| GTCN_1765 | 37188 | CTCN_8067 | 51247 |
| CTCN_3309 | 37189 | ATCN_4634 | 51248 |
| TTCN_2702 | 37190 | ATCN_4635 | 51249 |
| CTCN_3310 | 37191 | ATCN_4636 | 51250 |
| GTCN_1766 | 37192 | CTCN_8068 | 51251 |
| TTCN_2703 | 37193 | CTCN_8069 | 51252 |
| TTCN_2704 | 37194 | ATCN_4637 | 51253 |
| CTCN_3311 | 37195 | TTCN_6748 | 51254 |
| CTCN_3312 | 37196 | GTCN_4343 | 51255 |
| CTCN_3313 | 37197 | ATCN_4638 | 51256 |
| TTCN_2705 | 37198 | ATCN_4639 | 51257 |
| TTCN_2706 | 37199 | TTCN_6749 | 51258 |
| GTCN_1767 | 37200 | TTCN_6750 | 51259 |
| CTCN_3314 | 37201 | CTCN_8070 | 51260 |
| TTCN_2707 | 37202 | TTCN_6751 | 51261 |
| TTCN_2708 | 37203 | TTCN_6752 | 51262 |
| TTCN_2709 | 37204 | CTCN_8071 | 51263 |
| CTCN_3315 | 37205 | ATCN_4640 | 51264 |
| GTCN_1768 | 37206 | TTCN_6753 | 51265 |
| CTCN_3316 | 37207 | CTCN_8072 | 51266 |
| GTCN_1769 | 37208 | TTCN_6754 | 51267 |
| CTCN_3317 | 37209 | TTCN_6755 | 51268 |
| GTCN_1770 | 37210 | CTCN_8073 | 51269 |
| CTCN_3318 | 37211 | TTCN_6756 | 51270 |

| | | | |
|---|---|---|---|
| GTCN_1771 | 37212 | CTCN_8074 | 51271 |
| CTCN_3319 | 37213 | GTCN_4344 | 51272 |
| CTCN_3320 | 37214 | TTCN_6757 | 51273 |
| ATCN_1957 | 37215 | TTCN_6758 | 51274 |
| ATCN_1958 | 37216 | CTCN_8075 | 51275 |
| CTCN_3321 | 37217 | GTCN_4345 | 51276 |
| CTCN_3322 | 37218 | TTCN_6759 | 51277 |
| CTCN_3323 | 37219 | CTCN_8076 | 51278 |
| CTCN_3324 | 37220 | CTCN_8077 | 51279 |
| TTCN_2710 | 37221 | GTCN_4346 | 51280 |
| TTCN_2711 | 37222 | GTCN_4347 | 51281 |
| CTCN_3325 | 37223 | GTCN_4348 | 51282 |
| CTCN_3326 | 37224 | GTCN_4349 | 51283 |
| ATCN_1959 | 37225 | CTCN_8078 | 51284 |
| CTCN_3327 | 37226 | CTCN_8079 | 51285 |
| CTCN_3328 | 37227 | CTCN_8080 | 51286 |
| GTCN_1772 | 37228 | CTCN_8081 | 51287 |
| TTCN_2712 | 37229 | GTCN_4350 | 51288 |
| GTCN_1773 | 37230 | CTCN_8082 | 51289 |
| GTCN_1774 | 37231 | CTCN_8083 | 51290 |
| TTCN_2713 | 37232 | CTCN_8084 | 51291 |
| CTCN_3329 | 37233 | GTCN_4351 | 51292 |
| GTCN_1775 | 37234 | ATCN_4641 | 51293 |
| CTCN_3330 | 37235 | CTCN_8085 | 51294 |
| ATCN_1960 | 37236 | CTCN_8086 | 51295 |
| CTCN_3331 | 37237 | ATCN_4642 | 51296 |
| CTCN_3332 | 37238 | ATCN_4643 | 51297 |
| CTCN_3333 | 37239 | CTCN_8087 | 51298 |
| ATCN_1961 | 37240 | TTCN_6760 | 51299 |
| CTCN_3334 | 37241 | ATCN_4644 | 51300 |
| CTCN_3335 | 37242 | CTCN_8088 | 51301 |
| TTCN_2714 | 37243 | GTCN_4352 | 51302 |
| CTCN_3336 | 37244 | CTCN_8089 | 51303 |
| CTCN_3337 | 37245 | CTCN_8090 | 51304 |
| ATCN_1962 | 37246 | GTCN_4353 | 51305 |
| TTCN_2715 | 37247 | CTCN_8091 | 51306 |
| CTCN_3338 | 37248 | GTCN_4354 | 51307 |
| CTCN_3339 | 37249 | CTCN_8092 | 51308 |
| CTCN_3340 | 37250 | TTCN_6761 | 51309 |
| TTCN_2716 | 37251 | CTCN_8093 | 51310 |
| TTCN_2717 | 37252 | CTCN_8094 | 51311 |
| CTCN_3341 | 37253 | CTCN_8095 | 51312 |
| TTCN_2718 | 37254 | GTCN_4355 | 51313 |

FIG. 37 (continued)

| | | | |
|---|---|---|---|
| CTCN_3342 | 37255 | CTCN_8096 | 51314 |
| GTCN_1776 | 37256 | CTCN_8097 | 51315 |
| CTCN_3343 | 37257 | CTCN_8098 | 51316 |
| ATCN_1963 | 37258 | CTCN_8099 | 51317 |
| GTCN_1777 | 37259 | CTCN_8100 | 51318 |
| CTCN_3344 | 37260 | TTCN_6762 | 51319 |
| CTCN_3345 | 37261 | GTCN_4356 | 51320 |
| TTCN_2719 | 37262 | TTCN_6763 | 51321 |
| TTCN_2720 | 37263 | ATCN_4645 | 51322 |
| ATCN_1964 | 37264 | GTCN_4357 | 51323 |
| TTCN_2721 | 37265 | TTCN_6764 | 51324 |
| GTCN_1778 | 37266 | GTCN_4358 | 51325 |
| ATCN_1965 | 37267 | CTCN_8101 | 51326 |
| CTCN_3346 | 37268 | CTCN_8102 | 51327 |
| GTCN_1779 | 37269 | GTCN_4359 | 51328 |
| ATCN_1966 | 37270 | CTCN_8103 | 51329 |
| CTCN_3347 | 37271 | CTCN_8104 | 51330 |
| CTCN_3348 | 37272 | CTCN_8105 | 51331 |
| TTCN_2722 | 37273 | ATCN_4646 | 51332 |
| TTCN_2723 | 37274 | CTCN_8106 | 51333 |
| ATCN_1967 | 37275 | TTCN_6765 | 51334 |
| GTCN_1780 | 37276 | TTCN_6766 | 51335 |
| CTCN_3349 | 37277 | GTCN_4360 | 51336 |
| TTCN_2724 | 37278 | CTCN_8107 | 51337 |
| ATCN_1968 | 37279 | GTCN_4361 | 51338 |
| CTCN_3350 | 37280 | CTCN_8108 | 51339 |
| GTCN_1781 | 37281 | CTCN_8109 | 51340 |
| CTCN_3351 | 37282 | TTCN_6767 | 51341 |
| CTCN_3352 | 37283 | CTCN_8110 | 51342 |
| CTCN_3353 | 37284 | TTCN_6768 | 51343 |
| TTCN_2725 | 37285 | CTCN_8111 | 51344 |
| GTCN_1782 | 37286 | CTCN_8112 | 51345 |
| ATCN_1969 | 37287 | TTCN_6769 | 51346 |
| CTCN_3354 | 37288 | TTCN_6770 | 51347 |
| TTCN_2726 | 37289 | GTCN_4362 | 51348 |
| TTCN_2727 | 37290 | TTCN_6771 | 51349 |
| CTCN_3355 | 37291 | ATCN_4647 | 51350 |
| GTCN_1783 | 37292 | CTCN_8113 | 51351 |
| GTCN_1784 | 37293 | TTCN_6772 | 51352 |
| TTCN_2728 | 37294 | TTCN_6773 | 51353 |
| CTCN_3356 | 37295 | CTCN_8114 | 51354 |
| CTCN_3357 | 37296 | TTCN_6774 | 51355 |
| ATCN_1970 | 37297 | GTCN_4363 | 51356 |

| | | | |
|---|---|---|---|
| CTCN_3358 | 37298 | GTCN_4364 | 51357 |
| ATCN_1971 | 37299 | GTCN_4365 | 51358 |
| ATCN_1972 | 37300 | TTCN_6775 | 51359 |
| TTCN_2729 | 37301 | TTCN_6776 | 51360 |
| CTCN_3359 | 37302 | CTCN_8115 | 51361 |
| CTCN_3360 | 37303 | GTCN_4366 | 51362 |
| TTCN_2730 | 37304 | TTCN_6777 | 51363 |
| ATCN_1973 | 37305 | TTCN_6778 | 51364 |
| ATCN_1974 | 37306 | CTCN_8116 | 51365 |
| TTCN_2731 | 37307 | CTCN_8117 | 51366 |
| TTCN_2732 | 37308 | TTCN_6779 | 51367 |
| TTCN_2733 | 37309 | GTCN_4367 | 51368 |
| CTCN_3361 | 37310 | ATCN_4648 | 51369 |
| ATCN_1975 | 37311 | CTCN_8118 | 51370 |
| CTCN_3362 | 37312 | ATCN_4649 | 51371 |
| CTCN_3363 | 37313 | ATCN_4650 | 51372 |
| TTCN_2734 | 37314 | GTCN_4368 | 51373 |
| ATCN_1976 | 37315 | GTCN_4369 | 51374 |
| CTCN_3364 | 37316 | CTCN_8119 | 51375 |
| CTCN_3365 | 37317 | CTCN_8120 | 51376 |
| ATCN_1977 | 37318 | CTCN_8121 | 51377 |
| TTCN_2735 | 37319 | CTCN_8122 | 51378 |
| TTCN_2736 | 37320 | TTCN_6780 | 51379 |
| TTCN_2737 | 37321 | TTCN_6781 | 51380 |
| CTCN_3366 | 37322 | TTCN_6782 | 51381 |
| ATCN_1978 | 37323 | CTCN_8123 | 51382 |
| ATCN_1979 | 37324 | GTCN_4370 | 51383 |
| ATCN_1980 | 37325 | GTCN_4371 | 51384 |
| TTCN_2738 | 37326 | CTCN_8124 | 51385 |
| ATCN_1981 | 37327 | CTCN_8125 | 51386 |
| GTCN_1785 | 37328 | CTCN_8126 | 51387 |
| CTCN_3367 | 37329 | TTCN_6783 | 51388 |
| TTCN_2739 | 37330 | ATCN_4651 | 51389 |
| GTCN_1786 | 37331 | ATCN_4652 | 51390 |
| ATCN_1982 | 37332 | ATCN_4653 | 51391 |
| TTCN_2740 | 37333 | ATCN_4654 | 51392 |
| CTCN_3368 | 37334 | TTCN_6784 | 51393 |
| CTCN_3369 | 37335 | CTCN_8127 | 51394 |
| CTCN_3370 | 37336 | CTCN_8128 | 51395 |
| CTCN_3371 | 37337 | CTCN_8129 | 51396 |
| CTCN_3372 | 37338 | ATCN_4655 | 51397 |
| TTCN_2741 | 37339 | TTCN_6785 | 51398 |
| TTCN_2742 | 37340 | GTCN_4372 | 51399 |

FIG. 37 (continued)

| | | | |
|---|---|---|---|
| GTCN_1787 | 37341 | ATCN_4656 | 51400 |
| GTCN_1788 | 37342 | ATCN_4657 | 51401 |
| TTCN_2743 | 37343 | CTCN_8130 | 51402 |
| ATCN_1983 | 37344 | TTCN_6786 | 51403 |
| TTCN_2744 | 37345 | ATCN_4658 | 51404 |
| ATCN_1984 | 37346 | CTCN_8131 | 51405 |
| TTCN_2745 | 37347 | CTCN_8132 | 51406 |
| GTCN_1789 | 37348 | GTCN_4373 | 51407 |
| ATCN_1985 | 37349 | CTCN_8133 | 51408 |
| ATCN_1986 | 37350 | GTCN_4374 | 51409 |
| ATCN_1987 | 37351 | CTCN_8134 | 51410 |
| TTCN_2746 | 37352 | CTCN_8135 | 51411 |
| TTCN_2747 | 37353 | TTCN_6787 | 51412 |
| CTCN_3373 | 37354 | GTCN_4375 | 51413 |
| CTCN_3374 | 37355 | TTCN_6788 | 51414 |
| ATCN_1988 | 37356 | GTCN_4376 | 51415 |
| TTCN_2748 | 37357 | ATCN_4659 | 51416 |
| TTCN_2749 | 37358 | GTCN_4377 | 51417 |
| TTCN_2750 | 37359 | ATCN_4660 | 51418 |
| CTCN_3375 | 37360 | TTCN_6789 | 51419 |
| GTCN_1790 | 37361 | ATCN_4661 | 51420 |
| TTCN_2751 | 37362 | CTCN_8136 | 51421 |
| GTCN_1791 | 37363 | ATCN_4662 | 51422 |
| GTCN_1792 | 37364 | CTCN_8137 | 51423 |
| CTCN_3376 | 37365 | GTCN_4378 | 51424 |
| CTCN_3377 | 37366 | TTCN_6790 | 51425 |
| CTCN_3378 | 37367 | CTCN_8138 | 51426 |
| CTCN_3379 | 37368 | TTCN_6791 | 51427 |
| TTCN_2752 | 37369 | TTCN_6792 | 51428 |
| GTCN_1793 | 37370 | CTCN_8139 | 51429 |
| TTCN_2753 | 37371 | CTCN_8140 | 51430 |
| CTCN_3380 | 37372 | ATCN_4663 | 51431 |
| TTCN_2754 | 37373 | ATCN_4664 | 51432 |
| CTCN_3381 | 37374 | ATCN_4665 | 51433 |
| CTCN_3382 | 37375 | CTCN_8141 | 51434 |
| GTCN_1794 | 37376 | GTCN_4379 | 51435 |
| CTCN_3383 | 37377 | ATCN_4666 | 51436 |
| ATCN_1989 | 37378 | ATCN_4667 | 51437 |
| TTCN_2755 | 37379 | GTCN_4380 | 51438 |
| ATCN_1990 | 37380 | GTCN_4381 | 51439 |
| CTCN_3384 | 37381 | TTCN_6793 | 51440 |
| ATCN_1991 | 37382 | TTCN_6794 | 51441 |
| CTCN_3385 | 37383 | TTCN_6795 | 51442 |

| | | | |
|---|---|---|---|
| CTCN_3386 | 37384 | CTCN_8142 | 51443 |
| GTCN_1795 | 37385 | TTCN_6796 | 51444 |
| CTCN_3387 | 37386 | GTCN_4382 | 51445 |
| TTCN_2756 | 37387 | CTCN_8143 | 51446 |
| ATCN_1992 | 37388 | GTCN_4383 | 51447 |
| TTCN_2757 | 37389 | CTCN_8144 | 51448 |
| TTCN_2758 | 37390 | TTCN_6797 | 51449 |
| ATCN_1993 | 37391 | TTCN_6798 | 51450 |
| GTCN_1796 | 37392 | ATCN_4668 | 51451 |
| CTCN_3388 | 37393 | ATCN_4669 | 51452 |
| GTCN_1797 | 37394 | GTCN_4384 | 51453 |
| GTCN_1798 | 37395 | TTCN_6799 | 51454 |
| GTCN_1799 | 37396 | CTCN_8145 | 51455 |
| TTCN_2759 | 37397 | TTCN_6800 | 51456 |
| TTCN_2760 | 37398 | CTCN_8146 | 51457 |
| TTCN_2761 | 37399 | TTCN_6801 | 51458 |
| ATCN_1994 | 37400 | TTCN_6802 | 51459 |
| ATCN_1995 | 37401 | GTCN_4385 | 51460 |
| TTCN_2762 | 37402 | GTCN_4386 | 51461 |
| CTCN_3389 | 37403 | CTCN_8147 | 51462 |
| CTCN_3390 | 37404 | GTCN_4387 | 51463 |
| TTCN_2763 | 37405 | CTCN_8148 | 51464 |
| CTCN_3391 | 37406 | CTCN_8149 | 51465 |
| CTCN_3392 | 37407 | CTCN_8150 | 51466 |
| CTCN_3393 | 37408 | CTCN_8151 | 51467 |
| TTCN_2764 | 37409 | CTCN_8152 | 51468 |
| CTCN_3394 | 37410 | CTCN_8153 | 51469 |
| CTCN_3395 | 37411 | CTCN_8154 | 51470 |
| ATCN_1996 | 37412 | TTCN_6803 | 51471 |
| GTCN_1800 | 37413 | CTCN_8155 | 51472 |
| CTCN_3396 | 37414 | TTCN_6804 | 51473 |
| CTCN_3397 | 37415 | GTCN_4388 | 51474 |
| CTCN_3398 | 37416 | CTCN_8156 | 51475 |
| TTCN_2765 | 37417 | GTCN_4389 | 51476 |
| CTCN_3399 | 37418 | GTCN_4390 | 51477 |
| CTCN_3400 | 37419 | CTCN_8157 | 51478 |
| CTCN_3401 | 37420 | TTCN_6805 | 51479 |
| CTCN_3402 | 37421 | CTCN_8158 | 51480 |
| ATCN_1997 | 37422 | GTCN_4391 | 51481 |
| ATCN_1998 | 37423 | CTCN_8159 | 51482 |
| ATCN_1999 | 37424 | ATCN_4670 | 51483 |
| ATCN_2000 | 37425 | CTCN_8160 | 51484 |
| TTCN_2766 | 37426 | TTCN_6806 | 51485 |

FIG. 37 (continued)

| | | | | | | | |
|---|---|---|---|---|---|---|---|
| CTCN_3403 | 37427 | CTCN_8161 | 51486 | ATCN_2012 | 37470 | CTCN_8178 | 51529 |
| ATCN_2001 | 37428 | GTCN_4392 | 51487 | CTCN_3413 | 37471 | CTCN_8179 | 51530 |
| CTCN_3404 | 37429 | CTCN_8162 | 51488 | GTCN_1809 | 37472 | CTCN_8180 | 51531 |
| CTCN_3405 | 37430 | TTCN_6807 | 51489 | CTCN_3414 | 37473 | ATCN_4682 | 51532 |
| TTCN_2767 | 37431 | TTCN_6808 | 51490 | GTCN_1810 | 37474 | ATCN_4683 | 51533 |
| GTCN_1801 | 37432 | ATCN_4671 | 51491 | TTCN_2781 | 37475 | CTCN_8181 | 51534 |
| TTCN_2768 | 37433 | TTCN_6809 | 51492 | CTCN_3415 | 37476 | CTCN_8182 | 51535 |
| TTCN_2769 | 37434 | TTCN_6810 | 51493 | CTCN_3416 | 37477 | ATCN_4684 | 51536 |
| TTCN_2770 | 37435 | ATCN_4672 | 51494 | TTCN_2782 | 37478 | CTCN_8183 | 51537 |
| ATCN_2002 | 37436 | TTCN_6811 | 51495 | ATCN_2013 | 37479 | CTCN_8184 | 51538 |
| GTCN_1802 | 37437 | GTCN_4393 | 51496 | TTCN_2783 | 37480 | CTCN_8185 | 51539 |
| TTCN_2771 | 37438 | CTCN_8163 | 51497 | CTCN_3417 | 37481 | CTCN_8186 | 51540 |
| CTCN_3406 | 37439 | CTCN_8164 | 51498 | CTCN_3418 | 37482 | ATCN_4685 | 51541 |
| ATCN_2003 | 37440 | ATCN_4673 | 51499 | CTCN_3419 | 37483 | ATCN_4686 | 51542 |
| CTCN_3407 | 37441 | ATCN_4674 | 51500 | ATCN_2014 | 37484 | CTCN_8187 | 51543 |
| TTCN_2772 | 37442 | CTCN_8165 | 51501 | TTCN_2784 | 37485 | CTCN_8188 | 51544 |
| GTCN_1803 | 37443 | CTCN_8166 | 51502 | CTCN_3420 | 37486 | CTCN_8189 | 51545 |
| ATCN_2004 | 37444 | CTCN_8167 | 51503 | GTCN_1811 | 37487 | GTCN_4395 | 51546 |
| TTCN_2773 | 37445 | ATCN_4675 | 51504 | ATCN_2015 | 37488 | GTCN_4396 | 51547 |
| ATCN_2005 | 37446 | TTCN_6812 | 51505 | TTCN_2785 | 37489 | GTCN_4397 | 51548 |
| ATCN_2006 | 37447 | TTCN_6813 | 51506 | GTCN_1812 | 37490 | ATCN_4687 | 51549 |
| GTCN_1804 | 37448 | CTCN_8168 | 51507 | CTCN_3421 | 37491 | CTCN_8190 | 51550 |
| CTCN_3408 | 37449 | GTCN_4394 | 51508 | CTCN_3422 | 37492 | GTCN_4398 | 51551 |
| TTCN_2774 | 37450 | TTCN_6814 | 51509 | GTCN_1813 | 37493 | ATCN_4688 | 51552 |
| CTCN_3409 | 37451 | ATCN_4676 | 51510 | CTCN_3423 | 37494 | CTCN_8191 | 51553 |
| GTCN_1805 | 37452 | CTCN_8169 | 51511 | ATCN_2016 | 37495 | CTCN_8192 | 51554 |
| TTCN_2775 | 37453 | CTCN_8170 | 51512 | ATCN_2017 | 37496 | CTCN_8193 | 51555 |
| TTCN_2776 | 37454 | CTCN_8171 | 51513 | CTCN_3424 | 37497 | TTCN_6819 | 51556 |
| GTCN_1806 | 37455 | CTCN_8172 | 51514 | CTCN_3425 | 37498 | ATCN_4689 | 51557 |
| CTCN_3410 | 37456 | ATCN_4677 | 51515 | ATCN_2018 | 37499 | ATCN_4690 | 51558 |
| TTCN_2777 | 37457 | ATCN_4678 | 51516 | TTCN_2786 | 37500 | CTCN_8194 | 51559 |
| GTCN_1807 | 37458 | CTCN_8173 | 51517 | TTCN_2787 | 37501 | CTCN_8195 | 51560 |
| TTCN_2778 | 37459 | TTCN_6815 | 51518 | CTCN_3426 | 37502 | TTCN_6820 | 51561 |
| TTCN_2779 | 37460 | ATCN_4679 | 51519 | TTCN_2788 | 37503 | CTCN_8196 | 51562 |
| CTCN_3411 | 37461 | TTCN_6816 | 51520 | TTCN_2789 | 37504 | ATCN_4691 | 51563 |
| TTCN_2780 | 37462 | ATCN_4680 | 51521 | ATCN_2019 | 37505 | CTCN_8197 | 51564 |
| ATCN_2007 | 37463 | CTCN_8174 | 51522 | TTCN_2790 | 37506 | GTCN_4399 | 51565 |
| ATCN_2008 | 37464 | CTCN_8175 | 51523 | CTCN_3427 | 37507 | TTCN_6821 | 51566 |
| ATCN_2009 | 37465 | CTCN_8176 | 51524 | CTCN_3428 | 37508 | GTCN_4400 | 51567 |
| GTCN_1808 | 37466 | TTCN_6817 | 51525 | GTCN_1814 | 37509 | GTCN_4401 | 51568 |
| ATCN_2010 | 37467 | CTCN_8177 | 51526 | GTCN_1815 | 37510 | CTCN_8198 | 51569 |
| CTCN_3412 | 37468 | TTCN_6818 | 51527 | ATCN_2020 | 37511 | TTCN_6822 | 51570 |
| ATCN_2011 | 37469 | ATCN_4681 | 51528 | TTCN_2791 | 37512 | ATCN_4692 | 51571 |

FIG. 37 (continued)

| | | | |
|---|---|---|---|
| TTCN_2792 | 37513 | TTCN_6823 | 51572 |
| ATCN_2021 | 37514 | TTCN_6824 | 51573 |
| CTCN_3429 | 37515 | CTCN_8199 | 51574 |
| GTCN_1816 | 37516 | TTCN_6825 | 51575 |
| GTCN_1817 | 37517 | TTCN_6826 | 51576 |
| TTCN_2793 | 37518 | TTCN_6827 | 51577 |
| CTCN_3430 | 37519 | TTCN_6828 | 51578 |
| TTCN_2794 | 37520 | ATCN_4693 | 51579 |
| CTCN_3431 | 37521 | CTCN_8200 | 51580 |
| CTCN_3432 | 37522 | TTCN_6829 | 51581 |
| CTCN_3433 | 37523 | CTCN_8201 | 51582 |
| CTCN_3434 | 37524 | TTCN_6830 | 51583 |
| TTCN_2795 | 37525 | TTCN_6831 | 51584 |
| CTCN_3435 | 37526 | TTCN_6832 | 51585 |
| TTCN_2796 | 37527 | TTCN_6833 | 51586 |
| CTCN_3436 | 37528 | ATCN_4694 | 51587 |
| ATCN_2022 | 37529 | TTCN_6834 | 51588 |
| CTCN_3437 | 37530 | CTCN_8202 | 51589 |
| ATCN_2023 | 37531 | ATCN_4695 | 51590 |
| CTCN_3438 | 37532 | TTCN_6835 | 51591 |
| TTCN_2797 | 37533 | CTCN_8203 | 51592 |
| GTCN_1818 | 37534 | GTCN_4402 | 51593 |
| CTCN_3439 | 37535 | GTCN_4403 | 51594 |
| ATCN_2024 | 37536 | TTCN_6836 | 51595 |
| ATCN_2025 | 37537 | ATCN_4696 | 51596 |
| ATCN_2026 | 37538 | TTCN_6837 | 51597 |
| CTCN_3440 | 37539 | TTCN_6838 | 51598 |
| TTCN_2798 | 37540 | TTCN_6839 | 51599 |
| TTCN_2799 | 37541 | CTCN_8204 | 51600 |
| GTCN_1819 | 37542 | CTCN_8205 | 51601 |
| TTCN_2800 | 37543 | CTCN_8206 | 51602 |
| TTCN_2801 | 37544 | TTCN_6840 | 51603 |
| TTCN_2802 | 37545 | CTCN_8207 | 51604 |
| TTCN_2803 | 37546 | GTCN_4404 | 51605 |
| CTCN_3441 | 37547 | GTCN_4405 | 51606 |
| TTCN_2804 | 37548 | GTCN_4406 | 51607 |
| TTCN_2805 | 37549 | CTCN_8208 | 51608 |
| GTCN_1820 | 37550 | TTCN_6841 | 51609 |
| CTCN_3442 | 37551 | CTCN_8209 | 51610 |
| GTCN_1821 | 37552 | GTCN_4407 | 51611 |
| ATCN_2027 | 37553 | TTCN_6842 | 51612 |
| ATCN_2028 | 37554 | TTCN_6843 | 51613 |
| CTCN_3443 | 37555 | CTCN_8210 | 51614 |

| | | | |
|---|---|---|---|
| GTCN_1822 | 37556 | GTCN_4408 | 51615 |
| TTCN_2806 | 37557 | TTCN_6844 | 51616 |
| CTCN_3444 | 37558 | ATCN_4697 | 51617 |
| ATCN_2029 | 37559 | GTCN_4409 | 51618 |
| CTCN_3445 | 37560 | ATCN_4698 | 51619 |
| GTCN_1823 | 37561 | CTCN_8211 | 51620 |
| ATCN_2030 | 37562 | GTCN_4410 | 51621 |
| TTCN_2807 | 37563 | GTCN_4411 | 51622 |
| CTCN_3446 | 37564 | CTCN_8212 | 51623 |
| GTCN_1824 | 37565 | CTCN_8213 | 51624 |
| GTCN_1825 | 37566 | GTCN_4412 | 51625 |
| CTCN_3447 | 37567 | CTCN_8214 | 51626 |
| ATCN_2031 | 37568 | GTCN_4413 | 51627 |
| CTCN_3448 | 37569 | ATCN_4699 | 51628 |
| ATCN_2032 | 37570 | ATCN_4700 | 51629 |
| CTCN_3449 | 37571 | GTCN_4414 | 51630 |
| TTCN_2808 | 37572 | CTCN_8215 | 51631 |
| GTCN_1826 | 37573 | TTCN_6845 | 51632 |
| CTCN_3450 | 37574 | CTCN_8216 | 51633 |
| CTCN_3451 | 37575 | CTCN_8217 | 51634 |
| ATCN_2033 | 37576 | ATCN_4701 | 51635 |
| CTCN_3452 | 37577 | CTCN_8218 | 51636 |
| CTCN_3453 | 37578 | CTCN_8219 | 51637 |
| CTCN_3454 | 37579 | ATCN_4702 | 51638 |
| CTCN_3455 | 37580 | ATCN_4703 | 51639 |
| TTCN_2809 | 37581 | CTCN_8220 | 51640 |
| ATCN_2034 | 37582 | GTCN_4415 | 51641 |
| ATCN_2035 | 37583 | CTCN_8221 | 51642 |
| CTCN_3456 | 37584 | TTCN_6846 | 51643 |
| ATCN_2036 | 37585 | GTCN_4416 | 51644 |
| TTCN_2810 | 37586 | GTCN_4417 | 51645 |
| GTCN_1827 | 37587 | TTCN_6847 | 51646 |
| CTCN_3457 | 37588 | GTCN_4418 | 51647 |
| CTCN_3458 | 37589 | CTCN_8222 | 51648 |
| GTCN_1828 | 37590 | ATCN_4704 | 51649 |
| CTCN_3459 | 37591 | TTCN_6848 | 51650 |
| ATCN_2037 | 37592 | CTCN_8223 | 51651 |
| CTCN_3460 | 37593 | CTCN_8224 | 51652 |
| GTCN_1829 | 37594 | CTCN_8225 | 51653 |
| CTCN_3461 | 37595 | CTCN_8226 | 51654 |
| TTCN_2811 | 37596 | TTCN_6849 | 51655 |
| TTCN_2812 | 37597 | ATCN_4705 | 51656 |
| ATCN_2038 | 37598 | TTCN_6850 | 51657 |

FIG. 37 (continued)

| | | | |
|---|---|---|---|
| CTCN_3462 | 37599 | CTCN_8227 | 51658 |
| TTCN_2813 | 37600 | TTCN_6851 | 51659 |
| TTCN_2814 | 37601 | CTCN_8228 | 51660 |
| TTCN_2815 | 37602 | CTCN_8229 | 51661 |
| GTCN_1830 | 37603 | ATCN_4706 | 51662 |
| GTCN_1831 | 37604 | ATCN_4707 | 51663 |
| TTCN_2816 | 37605 | CTCN_8230 | 51664 |
| TTCN_2817 | 37606 | GTCN_4419 | 51665 |
| CTCN_3463 | 37607 | CTCN_8231 | 51666 |
| TTCN_2818 | 37608 | GTCN_4420 | 51667 |
| GTCN_1832 | 37609 | CTCN_8232 | 51668 |
| CTCN_3464 | 37610 | ATCN_4708 | 51669 |
| TTCN_2819 | 37611 | CTCN_8233 | 51670 |
| TTCN_2820 | 37612 | CTCN_8234 | 51671 |
| TTCN_2821 | 37613 | GTCN_4421 | 51672 |
| TTCN_2822 | 37614 | CTCN_8235 | 51673 |
| GTCN_1833 | 37615 | ATCN_4709 | 51674 |
| GTCN_1834 | 37616 | TTCN_6852 | 51675 |
| CTCN_3465 | 37617 | CTCN_8236 | 51676 |
| CTCN_3466 | 37618 | CTCN_8237 | 51677 |
| TTCN_2823 | 37619 | GTCN_4422 | 51678 |
| ATCN_2039 | 37620 | GTCN_4423 | 51679 |
| ATCN_2040 | 37621 | TTCN_6853 | 51680 |
| CTCN_3467 | 37622 | ATCN_4710 | 51681 |
| TTCN_2824 | 37623 | ATCN_4711 | 51682 |
| TTCN_2825 | 37624 | CTCN_8238 | 51683 |
| TTCN_2826 | 37625 | ATCN_4712 | 51684 |
| TTCN_2827 | 37626 | TTCN_6854 | 51685 |
| ATCN_2041 | 37627 | GTCN_4424 | 51686 |
| GTCN_1835 | 37628 | TTCN_6855 | 51687 |
| CTCN_3468 | 37629 | CTCN_8239 | 51688 |
| GTCN_1836 | 37630 | CTCN_8240 | 51689 |
| CTCN_3469 | 37631 | ATCN_4713 | 51690 |
| ATCN_2042 | 37632 | GTCN_4425 | 51691 |
| CTCN_3470 | 37633 | GTCN_4426 | 51692 |
| TTCN_2828 | 37634 | ATCN_4714 | 51693 |
| ATCN_2043 | 37635 | GTCN_4427 | 51694 |
| TTCN_2829 | 37636 | CTCN_8241 | 51695 |
| CTCN_3471 | 37637 | CTCN_8242 | 51696 |
| CTCN_3472 | 37638 | GTCN_4428 | 51697 |
| TTCN_2830 | 37639 | CTCN_8243 | 51698 |
| GTCN_1837 | 37640 | TTCN_6856 | 51699 |
| CTCN_3473 | 37641 | TTCN_6857 | 51700 |

| | | | |
|---|---|---|---|
| CTCN_3474 | 37642 | TTCN_6858 | 51701 |
| ATCN_2044 | 37643 | TTCN_6859 | 51702 |
| TTCN_2831 | 37644 | TTCN_6860 | 51703 |
| TTCN_2832 | 37645 | ATCN_4715 | 51704 |
| TTCN_2833 | 37646 | TTCN_6861 | 51705 |
| CTCN_3475 | 37647 | GTCN_4429 | 51706 |
| TTCN_2834 | 37648 | CTCN_8244 | 51707 |
| CTCN_3476 | 37649 | TTCN_6862 | 51708 |
| GTCN_1838 | 37650 | CTCN_8245 | 51709 |
| GTCN_1839 | 37651 | TTCN_6863 | 51710 |
| ATCN_2045 | 37652 | ATCN_4716 | 51711 |
| CTCN_3477 | 37653 | TTCN_6864 | 51712 |
| TTCN_2835 | 37654 | CTCN_8246 | 51713 |
| CTCN_3478 | 37655 | GTCN_4430 | 51714 |
| CTCN_3479 | 37656 | TTCN_6865 | 51715 |
| ATCN_2046 | 37657 | CTCN_8247 | 51716 |
| GTCN_1840 | 37658 | ATCN_4717 | 51717 |
| CTCN_3480 | 37659 | TTCN_6866 | 51718 |
| CTCN_3481 | 37660 | TTCN_6867 | 51719 |
| CTCN_3482 | 37661 | GTCN_4431 | 51720 |
| GTCN_1841 | 37662 | TTCN_6868 | 51721 |
| CTCN_3483 | 37663 | TTCN_6869 | 51722 |
| ATCN_2047 | 37664 | TTCN_6870 | 51723 |
| ATCN_2048 | 37665 | CTCN_8248 | 51724 |
| ATCN_2049 | 37666 | GTCN_4432 | 51725 |
| GTCN_1842 | 37667 | CTCN_8249 | 51726 |
| CTCN_3484 | 37668 | CTCN_8250 | 51727 |
| CTCN_3485 | 37669 | TTCN_6871 | 51728 |
| GTCN_1843 | 37670 | CTCN_8251 | 51729 |
| GTCN_1844 | 37671 | GTCN_4433 | 51730 |
| ATCN_2050 | 37672 | TTCN_6872 | 51731 |
| ATCN_2051 | 37673 | ATCN_4718 | 51732 |
| TTCN_2836 | 37674 | CTCN_8252 | 51733 |
| TTCN_2837 | 37675 | TTCN_6873 | 51734 |
| GTCN_1845 | 37676 | CTCN_8253 | 51735 |
| TTCN_2838 | 37677 | GTCN_4434 | 51736 |
| CTCN_3486 | 37678 | ATCN_4719 | 51737 |
| CTCN_3487 | 37679 | CTCN_8254 | 51738 |
| GTCN_1846 | 37680 | GTCN_4435 | 51739 |
| CTCN_3488 | 37681 | CTCN_8255 | 51740 |
| CTCN_3489 | 37682 | CTCN_8256 | 51741 |
| TTCN_2839 | 37683 | TTCN_6874 | 51742 |
| GTCN_1847 | 37684 | TTCN_6875 | 51743 |

FIG. 37 (continued)

| | | | |
|---|---|---|---|
| CTCN_3490 | 37685 | CTCN_8257 | 51744 |
| GTCN_1848 | 37686 | GTCN_4436 | 51745 |
| GTCN_1849 | 37687 | TTCN_6876 | 51746 |
| GTCN_1850 | 37688 | GTCN_4437 | 51747 |
| TTCN_2840 | 37689 | GTCN_4438 | 51748 |
| GTCN_1851 | 37690 | CTCN_8258 | 51749 |
| CTCN_3491 | 37691 | CTCN_8259 | 51750 |
| GTCN_1852 | 37692 | CTCN_8260 | 51751 |
| GTCN_1853 | 37693 | TTCN_6877 | 51752 |
| ATCN_2052 | 37694 | CTCN_8261 | 51753 |
| CTCN_3492 | 37695 | GTCN_4439 | 51754 |
| TTCN_2841 | 37696 | CTCN_8262 | 51755 |
| TTCN_2842 | 37697 | ATCN_4720 | 51756 |
| CTCN_3493 | 37698 | ATCN_4721 | 51757 |
| GTCN_1854 | 37699 | ATCN_4722 | 51758 |
| TTCN_2843 | 37700 | TTCN_6878 | 51759 |
| GTCN_1855 | 37701 | ATCN_4723 | 51760 |
| GTCN_1856 | 37702 | TTCN_6879 | 51761 |
| CTCN_3494 | 37703 | ATCN_4724 | 51762 |
| TTCN_2844 | 37704 | CTCN_8263 | 51763 |
| CTCN_3495 | 37705 | CTCN_8264 | 51764 |
| ATCN_2053 | 37706 | CTCN_8265 | 51765 |
| TTCN_2845 | 37707 | TTCN_6880 | 51766 |
| ATCN_2054 | 37708 | GTCN_4440 | 51767 |
| TTCN_2846 | 37709 | CTCN_8266 | 51768 |
| ATCN_2055 | 37710 | ATCN_4725 | 51769 |
| TTCN_2847 | 37711 | GTCN_4441 | 51770 |
| ATCN_2056 | 37712 | TTCN_6881 | 51771 |
| ATCN_2057 | 37713 | CTCN_8267 | 51772 |
| GTCN_1857 | 37714 | ATCN_4726 | 51773 |
| GTCN_1858 | 37715 | TTCN_6882 | 51774 |
| CTCN_3496 | 37716 | TTCN_6883 | 51775 |
| TTCN_2848 | 37717 | CTCN_8268 | 51776 |
| CTCN_3497 | 37718 | ATCN_4727 | 51777 |
| ATCN_2058 | 37719 | CTCN_8269 | 51778 |
| ATCN_2059 | 37720 | TTCN_6884 | 51779 |
| GTCN_1859 | 37721 | ATCN_4728 | 51780 |
| CTCN_3498 | 37722 | TTCN_6885 | 51781 |
| CTCN_3499 | 37723 | CTCN_8270 | 51782 |
| GTCN_1860 | 37724 | CTCN_8271 | 51783 |
| CTCN_3500 | 37725 | TTCN_6886 | 51784 |
| ATCN_2060 | 37726 | ATCN_4729 | 51785 |
| ATCN_2061 | 37727 | ATCN_4730 | 51786 |

| | | | |
|---|---|---|---|
| CTCN_3501 | 37728 | CTCN_8272 | 51787 |
| CTCN_3502 | 37729 | TTCN_6887 | 51788 |
| CTCN_3503 | 37730 | TTCN_6888 | 51789 |
| ATCN_2062 | 37731 | TTCN_6889 | 51790 |
| TTCN_2849 | 37732 | ATCN_4731 | 51791 |
| CTCN_3504 | 37733 | ATCN_4732 | 51792 |
| TTCN_2850 | 37734 | TTCN_6890 | 51793 |
| CTCN_3505 | 37735 | ATCN_4733 | 51794 |
| ATCN_2063 | 37736 | TTCN_6891 | 51795 |
| CTCN_3506 | 37737 | TTCN_6892 | 51796 |
| GTCN_1861 | 37738 | GTCN_4442 | 51797 |
| TTCN_2851 | 37739 | TTCN_6893 | 51798 |
| CTCN_3507 | 37740 | GTCN_4443 | 51799 |
| CTCN_3508 | 37741 | ATCN_4734 | 51800 |
| CTCN_3509 | 37742 | ATCN_4735 | 51801 |
| CTCN_3510 | 37743 | TTCN_6894 | 51802 |
| TTCN_2852 | 37744 | ATCN_4736 | 51803 |
| ATCN_2064 | 37745 | GTCN_4444 | 51804 |
| GTCN_1862 | 37746 | TTCN_6895 | 51805 |
| GTCN_1863 | 37747 | CTCN_8273 | 51806 |
| CTCN_3511 | 37748 | TTCN_6896 | 51807 |
| CTCN_3512 | 37749 | TTCN_6897 | 51808 |
| CTCN_3513 | 37750 | CTCN_8274 | 51809 |
| ATCN_2065 | 37751 | CTCN_8275 | 51810 |
| CTCN_3514 | 37752 | ATCN_4737 | 51811 |
| ATCN_2066 | 37753 | CTCN_8276 | 51812 |
| CTCN_3515 | 37754 | ATCN_4738 | 51813 |
| CTCN_3516 | 37755 | ATCN_4739 | 51814 |
| TTCN_2853 | 37756 | CTCN_8277 | 51815 |
| ATCN_2067 | 37757 | GTCN_4445 | 51816 |
| TTCN_2854 | 37758 | ATCN_4740 | 51817 |
| TTCN_2855 | 37759 | ATCN_4741 | 51818 |
| TTCN_2856 | 37760 | CTCN_8278 | 51819 |
| CTCN_3517 | 37761 | TTCN_6898 | 51820 |
| GTCN_1864 | 37762 | CTCN_8279 | 51821 |
| ATCN_2068 | 37763 | TTCN_6899 | 51822 |
| ATCN_2069 | 37764 | GTCN_4446 | 51823 |
| CTCN_3518 | 37765 | ATCN_4742 | 51824 |
| TTCN_2857 | 37766 | TTCN_6900 | 51825 |
| CTCN_3519 | 37767 | CTCN_8280 | 51826 |
| GTCN_1865 | 37768 | GTCN_4447 | 51827 |
| TTCN_2858 | 37769 | CTCN_8281 | 51828 |
| GTCN_1866 | 37770 | CTCN_8282 | 51829 |

FIG. 37 (continued)

| | | | |
|---|---|---|---|
| TTCN_2859 | 37771 | GTCN_4448 | 51830 |
| ATCN_2070 | 37772 | ATCN_4743 | 51831 |
| ATCN_2071 | 37773 | CTCN_8283 | 51832 |
| TTCN_2860 | 37774 | CTCN_8284 | 51833 |
| CTCN_3520 | 37775 | CTCN_8285 | 51834 |
| GTCN_1867 | 37776 | CTCN_8286 | 51835 |
| ATCN_2072 | 37777 | TTCN_6901 | 51836 |
| GTCN_1868 | 37778 | ATCN_4744 | 51837 |
| CTCN_3521 | 37779 | TTCN_6902 | 51838 |
| CTCN_3522 | 37780 | CTCN_8287 | 51839 |
| CTCN_3523 | 37781 | CTCN_8288 | 51840 |
| TTCN_2861 | 37782 | CTCN_8289 | 51841 |
| ATCN_2073 | 37783 | ATCN_4745 | 51842 |
| TTCN_2862 | 37784 | CTCN_8290 | 51843 |
| TTCN_2863 | 37785 | CTCN_8291 | 51844 |
| GTCN_1869 | 37786 | GTCN_4449 | 51845 |
| CTCN_3524 | 37787 | CTCN_8292 | 51846 |
| CTCN_3525 | 37788 | CTCN_8293 | 51847 |
| ATCN_2074 | 37789 | CTCN_8294 | 51848 |
| CTCN_3526 | 37790 | TTCN_6903 | 51849 |
| ATCN_2075 | 37791 | TTCN_6904 | 51850 |
| ATCN_2076 | 37792 | TTCN_6905 | 51851 |
| CTCN_3527 | 37793 | TTCN_6906 | 51852 |
| GTCN_1870 | 37794 | CTCN_8295 | 51853 |
| CTCN_3528 | 37795 | TTCN_6907 | 51854 |
| TTCN_2864 | 37796 | TTCN_6908 | 51855 |
| TTCN_2865 | 37797 | TTCN_6909 | 51856 |
| GTCN_1871 | 37798 | ATCN_4746 | 51857 |
| TTCN_2866 | 37799 | CTCN_8296 | 51858 |
| ATCN_2077 | 37800 | ATCN_4747 | 51859 |
| CTCN_3529 | 37801 | GTCN_4450 | 51860 |
| TTCN_2867 | 37802 | ATCN_4748 | 51861 |
| CTCN_3530 | 37803 | TTCN_6910 | 51862 |
| TTCN_2868 | 37804 | TTCN_6911 | 51863 |
| TTCN_2869 | 37805 | TTCN_6912 | 51864 |
| ATCN_2078 | 37806 | CTCN_8297 | 51865 |
| CTCN_3531 | 37807 | TTCN_6913 | 51866 |
| CTCN_3532 | 37808 | CTCN_8298 | 51867 |
| CTCN_3533 | 37809 | GTCN_4451 | 51868 |
| ATCN_2079 | 37810 | ATCN_4749 | 51869 |
| CTCN_3534 | 37811 | CTCN_8299 | 51870 |
| GTCN_1872 | 37812 | GTCN_4452 | 51871 |
| CTCN_3535 | 37813 | TTCN_6914 | 51872 |

| | | | |
|---|---|---|---|
| CTCN_3536 | 37814 | TTCN_6915 | 51873 |
| GTCN_1873 | 37815 | GTCN_4453 | 51874 |
| CTCN_3537 | 37816 | GTCN_4454 | 51875 |
| GTCN_1874 | 37817 | GTCN_4455 | 51876 |
| CTCN_3538 | 37818 | ATCN_4750 | 51877 |
| TTCN_2870 | 37819 | TTCN_6916 | 51878 |
| TTCN_2871 | 37820 | CTCN_8300 | 51879 |
| CTCN_3539 | 37821 | CTCN_8301 | 51880 |
| GTCN_1875 | 37822 | CTCN_8302 | 51881 |
| CTCN_3540 | 37823 | TTCN_6917 | 51882 |
| TTCN_2872 | 37824 | GTCN_4456 | 51883 |
| CTCN_3541 | 37825 | ATCN_4751 | 51884 |
| TTCN_2873 | 37826 | TTCN_6918 | 51885 |
| CTCN_3542 | 37827 | CTCN_8303 | 51886 |
| CTCN_3543 | 37828 | TTCN_6919 | 51887 |
| CTCN_3544 | 37829 | TTCN_6920 | 51888 |
| TTCN_2874 | 37830 | TTCN_6921 | 51889 |
| TTCN_2875 | 37831 | CTCN_8304 | 51890 |
| CTCN_3545 | 37832 | CTCN_8305 | 51891 |
| TTCN_2876 | 37833 | TTCN_6922 | 51892 |
| TTCN_2877 | 37834 | CTCN_8306 | 51893 |
| CTCN_3546 | 37835 | TTCN_6923 | 51894 |
| CTCN_3547 | 37836 | TTCN_6924 | 51895 |
| CTCN_3548 | 37837 | TTCN_6925 | 51896 |
| GTCN_1876 | 37838 | CTCN_8307 | 51897 |
| TTCN_2878 | 37839 | TTCN_6926 | 51898 |
| TTCN_2879 | 37840 | CTCN_8308 | 51899 |
| CTCN_3549 | 37841 | TTCN_6927 | 51900 |
| CTCN_3550 | 37842 | TTCN_6928 | 51901 |
| CTCN_3551 | 37843 | TTCN_6929 | 51902 |
| CTCN_3552 | 37844 | TTCN_6930 | 51903 |
| CTCN_3553 | 37845 | GTCN_4457 | 51904 |
| TTCN_2880 | 37846 | TTCN_6931 | 51905 |
| CTCN_3554 | 37847 | CTCN_8309 | 51906 |
| CTCN_3555 | 37848 | ATCN_4752 | 51907 |
| TTCN_2881 | 37849 | ATCN_4753 | 51908 |
| TTCN_2882 | 37850 | ATCN_4754 | 51909 |
| TTCN_2883 | 37851 | TTCN_6932 | 51910 |
| ATCN_2080 | 37852 | CTCN_8310 | 51911 |
| GTCN_1877 | 37853 | ATCN_4755 | 51912 |
| TTCN_2884 | 37854 | TTCN_6933 | 51913 |
| ATCN_2081 | 37855 | CTCN_8311 | 51914 |
| GTCN_1878 | 37856 | CTCN_8312 | 51915 |

FIG. 37 (continued)

| | | | |
|---|---|---|---|
| GTCN_1879 | 37857 | CTCN_8313 | 51916 |
| ATCN_2082 | 37858 | ATCN_4756 | 51917 |
| TTCN_2885 | 37859 | ATCN_4757 | 51918 |
| GTCN_1880 | 37860 | CTCN_8314 | 51919 |
| GTCN_1881 | 37861 | CTCN_8315 | 51920 |
| TTCN_2886 | 37862 | GTCN_4458 | 51921 |
| GTCN_1882 | 37863 | GTCN_4459 | 51922 |
| ATCN_2083 | 37864 | GTCN_4460 | 51923 |
| TTCN_2887 | 37865 | CTCN_8316 | 51924 |
| CTCN_3556 | 37866 | CTCN_8317 | 51925 |
| ATCN_2084 | 37867 | CTCN_8318 | 51926 |
| TTCN_2888 | 37868 | GTCN_4461 | 51927 |
| CTCN_3557 | 37869 | CTCN_8319 | 51928 |
| ATCN_2085 | 37870 | TTCN_6934 | 51929 |
| CTCN_3558 | 37871 | TTCN_6935 | 51930 |
| ATCN_2086 | 37872 | CTCN_8320 | 51931 |
| ATCN_2087 | 37873 | CTCN_8321 | 51932 |
| CTCN_3559 | 37874 | TTCN_6936 | 51933 |
| GTCN_1883 | 37875 | CTCN_8322 | 51934 |
| CTCN_3560 | 37876 | CTCN_8323 | 51935 |
| TTCN_2889 | 37877 | GTCN_4462 | 51936 |
| GTCN_1884 | 37878 | GTCN_4463 | 51937 |
| TTCN_2890 | 37879 | GTCN_4464 | 51938 |
| GTCN_1885 | 37880 | CTCN_8324 | 51939 |
| CTCN_3561 | 37881 | GTCN_4465 | 51940 |
| ATCN_2088 | 37882 | CTCN_8325 | 51941 |
| CTCN_3562 | 37883 | TTCN_6937 | 51942 |
| CTCN_3563 | 37884 | CTCN_8326 | 51943 |
| GTCN_1886 | 37885 | TTCN_6938 | 51944 |
| CTCN_3564 | 37886 | CTCN_8327 | 51945 |
| TTCN_2891 | 37887 | CTCN_8328 | 51946 |
| ATCN_2089 | 37888 | TTCN_6939 | 51947 |
| TTCN_2892 | 37889 | CTCN_8329 | 51948 |
| CTCN_3565 | 37890 | TTCN_6940 | 51949 |
| CTCN_3566 | 37891 | TTCN_6941 | 51950 |
| CTCN_3567 | 37892 | TTCN_6942 | 51951 |
| ATCN_2090 | 37893 | TTCN_6943 | 51952 |
| TTCN_2893 | 37894 | TTCN_6944 | 51953 |
| CTCN_3568 | 37895 | TTCN_6945 | 51954 |
| CTCN_3569 | 37896 | CTCN_8330 | 51955 |
| GTCN_1887 | 37897 | TTCN_6946 | 51956 |
| CTCN_3570 | 37898 | GTCN_4466 | 51957 |
| TTCN_2894 | 37899 | TTCN_6947 | 51958 |

| | | | |
|---|---|---|---|
| TTCN_2895 | 37900 | TTCN_6948 | 51959 |
| ATCN_2091 | 37901 | TTCN_6949 | 51960 |
| ATCN_2092 | 37902 | CTCN_8331 | 51961 |
| TTCN_2896 | 37903 | GTCN_4467 | 51962 |
| GTCN_1888 | 37904 | TTCN_6950 | 51963 |
| ATCN_2093 | 37905 | ATCN_4758 | 51964 |
| ATCN_2094 | 37906 | TTCN_6951 | 51965 |
| ATCN_2095 | 37907 | CTCN_8332 | 51966 |
| ATCN_2096 | 37908 | CTCN_8333 | 51967 |
| GTCN_1889 | 37909 | GTCN_4468 | 51968 |
| ATCN_2097 | 37910 | TTCN_6952 | 51969 |
| GTCN_1890 | 37911 | CTCN_8334 | 51970 |
| GTCN_1891 | 37912 | CTCN_8335 | 51971 |
| CTCN_3571 | 37913 | CTCN_8336 | 51972 |
| TTCN_2897 | 37914 | CTCN_8337 | 51973 |
| CTCN_3572 | 37915 | CTCN_8338 | 51974 |
| GTCN_1892 | 37916 | CTCN_8339 | 51975 |
| CTCN_3573 | 37917 | GTCN_4469 | 51976 |
| CTCN_3574 | 37918 | GTCN_4470 | 51977 |
| ATCN_2098 | 37919 | GTCN_4471 | 51978 |
| CTCN_3575 | 37920 | CTCN_8340 | 51979 |
| CTCN_3576 | 37921 | CTCN_8341 | 51980 |
| ATCN_2099 | 37922 | CTCN_8342 | 51981 |
| GTCN_1893 | 37923 | GTCN_4472 | 51982 |
| GTCN_1894 | 37924 | GTCN_4473 | 51983 |
| ATCN_2100 | 37925 | CTCN_8343 | 51984 |
| ATCN_2101 | 37926 | CTCN_8344 | 51985 |
| TTCN_2898 | 37927 | TTCN_6953 | 51986 |
| CTCN_3577 | 37928 | CTCN_8345 | 51987 |
| CTCN_3578 | 37929 | TTCN_6954 | 51988 |
| TTCN_2899 | 37930 | GTCN_4474 | 51989 |
| TTCN_2900 | 37931 | CTCN_8346 | 51990 |
| CTCN_3579 | 37932 | TTCN_6955 | 51991 |
| CTCN_3580 | 37933 | TTCN_6956 | 51992 |
| CTCN_3581 | 37934 | CTCN_8347 | 51993 |
| CTCN_3582 | 37935 | GTCN_4475 | 51994 |
| CTCN_3583 | 37936 | GTCN_4476 | 51995 |
| GTCN_1895 | 37937 | TTCN_6957 | 51996 |
| TTCN_2901 | 37938 | GTCN_4477 | 51997 |
| TTCN_2902 | 37939 | CTCN_8348 | 51998 |
| CTCN_3584 | 37940 | TTCN_6958 | 51999 |
| TTCN_2903 | 37941 | CTCN_8349 | 52000 |
| CTCN_3585 | 37942 | GTCN_4478 | 52001 |

FIG. 37 (continued)

| | | | |
|---|---|---|---|
| CTCN_3586 | 37943 | TTCN_6959 | 52002 |
| TTCN_2904 | 37944 | GTCN_4479 | 52003 |
| TTCN_2905 | 37945 | CTCN_8350 | 52004 |
| CTCN_3587 | 37946 | TTCN_6960 | 52005 |
| ATCN_2102 | 37947 | GTCN_4480 | 52006 |
| TTCN_2906 | 37948 | CTCN_8351 | 52007 |
| TTCN_2907 | 37949 | CTCN_8352 | 52008 |
| TTCN_2908 | 37950 | TTCN_6961 | 52009 |
| TTCN_2909 | 37951 | TTCN_6962 | 52010 |
| GTCN_1896 | 37952 | TTCN_6963 | 52011 |
| TTCN_2910 | 37953 | GTCN_4481 | 52012 |
| ATCN_2103 | 37954 | CTCN_8353 | 52013 |
| ATCN_2104 | 37955 | GTCN_4482 | 52014 |
| CTCN_3588 | 37956 | CTCN_8354 | 52015 |
| CTCN_3589 | 37957 | CTCN_8355 | 52016 |
| ATCN_2105 | 37958 | GTCN_4483 | 52017 |
| CTCN_3590 | 37959 | GTCN_4484 | 52018 |
| TTCN_2911 | 37960 | TTCN_6964 | 52019 |
| TTCN_2912 | 37961 | CTCN_8356 | 52020 |
| CTCN_3591 | 37962 | ATCN_4759 | 52021 |
| ATCN_2106 | 37963 | ATCN_4760 | 52022 |
| ATCN_2107 | 37964 | CTCN_8357 | 52023 |
| CTCN_3592 | 37965 | GTCN_4485 | 52024 |
| TTCN_2913 | 37966 | CTCN_8358 | 52025 |
| GTCN_1897 | 37967 | TTCN_6965 | 52026 |
| TTCN_2914 | 37968 | CTCN_8359 | 52027 |
| CTCN_3593 | 37969 | TTCN_6966 | 52028 |
| GTCN_1898 | 37970 | CTCN_8360 | 52029 |
| CTCN_3594 | 37971 | CTCN_8361 | 52030 |
| TTCN_2915 | 37972 | CTCN_8362 | 52031 |
| TTCN_2916 | 37973 | GTCN_4486 | 52032 |
| ATCN_2108 | 37974 | TTCN_6967 | 52033 |
| CTCN_3595 | 37975 | CTCN_8363 | 52034 |
| GTCN_1899 | 37976 | ATCN_4761 | 52035 |
| TTCN_2917 | 37977 | GTCN_4487 | 52036 |
| CTCN_3596 | 37978 | CTCN_8364 | 52037 |
| ATCN_2109 | 37979 | GTCN_4488 | 52038 |
| TTCN_2918 | 37980 | CTCN_8365 | 52039 |
| TTCN_2919 | 37981 | TTCN_6968 | 52040 |
| ATCN_2110 | 37982 | CTCN_8366 | 52041 |
| CTCN_3597 | 37983 | CTCN_8367 | 52042 |
| CTCN_3598 | 37984 | TTCN_6969 | 52043 |
| CTCN_3599 | 37985 | ATCN_4762 | 52044 |

| | | | |
|---|---|---|---|
| GTCN_1900 | 37986 | CTCN_8368 | 52045 |
| ATCN_2111 | 37987 | CTCN_8369 | 52046 |
| ATCN_2112 | 37988 | CTCN_8370 | 52047 |
| CTCN_3600 | 37989 | CTCN_8371 | 52048 |
| GTCN_1901 | 37990 | GTCN_4489 | 52049 |
| CTCN_3601 | 37991 | GTCN_4490 | 52050 |
| CTCN_3602 | 37992 | GTCN_4491 | 52051 |
| TTCN_2920 | 37993 | ATCN_4763 | 52052 |
| TTCN_2921 | 37994 | TTCN_6970 | 52053 |
| GTCN_1902 | 37995 | CTCN_8372 | 52054 |
| CTCN_3603 | 37996 | CTCN_8373 | 52055 |
| ATCN_2113 | 37997 | CTCN_8374 | 52056 |
| CTCN_3604 | 37998 | GTCN_4492 | 52057 |
| CTCN_3605 | 37999 | CTCN_8375 | 52058 |
| CTCN_3606 | 38000 | CTCN_8376 | 52059 |
| TTCN_2922 | 38001 | CTCN_8377 | 52060 |
| TTCN_2923 | 38002 | TTCN_6971 | 52061 |
| TTCN_2924 | 38003 | CTCN_8378 | 52062 |
| CTCN_3607 | 38004 | CTCN_8379 | 52063 |
| GTCN_1903 | 38005 | GTCN_4493 | 52064 |
| CTCN_3608 | 38006 | CTCN_8380 | 52065 |
| ATCN_2114 | 38007 | CTCN_8381 | 52066 |
| CTCN_3609 | 38008 | ATCN_4764 | 52067 |
| GTCN_1904 | 38009 | ATCN_4765 | 52068 |
| CTCN_3610 | 38010 | CTCN_8382 | 52069 |
| GTCN_1905 | 38011 | CTCN_8383 | 52070 |
| CTCN_3611 | 38012 | CTCN_8384 | 52071 |
| GTCN_1906 | 38013 | TTCN_6972 | 52072 |
| CTCN_3612 | 38014 | CTCN_8385 | 52073 |
| TTCN_2925 | 38015 | CTCN_8386 | 52074 |
| TTCN_2926 | 38016 | TTCN_6973 | 52075 |
| TTCN_2927 | 38017 | GTCN_4494 | 52076 |
| CTCN_3613 | 38018 | CTCN_8387 | 52077 |
| CTCN_3614 | 38019 | GTCN_4495 | 52078 |
| CTCN_3615 | 38020 | GTCN_4496 | 52079 |
| GTCN_1907 | 38021 | CTCN_8388 | 52080 |
| ATCN_2115 | 38022 | GTCN_4497 | 52081 |
| CTCN_3616 | 38023 | ATCN_4766 | 52082 |
| ATCN_2116 | 38024 | TTCN_6974 | 52083 |
| GTCN_1908 | 38025 | CTCN_8389 | 52084 |
| TTCN_2928 | 38026 | CTCN_8390 | 52085 |
| ATCN_2117 | 38027 | CTCN_8391 | 52086 |
| TTCN_2929 | 38028 | ATCN_4767 | 52087 |

FIG. 37 (continued)

| | | | |
|---|---|---|---|
| CTCN_3617 | 38029 | ATCN_4768 | 52088 |
| GTCN_1909 | 38030 | TTCN_6975 | 52089 |
| ATCN_2118 | 38031 | CTCN_8392 | 52090 |
| TTCN_2930 | 38032 | CTCN_8393 | 52091 |
| TTCN_2931 | 38033 | CTCN_8394 | 52092 |
| TTCN_2932 | 38034 | CTCN_8395 | 52093 |
| ATCN_2119 | 38035 | CTCN_8396 | 52094 |
| CTCN_3618 | 38036 | CTCN_8397 | 52095 |
| CTCN_3619 | 38037 | CTCN_8398 | 52096 |
| TTCN_2933 | 38038 | CTCN_8399 | 52097 |
| TTCN_2934 | 38039 | CTCN_8400 | 52098 |
| CTCN_3620 | 38040 | GTCN_4498 | 52099 |
| ATCN_2120 | 38041 | GTCN_4499 | 52100 |
| GTCN_1910 | 38042 | CTCN_8401 | 52101 |
| TTCN_2935 | 38043 | ATCN_4769 | 52102 |
| CTCN_3621 | 38044 | TTCN_6976 | 52103 |
| ATCN_2121 | 38045 | CTCN_8402 | 52104 |
| TTCN_2936 | 38046 | ATCN_4770 | 52105 |
| CTCN_3622 | 38047 | CTCN_8403 | 52106 |
| GTCN_1911 | 38048 | CTCN_8404 | 52107 |
| CTCN_3623 | 38049 | GTCN_4500 | 52108 |
| CTCN_3624 | 38050 | CTCN_8405 | 52109 |
| ATCN_2122 | 38051 | ATCN_4771 | 52110 |
| TTCN_2937 | 38052 | ATCN_4772 | 52111 |
| CTCN_3625 | 38053 | CTCN_8406 | 52112 |
| CTCN_3626 | 38054 | CTCN_8407 | 52113 |
| GTCN_1912 | 38055 | GTCN_4501 | 52114 |
| CTCN_3627 | 38056 | CTCN_8408 | 52115 |
| ATCN_2123 | 38057 | TTCN_6977 | 52116 |
| GTCN_1913 | 38058 | CTCN_8409 | 52117 |
| TTCN_2938 | 38059 | GTCN_4502 | 52118 |
| TTCN_2939 | 38060 | TTCN_6978 | 52119 |
| ATCN_2124 | 38061 | GTCN_4503 | 52120 |
| GTCN_1914 | 38062 | CTCN_8410 | 52121 |
| GTCN_1915 | 38063 | ATCN_4773 | 52122 |
| TTCN_2940 | 38064 | CTCN_8411 | 52123 |
| TTCN_2941 | 38065 | CTCN_8412 | 52124 |
| TTCN_2942 | 38066 | CTCN_8413 | 52125 |
| ATCN_2125 | 38067 | CTCN_8414 | 52126 |
| TTCN_2943 | 38068 | TTCN_6979 | 52127 |
| ATCN_2126 | 38069 | ATCN_4774 | 52128 |
| TTCN_2944 | 38070 | TTCN_6980 | 52129 |
| CTCN_3628 | 38071 | CTCN_8415 | 52130 |

| | | | |
|---|---|---|---|
| TTCN_2945 | 38072 | ATCN_4775 | 52131 |
| ATCN_2127 | 38073 | CTCN_8416 | 52132 |
| ATCN_2128 | 38074 | CTCN_8417 | 52133 |
| ATCN_2129 | 38075 | CTCN_8418 | 52134 |
| TTCN_2946 | 38076 | CTCN_8419 | 52135 |
| ATCN_2130 | 38077 | GTCN_4504 | 52136 |
| TTCN_2947 | 38078 | GTCN_4505 | 52137 |
| TTCN_2948 | 38079 | GTCN_4506 | 52138 |
| TTCN_2949 | 38080 | ATCN_4776 | 52139 |
| ATCN_2131 | 38081 | TTCN_6981 | 52140 |
| ATCN_2132 | 38082 | TTCN_6982 | 52141 |
| TTCN_2950 | 38083 | CTCN_8420 | 52142 |
| TTCN_2951 | 38084 | CTCN_8421 | 52143 |
| ATCN_2133 | 38085 | GTCN_4507 | 52144 |
| TTCN_2952 | 38086 | GTCN_4508 | 52145 |
| TTCN_2953 | 38087 | CTCN_8422 | 52146 |
| ATCN_2134 | 38088 | ATCN_4777 | 52147 |
| ATCN_2135 | 38089 | CTCN_8423 | 52148 |
| GTCN_1916 | 38090 | TTCN_6983 | 52149 |
| ATCN_2136 | 38091 | TTCN_6984 | 52150 |
| CTCN_3629 | 38092 | TTCN_6985 | 52151 |
| ATCN_2137 | 38093 | GTCN_4509 | 52152 |
| ATCN_2138 | 38094 | CTCN_8424 | 52153 |
| ATCN_2139 | 38095 | CTCN_8425 | 52154 |
| TTCN_2954 | 38096 | TTCN_6986 | 52155 |
| TTCN_2955 | 38097 | CTCN_8426 | 52156 |
| ATCN_2140 | 38098 | CTCN_8427 | 52157 |
| CTCN_3630 | 38099 | ATCN_4778 | 52158 |
| TTCN_2956 | 38100 | ATCN_4779 | 52159 |
| ATCN_2141 | 38101 | GTCN_4510 | 52160 |
| TTCN_2957 | 38102 | ATCN_4780 | 52161 |
| ATCN_2142 | 38103 | CTCN_8428 | 52162 |
| CTCN_3631 | 38104 | GTCN_4511 | 52163 |
| GTCN_1917 | 38105 | TTCN_6987 | 52164 |
| CTCN_3632 | 38106 | GTCN_4512 | 52165 |
| TTCN_2958 | 38107 | GTCN_4513 | 52166 |
| TTCN_2959 | 38108 | TTCN_6988 | 52167 |
| CTCN_3633 | 38109 | ATCN_4781 | 52168 |
| TTCN_2960 | 38110 | TTCN_6989 | 52169 |
| CTCN_3634 | 38111 | CTCN_8429 | 52170 |
| CTCN_3635 | 38112 | TTCN_6990 | 52171 |
| GTCN_1918 | 38113 | CTCN_8430 | 52172 |
| CTCN_3636 | 38114 | CTCN_8431 | 52173 |

FIG. 37 (continued)

| | | | |
|---|---|---|---|
| GTCN_1919 | 38115 | TTCN_6991 | 52174 |
| CTCN_3637 | 38116 | ATCN_4782 | 52175 |
| GTCN_1920 | 38117 | GTCN_4514 | 52176 |
| TTCN_2961 | 38118 | TTCN_6992 | 52177 |
| GTCN_1921 | 38119 | ATCN_4783 | 52178 |
| GTCN_1922 | 38120 | TTCN_6993 | 52179 |
| GTCN_1923 | 38121 | TTCN_6994 | 52180 |
| TTCN_2962 | 38122 | CTCN_8432 | 52181 |
| ATCN_2143 | 38123 | GTCN_4515 | 52182 |
| TTCN_2963 | 38124 | TTCN_6995 | 52183 |
| GTCN_1924 | 38125 | TTCN_6996 | 52184 |
| TTCN_2964 | 38126 | CTCN_8433 | 52185 |
| ATCN_2144 | 38127 | ATCN_4784 | 52186 |
| TTCN_2965 | 38128 | ATCN_4785 | 52187 |
| CTCN_3638 | 38129 | GTCN_4516 | 52188 |
| CTCN_3639 | 38130 | CTCN_8434 | 52189 |
| CTCN_3640 | 38131 | CTCN_8435 | 52190 |
| CTCN_3641 | 38132 | ATCN_4786 | 52191 |
| TTCN_2966 | 38133 | ATCN_4787 | 52192 |
| CTCN_3642 | 38134 | GTCN_4517 | 52193 |
| CTCN_3643 | 38135 | TTCN_6997 | 52194 |
| ATCN_2145 | 38136 | GTCN_4518 | 52195 |
| TTCN_2967 | 38137 | GTCN_4519 | 52196 |
| ATCN_2146 | 38138 | ATCN_4788 | 52197 |
| CTCN_3644 | 38139 | ATCN_4789 | 52198 |
| CTCN_3645 | 38140 | TTCN_6998 | 52199 |
| CTCN_3646 | 38141 | CTCN_8436 | 52200 |
| CTCN_3647 | 38142 | ATCN_4790 | 52201 |
| GTCN_1925 | 38143 | TTCN_6999 | 52202 |
| GTCN_1926 | 38144 | GTCN_4520 | 52203 |
| CTCN_3648 | 38145 | TTCN_7000 | 52204 |
| GTCN_1927 | 38146 | CTCN_8437 | 52205 |
| CTCN_3649 | 38147 | CTCN_8438 | 52206 |
| CTCN_3650 | 38148 | CTCN_8439 | 52207 |
| CTCN_3651 | 38149 | CTCN_8440 | 52208 |
| ATCN_2147 | 38150 | ATCN_4791 | 52209 |
| ATCN_2148 | 38151 | CTCN_8441 | 52210 |
| TTCN_2968 | 38152 | TTCN_7001 | 52211 |
| ATCN_2149 | 38153 | CTCN_8442 | 52212 |
| TTCN_2969 | 38154 | ATCN_4792 | 52213 |
| TTCN_2970 | 38155 | TTCN_7002 | 52214 |
| TTCN_2971 | 38156 | TTCN_7003 | 52215 |
| CTCN_3652 | 38157 | CTCN_8443 | 52216 |

| | | | |
|---|---|---|---|
| ATCN_2150 | 38158 | TTCN_7004 | 52217 |
| TTCN_2972 | 38159 | GTCN_4521 | 52218 |
| CTCN_3653 | 38160 | TTCN_7005 | 52219 |
| TTCN_2973 | 38161 | GTCN_4522 | 52220 |
| CTCN_3654 | 38162 | ATCN_4793 | 52221 |
| TTCN_2974 | 38163 | GTCN_4523 | 52222 |
| TTCN_2975 | 38164 | ATCN_4794 | 52223 |
| CTCN_3655 | 38165 | GTCN_4524 | 52224 |
| CTCN_3656 | 38166 | CTCN_8444 | 52225 |
| CTCN_3657 | 38167 | TTCN_7006 | 52226 |
| CTCN_3658 | 38168 | CTCN_8445 | 52227 |
| CTCN_3659 | 38169 | GTCN_4525 | 52228 |
| TTCN_2976 | 38170 | TTCN_7007 | 52229 |
| CTCN_3660 | 38171 | ATCN_4795 | 52230 |
| TTCN_2977 | 38172 | TTCN_7008 | 52231 |
| CTCN_3661 | 38173 | GTCN_4526 | 52232 |
| CTCN_3662 | 38174 | CTCN_8446 | 52233 |
| CTCN_3663 | 38175 | TTCN_7009 | 52234 |
| ATCN_2151 | 38176 | TTCN_7010 | 52235 |
| CTCN_3664 | 38177 | GTCN_4527 | 52236 |
| CTCN_3665 | 38178 | ATCN_4796 | 52237 |
| GTCN_1928 | 38179 | TTCN_7011 | 52238 |
| TTCN_2978 | 38180 | ATCN_4797 | 52239 |
| CTCN_3666 | 38181 | GTCN_4528 | 52240 |
| TTCN_2979 | 38182 | CTCN_8447 | 52241 |
| CTCN_3667 | 38183 | TTCN_7012 | 52242 |
| GTCN_1929 | 38184 | ATCN_4798 | 52243 |
| CTCN_3668 | 38185 | ATCN_4799 | 52244 |
| GTCN_1930 | 38186 | TTCN_7013 | 52245 |
| TTCN_2980 | 38187 | TTCN_7014 | 52246 |
| CTCN_3669 | 38188 | TTCN_7015 | 52247 |
| CTCN_3670 | 38189 | CTCN_8448 | 52248 |
| CTCN_3671 | 38190 | TTCN_7016 | 52249 |
| TTCN_2981 | 38191 | CTCN_8449 | 52250 |
| CTCN_3672 | 38192 | ATCN_4800 | 52251 |
| TTCN_2982 | 38193 | CTCN_8450 | 52252 |
| ATCN_2152 | 38194 | CTCN_8451 | 52253 |
| GTCN_1931 | 38195 | TTCN_7017 | 52254 |
| CTCN_3673 | 38196 | TTCN_7018 | 52255 |
| TTCN_2983 | 38197 | CTCN_8452 | 52256 |
| GTCN_1932 | 38198 | TTCN_7019 | 52257 |
| ATCN_2153 | 38199 | ATCN_4801 | 52258 |
| GTCN_1933 | 38200 | ATCN_4802 | 52259 |

FIG. 37 (continued)

| | | | | | | | |
|---|---|---|---|---|---|---|---|
| CTCN_3674 | 38201 | CTCN_8453 | 52260 | TTCN_2993 | 38244 | TTCN_7034 | 52303 |
| TTCN_2984 | 38202 | CTCN_8454 | 52261 | TTCN_2994 | 38245 | CTCN_8464 | 52304 |
| TTCN_2985 | 38203 | CTCN_8455 | 52262 | ATCN_2161 | 38246 | TTCN_7035 | 52305 |
| CTCN_3675 | 38204 | ATCN_4803 | 52263 | GTCN_1941 | 38247 | ATCN_4811 | 52306 |
| ATCN_2154 | 38205 | ATCN_4804 | 52264 | TTCN_2995 | 38248 | TTCN_7036 | 52307 |
| CTCN_3676 | 38206 | CTCN_8456 | 52265 | CTCN_3694 | 38249 | GTCN_4539 | 52308 |
| CTCN_3677 | 38207 | GTCN_4529 | 52266 | TTCN_2996 | 38250 | TTCN_7037 | 52309 |
| CTCN_3678 | 38208 | TTCN_7020 | 52267 | GTCN_1942 | 38251 | CTCN_8465 | 52310 |
| CTCN_3679 | 38209 | TTCN_7021 | 52268 | GTCN_1943 | 38252 | CTCN_8466 | 52311 |
| CTCN_3680 | 38210 | TTCN_7022 | 52269 | ATCN_2162 | 38253 | ATCN_4812 | 52312 |
| CTCN_3681 | 38211 | ATCN_4805 | 52270 | GTCN_1944 | 38254 | TTCN_7038 | 52313 |
| GTCN_1934 | 38212 | CTCN_8457 | 52271 | TTCN_2997 | 38255 | TTCN_7039 | 52314 |
| CTCN_3682 | 38213 | CTCN_8458 | 52272 | GTCN_1945 | 38256 | ATCN_4813 | 52315 |
| TTCN_2986 | 38214 | TTCN_7023 | 52273 | TTCN_2998 | 38257 | GTCN_4540 | 52316 |
| ATCN_2155 | 38215 | GTCN_4530 | 52274 | ATCN_2163 | 38258 | CTCN_8467 | 52317 |
| CTCN_3683 | 38216 | CTCN_8459 | 52275 | TTCN_2999 | 38259 | ATCN_4814 | 52318 |
| CTCN_3684 | 38217 | GTCN_4531 | 52276 | CTCN_3695 | 38260 | CTCN_8468 | 52319 |
| GTCN_1935 | 38218 | CTCN_8460 | 52277 | GTCN_1946 | 38261 | CTCN_8469 | 52320 |
| ATCN_2156 | 38219 | TTCN_7024 | 52278 | CTCN_3696 | 38262 | CTCN_8470 | 52321 |
| TTCN_2987 | 38220 | TTCN_7025 | 52279 | ATCN_2164 | 38263 | TTCN_7040 | 52322 |
| TTCN_2988 | 38221 | TTCN_7026 | 52280 | CTCN_3697 | 38264 | ATCN_4815 | 52323 |
| GTCN_1936 | 38222 | GTCN_4532 | 52281 | TTCN_3000 | 38265 | ATCN_4816 | 52324 |
| CTCN_3685 | 38223 | CTCN_8461 | 52282 | CTCN_3698 | 38266 | TTCN_7041 | 52325 |
| GTCN_1937 | 38224 | ATCN_4806 | 52283 | TTCN_3001 | 38267 | CTCN_8471 | 52326 |
| GTCN_1938 | 38225 | CTCN_8462 | 52284 | GTCN_1947 | 38268 | TTCN_7042 | 52327 |
| CTCN_3686 | 38226 | GTCN_4533 | 52285 | ATCN_2165 | 38269 | TTCN_7043 | 52328 |
| GTCN_1939 | 38227 | TTCN_7027 | 52286 | CTCN_3699 | 38270 | ATCN_4817 | 52329 |
| GTCN_1940 | 38228 | ATCN_4807 | 52287 | TTCN_3002 | 38271 | TTCN_7044 | 52330 |
| CTCN_3687 | 38229 | ATCN_4808 | 52288 | GTCN_1948 | 38272 | TTCN_7045 | 52331 |
| CTCN_3688 | 38230 | CTCN_8463 | 52289 | ATCN_2166 | 38273 | GTCN_4541 | 52332 |
| ATCN_2157 | 38231 | TTCN_7028 | 52290 | TTCN_3003 | 38274 | CTCN_8472 | 52333 |
| ATCN_2158 | 38232 | TTCN_7029 | 52291 | ATCN_2167 | 38275 | GTCN_4542 | 52334 |
| ATCN_2159 | 38233 | GTCN_4534 | 52292 | CTCN_3700 | 38276 | CTCN_8473 | 52335 |
| ATCN_2160 | 38234 | TTCN_7030 | 52293 | GTCN_1949 | 38277 | ATCN_4818 | 52336 |
| CTCN_3689 | 38235 | TTCN_7031 | 52294 | GTCN_1950 | 38278 | ATCN_4819 | 52337 |
| CTCN_3690 | 38236 | GTCN_4535 | 52295 | CTCN_3701 | 38279 | TTCN_7046 | 52338 |
| CTCN_3691 | 38237 | GTCN_4536 | 52296 | TTCN_3004 | 38280 | ATCN_4820 | 52339 |
| CTCN_3692 | 38238 | ATCN_4809 | 52297 | ATCN_2168 | 38281 | TTCN_7047 | 52340 |
| TTCN_2989 | 38239 | ATCN_4810 | 52298 | ATCN_2169 | 38282 | CTCN_8474 | 52341 |
| CTCN_3693 | 38240 | TTCN_7032 | 52299 | CTCN_3702 | 38283 | GTCN_4543 | 52342 |
| TTCN_2990 | 38241 | GTCN_4537 | 52300 | CTCN_3703 | 38284 | ATCN_4821 | 52343 |
| TTCN_2991 | 38242 | TTCN_7033 | 52301 | TTCN_3005 | 38285 | CTCN_8475 | 52344 |
| TTCN_2992 | 38243 | GTCN_4538 | 52302 | CTCN_3704 | 38286 | GTCN_4544 | 52345 |

FIG. 37 (continued)

| | | | | | | | |
|---|---|---|---|---|---|---|---|
| GTCN_1951 | 38287 | TTCN_7048 | 52346 | CTCN_3720 | 38330 | CTCN_8499 | 52389 |
| CTCN_3705 | 38288 | CTCN_8476 | 52347 | CTCN_3721 | 38331 | CTCN_8500 | 52390 |
| TTCN_3006 | 38289 | GTCN_4545 | 52348 | CTCN_3722 | 38332 | CTCN_8501 | 52391 |
| CTCN_3706 | 38290 | GTCN_4546 | 52349 | TTCN_3021 | 38333 | CTCN_8502 | 52392 |
| CTCN_3707 | 38291 | TTCN_7049 | 52350 | GTCN_1956 | 38334 | CTCN_8503 | 52393 |
| CTCN_3708 | 38292 | CTCN_8477 | 52351 | CTCN_3723 | 38335 | CTCN_8504 | 52394 |
| ATCN_2170 | 38293 | GTCN_4547 | 52352 | ATCN_2178 | 38336 | GTCN_4555 | 52395 |
| CTCN_3709 | 38294 | CTCN_8478 | 52353 | ATCN_2179 | 38337 | CTCN_8505 | 52396 |
| TTCN_3007 | 38295 | CTCN_8479 | 52354 | ATCN_2180 | 38338 | TTCN_7054 | 52397 |
| TTCN_3008 | 38296 | CTCN_8480 | 52355 | TTCN_3022 | 38339 | CTCN_8506 | 52398 |
| GTCN_1952 | 38297 | TTCN_7050 | 52356 | TTCN_3023 | 38340 | GTCN_4556 | 52399 |
| TTCN_3009 | 38298 | CTCN_8481 | 52357 | GTCN_1957 | 38341 | CTCN_8507 | 52400 |
| ATCN_2171 | 38299 | ATCN_4822 | 52358 | TTCN_3024 | 38342 | GTCN_4557 | 52401 |
| CTCN_3710 | 38300 | CTCN_8482 | 52359 | CTCN_3724 | 38343 | CTCN_8508 | 52402 |
| ATCN_2172 | 38301 | GTCN_4548 | 52360 | TTCN_3025 | 38344 | TTCN_7055 | 52403 |
| CTCN_3711 | 38302 | CTCN_8483 | 52361 | GTCN_1958 | 38345 | CTCN_8509 | 52404 |
| CTCN_3712 | 38303 | CTCN_8484 | 52362 | CTCN_3725 | 38346 | CTCN_8510 | 52405 |
| TTCN_3010 | 38304 | CTCN_8485 | 52363 | TTCN_3026 | 38347 | GTCN_4558 | 52406 |
| TTCN_3011 | 38305 | CTCN_8486 | 52364 | GTCN_1959 | 38348 | TTCN_7056 | 52407 |
| TTCN_3012 | 38306 | ATCN_4823 | 52365 | TTCN_3027 | 38349 | ATCN_4826 | 52408 |
| CTCN_3713 | 38307 | ATCN_4824 | 52366 | ATCN_2181 | 38350 | ATCN_4827 | 52409 |
| TTCN_3013 | 38308 | CTCN_8487 | 52367 | CTCN_3726 | 38351 | GTCN_4559 | 52410 |
| GTCN_1953 | 38309 | CTCN_8488 | 52368 | TTCN_3028 | 38352 | CTCN_8511 | 52411 |
| ATCN_2173 | 38310 | TTCN_7051 | 52369 | TTCN_3029 | 38353 | TTCN_7057 | 52412 |
| TTCN_3014 | 38311 | CTCN_8489 | 52370 | CTCN_3727 | 38354 | GTCN_4560 | 52413 |
| TTCN_3015 | 38312 | GTCN_4549 | 52371 | TTCN_3030 | 38355 | CTCN_8512 | 52414 |
| TTCN_3016 | 38313 | ATCN_4825 | 52372 | GTCN_1960 | 38356 | CTCN_8513 | 52415 |
| CTCN_3714 | 38314 | CTCN_8490 | 52373 | GTCN_1961 | 38357 | ATCN_4828 | 52416 |
| CTCN_3715 | 38315 | CTCN_8491 | 52374 | CTCN_3728 | 38358 | CTCN_8514 | 52417 |
| CTCN_3716 | 38316 | GTCN_4550 | 52375 | CTCN_3729 | 38359 | ATCN_4829 | 52418 |
| ATCN_2174 | 38317 | GTCN_4551 | 52376 | CTCN_3730 | 38360 | ATCN_4830 | 52419 |
| CTCN_3717 | 38318 | GTCN_4552 | 52377 | CTCN_3731 | 38361 | CTCN_8515 | 52420 |
| CTCN_3718 | 38319 | CTCN_8492 | 52378 | CTCN_3732 | 38362 | TTCN_7058 | 52421 |
| GTCN_1954 | 38320 | CTCN_8493 | 52379 | GTCN_1962 | 38363 | CTCN_8516 | 52422 |
| ATCN_2175 | 38321 | CTCN_8494 | 52380 | ATCN_2182 | 38364 | CTCN_8517 | 52423 |
| ATCN_2176 | 38322 | CTCN_8495 | 52381 | CTCN_3733 | 38365 | GTCN_4561 | 52424 |
| TTCN_3017 | 38323 | GTCN_4553 | 52382 | TTCN_3031 | 38366 | GTCN_4562 | 52425 |
| ATCN_2177 | 38324 | TTCN_7052 | 52383 | ATCN_2183 | 38367 | GTCN_4563 | 52426 |
| TTCN_3018 | 38325 | CTCN_8496 | 52384 | CTCN_3734 | 38368 | CTCN_8518 | 52427 |
| TTCN_3019 | 38326 | CTCN_8497 | 52385 | TTCN_3032 | 38369 | ATCN_4831 | 52428 |
| GTCN_1955 | 38327 | CTCN_8498 | 52386 | CTCN_3735 | 38370 | CTCN_8519 | 52429 |
| CTCN_3719 | 38328 | TTCN_7053 | 52387 | ATCN_2184 | 38371 | CTCN_8520 | 52430 |
| TTCN_3020 | 38329 | GTCN_4554 | 52388 | CTCN_3736 | 38372 | CTCN_8521 | 52431 |

FIG. 37 (continued)

| | | | |
|---|---|---|---|
| CTCN_3737 | 38373 | CTCN_8522 | 52432 |
| TTCN_3033 | 38374 | TTCN_7059 | 52433 |
| TTCN_3034 | 38375 | ATCN_4832 | 52434 |
| TTCN_3035 | 38376 | TTCN_7060 | 52435 |
| CTCN_3738 | 38377 | CTCN_8523 | 52436 |
| ATCN_2185 | 38378 | CTCN_8524 | 52437 |
| TTCN_3036 | 38379 | CTCN_8525 | 52438 |
| CTCN_3739 | 38380 | CTCN_8526 | 52439 |
| GTCN_1963 | 38381 | ATCN_4833 | 52440 |
| TTCN_3037 | 38382 | CTCN_8527 | 52441 |
| TTCN_3038 | 38383 | CTCN_8528 | 52442 |
| CTCN_3740 | 38384 | CTCN_8529 | 52443 |
| TTCN_3039 | 38385 | ATCN_4834 | 52444 |
| GTCN_1964 | 38386 | CTCN_8530 | 52445 |
| TTCN_3040 | 38387 | GTCN_4564 | 52446 |
| TTCN_3041 | 38388 | CTCN_8531 | 52447 |
| TTCN_3042 | 38389 | CTCN_8532 | 52448 |
| TTCN_3043 | 38390 | GTCN_4565 | 52449 |
| TTCN_3044 | 38391 | GTCN_4566 | 52450 |
| ATCN_2186 | 38392 | ATCN_4835 | 52451 |
| ATCN_2187 | 38393 | TTCN_7061 | 52452 |
| TTCN_3045 | 38394 | GTCN_4567 | 52453 |
| CTCN_3741 | 38395 | TTCN_7062 | 52454 |
| TTCN_3046 | 38396 | CTCN_8533 | 52455 |
| ATCN_2188 | 38397 | GTCN_4568 | 52456 |
| TTCN_3047 | 38398 | CTCN_8534 | 52457 |
| TTCN_3048 | 38399 | CTCN_8535 | 52458 |
| CTCN_3742 | 38400 | GTCN_4569 | 52459 |
| GTCN_1965 | 38401 | TTCN_7063 | 52460 |
| TTCN_3049 | 38402 | GTCN_4570 | 52461 |
| TTCN_3050 | 38403 | GTCN_4571 | 52462 |
| TTCN_3051 | 38404 | ATCN_4836 | 52463 |
| TTCN_3052 | 38405 | CTCN_8536 | 52464 |
| CTCN_3743 | 38406 | CTCN_8537 | 52465 |
| CTCN_3744 | 38407 | CTCN_8538 | 52466 |
| GTCN_1966 | 38408 | CTCN_8539 | 52467 |
| TTCN_3053 | 38409 | CTCN_8540 | 52468 |
| TTCN_3054 | 38410 | CTCN_8541 | 52469 |
| TTCN_3055 | 38411 | TTCN_7064 | 52470 |
| ATCN_2189 | 38412 | TTCN_7065 | 52471 |
| TTCN_3056 | 38413 | ATCN_4837 | 52472 |
| TTCN_3057 | 38414 | GTCN_4572 | 52473 |
| ATCN_2190 | 38415 | GTCN_4573 | 52474 |

| | | | |
|---|---|---|---|
| CTCN_3745 | 38416 | CTCN_8542 | 52475 |
| GTCN_1967 | 38417 | CTCN_8543 | 52476 |
| TTCN_3058 | 38418 | CTCN_8544 | 52477 |
| TTCN_3059 | 38419 | CTCN_8545 | 52478 |
| CTCN_3746 | 38420 | TTCN_7066 | 52479 |
| CTCN_3747 | 38421 | CTCN_8546 | 52480 |
| GTCN_1968 | 38422 | TTCN_7067 | 52481 |
| ATCN_2191 | 38423 | TTCN_7068 | 52482 |
| GTCN_1969 | 38424 | TTCN_7069 | 52483 |
| ATCN_2192 | 38425 | TTCN_7070 | 52484 |
| TTCN_3060 | 38426 | GTCN_4574 | 52485 |
| CTCN_3748 | 38427 | TTCN_7071 | 52486 |
| ATCN_2193 | 38428 | CTCN_8547 | 52487 |
| CTCN_3749 | 38429 | CTCN_8548 | 52488 |
| TTCN_3061 | 38430 | CTCN_8549 | 52489 |
| GTCN_1970 | 38431 | CTCN_8550 | 52490 |
| CTCN_3750 | 38432 | ATCN_4838 | 52491 |
| GTCN_1971 | 38433 | ATCN_4839 | 52492 |
| GTCN_1972 | 38434 | CTCN_8551 | 52493 |
| CTCN_3751 | 38435 | GTCN_4575 | 52494 |
| TTCN_3062 | 38436 | ATCN_4840 | 52495 |
| TTCN_3063 | 38437 | GTCN_4576 | 52496 |
| CTCN_3752 | 38438 | TTCN_7072 | 52497 |
| CTCN_3753 | 38439 | ATCN_4841 | 52498 |
| TTCN_3064 | 38440 | GTCN_4577 | 52499 |
| GTCN_1973 | 38441 | ATCN_4842 | 52500 |
| ATCN_2194 | 38442 | GTCN_4578 | 52501 |
| CTCN_3754 | 38443 | CTCN_8552 | 52502 |
| TTCN_3065 | 38444 | CTCN_8553 | 52503 |
| CTCN_3755 | 38445 | GTCN_4579 | 52504 |
| GTCN_1974 | 38446 | TTCN_7073 | 52505 |
| CTCN_3756 | 38447 | CTCN_8554 | 52506 |
| CTCN_3757 | 38448 | CTCN_8555 | 52507 |
| CTCN_3758 | 38449 | CTCN_8556 | 52508 |
| GTCN_1975 | 38450 | ATCN_4843 | 52509 |
| ATCN_2195 | 38451 | CTCN_8557 | 52510 |
| CTCN_3759 | 38452 | GTCN_4580 | 52511 |
| CTCN_3760 | 38453 | TTCN_7074 | 52512 |
| TTCN_3066 | 38454 | TTCN_7075 | 52513 |
| ATCN_2196 | 38455 | TTCN_7076 | 52514 |
| GTCN_1976 | 38456 | CTCN_8558 | 52515 |
| CTCN_3761 | 38457 | CTCN_8559 | 52516 |
| CTCN_3762 | 38458 | ATCN_4844 | 52517 |

FIG. 37 (continued)

| | | | |
|---|---|---|---|
| TTCN_3067 | 38459 | CTCN_8560 | 52518 |
| CTCN_3763 | 38460 | CTCN_8561 | 52519 |
| TTCN_3068 | 38461 | ATCN_4845 | 52520 |
| CTCN_3764 | 38462 | ATCN_4846 | 52521 |
| GTCN_1977 | 38463 | ATCN_4847 | 52522 |
| CTCN_3765 | 38464 | GTCN_4581 | 52523 |
| GTCN_1978 | 38465 | TTCN_7077 | 52524 |
| ATCN_2197 | 38466 | CTCN_8562 | 52525 |
| ATCN_2198 | 38467 | CTCN_8563 | 52526 |
| TTCN_3069 | 38468 | CTCN_8564 | 52527 |
| ATCN_2199 | 38469 | TTCN_7078 | 52528 |
| TTCN_3070 | 38470 | CTCN_8565 | 52529 |
| ATCN_2200 | 38471 | TTCN_7079 | 52530 |
| TTCN_3071 | 38472 | GTCN_4582 | 52531 |
| GTCN_1979 | 38473 | GTCN_4583 | 52532 |
| CTCN_3766 | 38474 | CTCN_8566 | 52533 |
| CTCN_3767 | 38475 | ATCN_4848 | 52534 |
| CTCN_3768 | 38476 | TTCN_7080 | 52535 |
| ATCN_2201 | 38477 | ATCN_4849 | 52536 |
| CTCN_3769 | 38478 | ATCN_4850 | 52537 |
| CTCN_3770 | 38479 | ATCN_4851 | 52538 |
| TTCN_3072 | 38480 | CTCN_8567 | 52539 |
| GTCN_1980 | 38481 | CTCN_8568 | 52540 |
| TTCN_3073 | 38482 | CTCN_8569 | 52541 |
| GTCN_1981 | 38483 | ATCN_4852 | 52542 |
| TTCN_3074 | 38484 | CTCN_8570 | 52543 |
| GTCN_1982 | 38485 | ATCN_4853 | 52544 |
| CTCN_3771 | 38486 | ATCN_4854 | 52545 |
| CTCN_3772 | 38487 | TTCN_7081 | 52546 |
| GTCN_1983 | 38488 | CTCN_8571 | 52547 |
| TTCN_3075 | 38489 | TTCN_7082 | 52548 |
| CTCN_3773 | 38490 | TTCN_7083 | 52549 |
| CTCN_3774 | 38491 | TTCN_7084 | 52550 |
| TTCN_3076 | 38492 | GTCN_4584 | 52551 |
| TTCN_3077 | 38493 | ATCN_4855 | 52552 |
| TTCN_3078 | 38494 | TTCN_7085 | 52553 |
| TTCN_3079 | 38495 | GTCN_4585 | 52554 |
| ATCN_2202 | 38496 | ATCN_4856 | 52555 |
| TTCN_3080 | 38497 | TTCN_7086 | 52556 |
| GTCN_1984 | 38498 | CTCN_8572 | 52557 |
| TTCN_3081 | 38499 | TTCN_7087 | 52558 |
| CTCN_3775 | 38500 | TTCN_7088 | 52559 |
| ATCN_2203 | 38501 | TTCN_7089 | 52560 |

| | | | |
|---|---|---|---|
| ATCN_2204 | 38502 | GTCN_4586 | 52561 |
| ATCN_2205 | 38503 | TTCN_7090 | 52562 |
| ATCN_2206 | 38504 | TTCN_7091 | 52563 |
| GTCN_1985 | 38505 | CTCN_8573 | 52564 |
| TTCN_3082 | 38506 | GTCN_4587 | 52565 |
| TTCN_3083 | 38507 | ATCN_4857 | 52566 |
| TTCN_3084 | 38508 | CTCN_8574 | 52567 |
| CTCN_3776 | 38509 | TTCN_7092 | 52568 |
| TTCN_3085 | 38510 | CTCN_8575 | 52569 |
| ATCN_2207 | 38511 | ATCN_4858 | 52570 |
| ATCN_2208 | 38512 | ATCN_4859 | 52571 |
| ATCN_2209 | 38513 | CTCN_8576 | 52572 |
| ATCN_2210 | 38514 | CTCN_8577 | 52573 |
| ATCN_2211 | 38515 | GTCN_4588 | 52574 |
| ATCN_2212 | 38516 | GTCN_4589 | 52575 |
| TTCN_3086 | 38517 | GTCN_4590 | 52576 |
| TTCN_3087 | 38518 | TTCN_7093 | 52577 |
| ATCN_2213 | 38519 | GTCN_4591 | 52578 |
| TTCN_3088 | 38520 | TTCN_7094 | 52579 |
| ATCN_2214 | 38521 | CTCN_8578 | 52580 |
| TTCN_3089 | 38522 | CTCN_8579 | 52581 |
| TTCN_3090 | 38523 | GTCN_4592 | 52582 |
| CTCN_3777 | 38524 | TTCN_7095 | 52583 |
| CTCN_3778 | 38525 | CTCN_8580 | 52584 |
| TTCN_3091 | 38526 | CTCN_8581 | 52585 |
| TTCN_3092 | 38527 | TTCN_7096 | 52586 |
| CTCN_3779 | 38528 | CTCN_8582 | 52587 |
| ATCN_2215 | 38529 | CTCN_8583 | 52588 |
| GTCN_1986 | 38530 | ATCN_4860 | 52589 |
| TTCN_3093 | 38531 | GTCN_4593 | 52590 |
| TTCN_3094 | 38532 | ATCN_4861 | 52591 |
| TTCN_3095 | 38533 | ATCN_4862 | 52592 |
| GTCN_1987 | 38534 | CTCN_8584 | 52593 |
| ATCN_2216 | 38535 | GTCN_4594 | 52594 |
| CTCN_3780 | 38536 | CTCN_8585 | 52595 |
| CTCN_3781 | 38537 | ATCN_4863 | 52596 |
| TTCN_3096 | 38538 | CTCN_8586 | 52597 |
| CTCN_3782 | 38539 | CTCN_8587 | 52598 |
| TTCN_3097 | 38540 | CTCN_8588 | 52599 |
| TTCN_3098 | 38541 | ATCN_4864 | 52600 |
| CTCN_3783 | 38542 | ATCN_4865 | 52601 |
| CTCN_3784 | 38543 | CTCN_8589 | 52602 |
| GTCN_1988 | 38544 | GTCN_4595 | 52603 |

FIG. 37 (continued)

| | | | |
|---|---|---|---|
| TTCN_3099 | 38545 | TTCN_7097 | 52604 |
| ATCN_2217 | 38546 | GTCN_4596 | 52605 |
| TTCN_3100 | 38547 | CTCN_8590 | 52606 |
| CTCN_3785 | 38548 | ATCN_4866 | 52607 |
| TTCN_3101 | 38549 | ATCN_4867 | 52608 |
| CTCN_3786 | 38550 | TTCN_7098 | 52609 |
| GTCN_1989 | 38551 | CTCN_8591 | 52610 |
| CTCN_3787 | 38552 | CTCN_8592 | 52611 |
| CTCN_3788 | 38553 | TTCN_7099 | 52612 |
| ATCN_2218 | 38554 | CTCN_8593 | 52613 |
| TTCN_3102 | 38555 | GTCN_4597 | 52614 |
| TTCN_3103 | 38556 | ATCN_4868 | 52615 |
| ATCN_2219 | 38557 | CTCN_8594 | 52616 |
| ATCN_2220 | 38558 | GTCN_4598 | 52617 |
| TTCN_3104 | 38559 | CTCN_8595 | 52618 |
| CTCN_3789 | 38560 | GTCN_4599 | 52619 |
| TTCN_3105 | 38561 | GTCN_4600 | 52620 |
| TTCN_3106 | 38562 | CTCN_8596 | 52621 |
| ATCN_2221 | 38563 | TTCN_7100 | 52622 |
| TTCN_3107 | 38564 | CTCN_8597 | 52623 |
| TTCN_3108 | 38565 | ATCN_4869 | 52624 |
| CTCN_3790 | 38566 | TTCN_7101 | 52625 |
| GTCN_1990 | 38567 | CTCN_8598 | 52626 |
| TTCN_3109 | 38568 | ATCN_4870 | 52627 |
| GTCN_1991 | 38569 | CTCN_8599 | 52628 |
| TTCN_3110 | 38570 | GTCN_4601 | 52629 |
| CTCN_3791 | 38571 | ATCN_4871 | 52630 |
| CTCN_3792 | 38572 | TTCN_7102 | 52631 |
| CTCN_3793 | 38573 | ATCN_4872 | 52632 |
| ATCN_2222 | 38574 | ATCN_4873 | 52633 |
| CTCN_3794 | 38575 | TTCN_7103 | 52634 |
| ATCN_2223 | 38576 | TTCN_7104 | 52635 |
| TTCN_3111 | 38577 | CTCN_8600 | 52636 |
| CTCN_3795 | 38578 | GTCN_4602 | 52637 |
| ATCN_2224 | 38579 | GTCN_4603 | 52638 |
| ATCN_2225 | 38580 | CTCN_8601 | 52639 |
| ATCN_2226 | 38581 | TTCN_7105 | 52640 |
| TTCN_3112 | 38582 | GTCN_4604 | 52641 |
| TTCN_3113 | 38583 | GTCN_4605 | 52642 |
| ATCN_2227 | 38584 | CTCN_8602 | 52643 |
| ATCN_2228 | 38585 | GTCN_4606 | 52644 |
| CTCN_3796 | 38586 | TTCN_7106 | 52645 |
| TTCN_3114 | 38587 | CTCN_8603 | 52646 |

| | | | |
|---|---|---|---|
| CTCN_3797 | 38588 | ATCN_4874 | 52647 |
| ATCN_2229 | 38589 | ATCN_4875 | 52648 |
| TTCN_3115 | 38590 | TTCN_7107 | 52649 |
| CTCN_3798 | 38591 | ATCN_4876 | 52650 |
| TTCN_3116 | 38592 | CTCN_8604 | 52651 |
| TTCN_3117 | 38593 | GTCN_4607 | 52652 |
| CTCN_3799 | 38594 | CTCN_8605 | 52653 |
| ATCN_2230 | 38595 | GTCN_4608 | 52654 |
| CTCN_3800 | 38596 | ATCN_4877 | 52655 |
| TTCN_3118 | 38597 | ATCN_4878 | 52656 |
| CTCN_3801 | 38598 | GTCN_4609 | 52657 |
| TTCN_3119 | 38599 | GTCN_4610 | 52658 |
| ATCN_2231 | 38600 | ATCN_4879 | 52659 |
| TTCN_3120 | 38601 | GTCN_4611 | 52660 |
| ATCN_2232 | 38602 | TTCN_7108 | 52661 |
| CTCN_3802 | 38603 | GTCN_4612 | 52662 |
| ATCN_2233 | 38604 | TTCN_7109 | 52663 |
| ATCN_2234 | 38605 | ATCN_4880 | 52664 |
| ATCN_2235 | 38606 | TTCN_7110 | 52665 |
| CTCN_3803 | 38607 | CTCN_8606 | 52666 |
| GTCN_1992 | 38608 | CTCN_8607 | 52667 |
| TTCN_3121 | 38609 | TTCN_7111 | 52668 |
| TTCN_3122 | 38610 | ATCN_4881 | 52669 |
| ATCN_2236 | 38611 | TTCN_7112 | 52670 |
| ATCN_2237 | 38612 | GTCN_4613 | 52671 |
| TTCN_3123 | 38613 | CTCN_8608 | 52672 |
| TTCN_3124 | 38614 | GTCN_4614 | 52673 |
| TTCN_3125 | 38615 | CTCN_8609 | 52674 |
| TTCN_3126 | 38616 | CTCN_8610 | 52675 |
| CTCN_3804 | 38617 | ATCN_4882 | 52676 |
| GTCN_1993 | 38618 | ATCN_4883 | 52677 |
| CTCN_3805 | 38619 | TTCN_7113 | 52678 |
| TTCN_3127 | 38620 | ATCN_4884 | 52679 |
| TTCN_3128 | 38621 | CTCN_8611 | 52680 |
| GTCN_1994 | 38622 | CTCN_8612 | 52681 |
| ATCN_2238 | 38623 | CTCN_8613 | 52682 |
| GTCN_1995 | 38624 | GTCN_4615 | 52683 |
| TTCN_3129 | 38625 | GTCN_4616 | 52684 |
| GTCN_1996 | 38626 | CTCN_8614 | 52685 |
| TTCN_3130 | 38627 | GTCN_4617 | 52686 |
| GTCN_1997 | 38628 | TTCN_7114 | 52687 |
| GTCN_1998 | 38629 | GTCN_4618 | 52688 |
| TTCN_3131 | 38630 | TTCN_7115 | 52689 |

FIG. 37 (continued)

| | | | |
|---|---|---|---|
| GTCN_1999 | 38631 | ATCN_4885 | 52690 |
| CTCN_3806 | 38632 | ATCN_4886 | 52691 |
| CTCN_3807 | 38633 | GTCN_4619 | 52692 |
| CTCN_3808 | 38634 | TTCN_7116 | 52693 |
| GTCN_2000 | 38635 | TTCN_7117 | 52694 |
| TTCN_3132 | 38636 | TTCN_7118 | 52695 |
| CTCN_3809 | 38637 | TTCN_7119 | 52696 |
| GTCN_2001 | 38638 | CTCN_8615 | 52697 |
| CTCN_3810 | 38639 | CTCN_8616 | 52698 |
| TTCN_3133 | 38640 | GTCN_4620 | 52699 |
| TTCN_3134 | 38641 | GTCN_4621 | 52700 |
| GTCN_2002 | 38642 | CTCN_8617 | 52701 |
| GTCN_2003 | 38643 | GTCN_4622 | 52702 |
| TTCN_3135 | 38644 | CTCN_8618 | 52703 |
| ATCN_2239 | 38645 | GTCN_4623 | 52704 |
| GTCN_2004 | 38646 | TTCN_7120 | 52705 |
| GTCN_2005 | 38647 | ATCN_4887 | 52706 |
| CTCN_3811 | 38648 | GTCN_4624 | 52707 |
| CTCN_3812 | 38649 | ATCN_4888 | 52708 |
| CTCN_3813 | 38650 | GTCN_4625 | 52709 |
| GTCN_2006 | 38651 | CTCN_8619 | 52710 |
| CTCN_3814 | 38652 | ATCN_4889 | 52711 |
| TTCN_3136 | 38653 | CTCN_8620 | 52712 |
| ATCN_2240 | 38654 | CTCN_8621 | 52713 |
| CTCN_3815 | 38655 | ATCN_4890 | 52714 |
| GTCN_2007 | 38656 | ATCN_4891 | 52715 |
| CTCN_3816 | 38657 | CTCN_8622 | 52716 |
| TTCN_3137 | 38658 | GTCN_4626 | 52717 |
| CTCN_3817 | 38659 | CTCN_8623 | 52718 |
| CTCN_3818 | 38660 | CTCN_8624 | 52719 |
| GTCN_2008 | 38661 | GTCN_4627 | 52720 |
| ATCN_2241 | 38662 | TTCN_7121 | 52721 |
| TTCN_3138 | 38663 | GTCN_4628 | 52722 |
| ATCN_2242 | 38664 | GTCN_4629 | 52723 |
| ATCN_2243 | 38665 | CTCN_8625 | 52724 |
| CTCN_3819 | 38666 | CTCN_8626 | 52725 |
| CTCN_3820 | 38667 | GTCN_4630 | 52726 |
| CTCN_3821 | 38668 | CTCN_8627 | 52727 |
| ATCN_2244 | 38669 | TTCN_7122 | 52728 |
| TTCN_3139 | 38670 | ATCN_4892 | 52729 |
| TTCN_3140 | 38671 | CTCN_8628 | 52730 |
| GTCN_2009 | 38672 | GTCN_4631 | 52731 |
| TTCN_3141 | 38673 | CTCN_8629 | 52732 |

| | | | |
|---|---|---|---|
| GTCN_2010 | 38674 | CTCN_8630 | 52733 |
| CTCN_3822 | 38675 | ATCN_4893 | 52734 |
| CTCN_3823 | 38676 | ATCN_4894 | 52735 |
| CTCN_3824 | 38677 | CTCN_8631 | 52736 |
| ATCN_2245 | 38678 | CTCN_8632 | 52737 |
| ATCN_2246 | 38679 | GTCN_4632 | 52738 |
| CTCN_3825 | 38680 | CTCN_8633 | 52739 |
| GTCN_2011 | 38681 | CTCN_8634 | 52740 |
| TTCN_3142 | 38682 | GTCN_4633 | 52741 |
| GTCN_2012 | 38683 | CTCN_8635 | 52742 |
| CTCN_3826 | 38684 | TTCN_7123 | 52743 |
| GTCN_2013 | 38685 | ATCN_4895 | 52744 |
| TTCN_3143 | 38686 | ATCN_4896 | 52745 |
| CTCN_3827 | 38687 | CTCN_8636 | 52746 |
| GTCN_2014 | 38688 | GTCN_4634 | 52747 |
| GTCN_2015 | 38689 | GTCN_4635 | 52748 |
| CTCN_3828 | 38690 | TTCN_7124 | 52749 |
| CTCN_3829 | 38691 | ATCN_4897 | 52750 |
| ATCN_2247 | 38692 | CTCN_8637 | 52751 |
| ATCN_2248 | 38693 | GTCN_4636 | 52752 |
| TTCN_3144 | 38694 | TTCN_7125 | 52753 |
| ATCN_2249 | 38695 | ATCN_4898 | 52754 |
| CTCN_3830 | 38696 | ATCN_4899 | 52755 |
| TTCN_3145 | 38697 | CTCN_8638 | 52756 |
| CTCN_3831 | 38698 | CTCN_8639 | 52757 |
| CTCN_3832 | 38699 | CTCN_8640 | 52758 |
| CTCN_3833 | 38700 | TTCN_7126 | 52759 |
| CTCN_3834 | 38701 | TTCN_7127 | 52760 |
| GTCN_2016 | 38702 | CTCN_8641 | 52761 |
| TTCN_3146 | 38703 | GTCN_4637 | 52762 |
| TTCN_3147 | 38704 | GTCN_4638 | 52763 |
| CTCN_3835 | 38705 | GTCN_4639 | 52764 |
| CTCN_3836 | 38706 | CTCN_8642 | 52765 |
| TTCN_3148 | 38707 | ATCN_4900 | 52766 |
| CTCN_3837 | 38708 | CTCN_8643 | 52767 |
| GTCN_2017 | 38709 | CTCN_8644 | 52768 |
| CTCN_3838 | 38710 | CTCN_8645 | 52769 |
| ATCN_2250 | 38711 | ATCN_4901 | 52770 |
| TTCN_3149 | 38712 | ATCN_4902 | 52771 |
| TTCN_3150 | 38713 | CTCN_8646 | 52772 |
| TTCN_3151 | 38714 | TTCN_7128 | 52773 |
| TTCN_3152 | 38715 | CTCN_8647 | 52774 |
| GTCN_2018 | 38716 | GTCN_4640 | 52775 |

FIG. 37 (continued)

| | | | |
|---|---|---|---|
| CTCN_3839 | 38717 | TTCN_7129 | 52776 |
| TTCN_3153 | 38718 | ATCN_4903 | 52777 |
| ATCN_2251 | 38719 | CTCN_8648 | 52778 |
| TTCN_3154 | 38720 | CTCN_8649 | 52779 |
| GTCN_2019 | 38721 | CTCN_8650 | 52780 |
| CTCN_3840 | 38722 | CTCN_8651 | 52781 |
| TTCN_3155 | 38723 | CTCN_8652 | 52782 |
| TTCN_3156 | 38724 | CTCN_8653 | 52783 |
| TTCN_3157 | 38725 | TTCN_7130 | 52784 |
| CTCN_3841 | 38726 | TTCN_7131 | 52785 |
| GTCN_2020 | 38727 | CTCN_8654 | 52786 |
| ATCN_2252 | 38728 | GTCN_4641 | 52787 |
| TTCN_3158 | 38729 | GTCN_4642 | 52788 |
| ATCN_2253 | 38730 | CTCN_8655 | 52789 |
| CTCN_3842 | 38731 | ATCN_4904 | 52790 |
| TTCN_3159 | 38732 | CTCN_8656 | 52791 |
| CTCN_3843 | 38733 | GTCN_4643 | 52792 |
| GTCN_2021 | 38734 | CTCN_8657 | 52793 |
| TTCN_3160 | 38735 | GTCN_4644 | 52794 |
| CTCN_3844 | 38736 | CTCN_8658 | 52795 |
| ATCN_2254 | 38737 | CTCN_8659 | 52796 |
| GTCN_2022 | 38738 | ATCN_4905 | 52797 |
| CTCN_3845 | 38739 | TTCN_7132 | 52798 |
| CTCN_3846 | 38740 | ATCN_4906 | 52799 |
| CTCN_3847 | 38741 | TTCN_7133 | 52800 |
| GTCN_2023 | 38742 | CTCN_8660 | 52801 |
| GTCN_2024 | 38743 | TTCN_7134 | 52802 |
| GTCN_2025 | 38744 | TTCN_7135 | 52803 |
| TTCN_3161 | 38745 | CTCN_8661 | 52804 |
| CTCN_3848 | 38746 | CTCN_8662 | 52805 |
| GTCN_2026 | 38747 | CTCN_8663 | 52806 |
| TTCN_3162 | 38748 | CTCN_8664 | 52807 |
| ATCN_2255 | 38749 | CTCN_8665 | 52808 |
| CTCN_3849 | 38750 | ATCN_4907 | 52809 |
| ATCN_2256 | 38751 | CTCN_8666 | 52810 |
| ATCN_2257 | 38752 | CTCN_8667 | 52811 |
| TTCN_3163 | 38753 | CTCN_8668 | 52812 |
| TTCN_3164 | 38754 | ATCN_4908 | 52813 |
| ATCN_2258 | 38755 | CTCN_8669 | 52814 |
| CTCN_3850 | 38756 | CTCN_8670 | 52815 |
| GTCN_2027 | 38757 | GTCN_4645 | 52816 |
| GTCN_2028 | 38758 | ATCN_4909 | 52817 |
| GTCN_2029 | 38759 | CTCN_8671 | 52818 |

| | | | |
|---|---|---|---|
| ATCN_2259 | 38760 | TTCN_7136 | 52819 |
| TTCN_3165 | 38761 | GTCN_4646 | 52820 |
| TTCN_3166 | 38762 | GTCN_4647 | 52821 |
| TTCN_3167 | 38763 | CTCN_8672 | 52822 |
| ATCN_2260 | 38764 | TTCN_7137 | 52823 |
| CTCN_3851 | 38765 | GTCN_4648 | 52824 |
| ATCN_2261 | 38766 | CTCN_8673 | 52825 |
| TTCN_3168 | 38767 | CTCN_8674 | 52826 |
| TTCN_3169 | 38768 | CTCN_8675 | 52827 |
| TTCN_3170 | 38769 | GTCN_4649 | 52828 |
| CTCN_3852 | 38770 | TTCN_7138 | 52829 |
| ATCN_2262 | 38771 | CTCN_8676 | 52830 |
| CTCN_3853 | 38772 | TTCN_7139 | 52831 |
| GTCN_2030 | 38773 | CTCN_8677 | 52832 |
| ATCN_2263 | 38774 | TTCN_7140 | 52833 |
| ATCN_2264 | 38775 | TTCN_7141 | 52834 |
| CTCN_3854 | 38776 | CTCN_8678 | 52835 |
| GTCN_2031 | 38777 | CTCN_8679 | 52836 |
| CTCN_3855 | 38778 | TTCN_7142 | 52837 |
| ATCN_2265 | 38779 | TTCN_7143 | 52838 |
| TTCN_3171 | 38780 | CTCN_8680 | 52839 |
| GTCN_2032 | 38781 | TTCN_7144 | 52840 |
| CTCN_3856 | 38782 | TTCN_7145 | 52841 |
| ATCN_2266 | 38783 | CTCN_8681 | 52842 |
| CTCN_3857 | 38784 | TTCN_7146 | 52843 |
| CTCN_3858 | 38785 | CTCN_8682 | 52844 |
| CTCN_3859 | 38786 | CTCN_8683 | 52845 |
| CTCN_3860 | 38787 | TTCN_7147 | 52846 |
| TTCN_3172 | 38788 | TTCN_7148 | 52847 |
| ATCN_2267 | 38789 | TTCN_7149 | 52848 |
| TTCN_3173 | 38790 | GTCN_4650 | 52849 |
| CTCN_3861 | 38791 | GTCN_4651 | 52850 |
| CTCN_3862 | 38792 | CTCN_8684 | 52851 |
| CTCN_3863 | 38793 | CTCN_8685 | 52852 |
| ATCN_2268 | 38794 | GTCN_4652 | 52853 |
| ATCN_2269 | 38795 | CTCN_8686 | 52854 |
| CTCN_3864 | 38796 | CTCN_8687 | 52855 |
| CTCN_3865 | 38797 | CTCN_8688 | 52856 |
| GTCN_2033 | 38798 | GTCN_4653 | 52857 |
| CTCN_3866 | 38799 | GTCN_4654 | 52858 |
| GTCN_2034 | 38800 | CTCN_8689 | 52859 |
| CTCN_3867 | 38801 | CTCN_8690 | 52860 |
| TTCN_3174 | 38802 | CTCN_8691 | 52861 |

FIG. 37 (continued)

| | | | |
|---|---|---|---|
| TTCN_3175 | 38803 | CTCN_8692 | 52862 |
| TTCN_3176 | 38804 | CTCN_8693 | 52863 |
| ATCN_2270 | 38805 | GTCN_4655 | 52864 |
| CTCN_3868 | 38806 | GTCN_4656 | 52865 |
| CTCN_3869 | 38807 | CTCN_8694 | 52866 |
| CTCN_3870 | 38808 | ATCN_4910 | 52867 |
| TTCN_3177 | 38809 | ATCN_4911 | 52868 |
| GTCN_2035 | 38810 | TTCN_7150 | 52869 |
| CTCN_3871 | 38811 | TTCN_7151 | 52870 |
| CTCN_3872 | 38812 | CTCN_8695 | 52871 |
| ATCN_2271 | 38813 | CTCN_8696 | 52872 |
| GTCN_2036 | 38814 | CTCN_8697 | 52873 |
| GTCN_2037 | 38815 | CTCN_8698 | 52874 |
| TTCN_3178 | 38816 | GTCN_4657 | 52875 |
| GTCN_2038 | 38817 | TTCN_7152 | 52876 |
| TTCN_3179 | 38818 | CTCN_8699 | 52877 |
| CTCN_3873 | 38819 | GTCN_4658 | 52878 |
| CTCN_3874 | 38820 | GTCN_4659 | 52879 |
| TTCN_3180 | 38821 | TTCN_7153 | 52880 |
| GTCN_2039 | 38822 | CTCN_8700 | 52881 |
| TTCN_3181 | 38823 | GTCN_4660 | 52882 |
| TTCN_3182 | 38824 | CTCN_8701 | 52883 |
| TTCN_3183 | 38825 | CTCN_8702 | 52884 |
| TTCN_3184 | 38826 | GTCN_4661 | 52885 |
| CTCN_3875 | 38827 | TTCN_7154 | 52886 |
| GTCN_2040 | 38828 | ATCN_4912 | 52887 |
| CTCN_3876 | 38829 | TTCN_7155 | 52888 |
| GTCN_2041 | 38830 | GTCN_4662 | 52889 |
| TTCN_3185 | 38831 | ATCN_4913 | 52890 |
| CTCN_3877 | 38832 | ATCN_4914 | 52891 |
| CTCN_3878 | 38833 | CTCN_8703 | 52892 |
| CTCN_3879 | 38834 | TTCN_7156 | 52893 |
| GTCN_2042 | 38835 | CTCN_8704 | 52894 |
| GTCN_2043 | 38836 | GTCN_4663 | 52895 |
| ATCN_2272 | 38837 | GTCN_4664 | 52896 |
| TTCN_3186 | 38838 | ATCN_4915 | 52897 |
| TTCN_3187 | 38839 | TTCN_7157 | 52898 |
| TTCN_3188 | 38840 | GTCN_4665 | 52899 |
| TTCN_3189 | 38841 | TTCN_7158 | 52900 |
| TTCN_3190 | 38842 | TTCN_7159 | 52901 |
| TTCN_3191 | 38843 | CTCN_8705 | 52902 |
| TTCN_3192 | 38844 | CTCN_8706 | 52903 |
| TTCN_3193 | 38845 | TTCN_7160 | 52904 |

| | | | |
|---|---|---|---|
| ATCN_2273 | 38846 | TTCN_7161 | 52905 |
| TTCN_3194 | 38847 | GTCN_4666 | 52906 |
| ATCN_2274 | 38848 | GTCN_4667 | 52907 |
| TTCN_3195 | 38849 | CTCN_8707 | 52908 |
| TTCN_3196 | 38850 | CTCN_8708 | 52909 |
| CTCN_3880 | 38851 | ATCN_4916 | 52910 |
| ATCN_2275 | 38852 | GTCN_4668 | 52911 |
| ATCN_2276 | 38853 | GTCN_4669 | 52912 |
| CTCN_3881 | 38854 | GTCN_4670 | 52913 |
| ATCN_2277 | 38855 | CTCN_8709 | 52914 |
| ATCN_2278 | 38856 | ATCN_4917 | 52915 |
| CTCN_3882 | 38857 | ATCN_4918 | 52916 |
| GTCN_2044 | 38858 | CTCN_8710 | 52917 |
| CTCN_3883 | 38859 | CTCN_8711 | 52918 |
| CTCN_3884 | 38860 | CTCN_8712 | 52919 |
| GTCN_2045 | 38861 | GTCN_4671 | 52920 |
| TTCN_3197 | 38862 | CTCN_8713 | 52921 |
| ATCN_2279 | 38863 | CTCN_8714 | 52922 |
| CTCN_3885 | 38864 | GTCN_4672 | 52923 |
| TTCN_3198 | 38865 | ATCN_4919 | 52924 |
| ATCN_2280 | 38866 | ATCN_4920 | 52925 |
| CTCN_3886 | 38867 | TTCN_7162 | 52926 |
| CTCN_3887 | 38868 | GTCN_4673 | 52927 |
| TTCN_3199 | 38869 | CTCN_8715 | 52928 |
| ATCN_2281 | 38870 | CTCN_8716 | 52929 |
| TTCN_3200 | 38871 | TTCN_7163 | 52930 |
| TTCN_3201 | 38872 | TTCN_7164 | 52931 |
| CTCN_3888 | 38873 | ATCN_4921 | 52932 |
| CTCN_3889 | 38874 | CTCN_8717 | 52933 |
| ATCN_2282 | 38875 | ATCN_4922 | 52934 |
| CTCN_3890 | 38876 | CTCN_8718 | 52935 |
| CTCN_3891 | 38877 | CTCN_8719 | 52936 |
| GTCN_2046 | 38878 | CTCN_8720 | 52937 |
| CTCN_3892 | 38879 | CTCN_8721 | 52938 |
| TTCN_3202 | 38880 | CTCN_8722 | 52939 |
| TTCN_3203 | 38881 | GTCN_4674 | 52940 |
| ATCN_2283 | 38882 | CTCN_8723 | 52941 |
| TTCN_3204 | 38883 | CTCN_8724 | 52942 |
| TTCN_3205 | 38884 | CTCN_8725 | 52943 |
| TTCN_3206 | 38885 | TTCN_7165 | 52944 |
| GTCN_2047 | 38886 | TTCN_7166 | 52945 |
| ATCN_2284 | 38887 | CTCN_8726 | 52946 |
| TTCN_3207 | 38888 | CTCN_8727 | 52947 |

FIG. 37 (continued)

| | | | |
|---|---|---|---|
| TTCN_3208 | 38889 | GTCN_4675 | 52948 |
| ATCN_2285 | 38890 | TTCN_7167 | 52949 |
| ATCN_2286 | 38891 | CTCN_8728 | 52950 |
| ATCN_2287 | 38892 | CTCN_8729 | 52951 |
| CTCN_3893 | 38893 | TTCN_7168 | 52952 |
| TTCN_3209 | 38894 | CTCN_8730 | 52953 |
| ATCN_2288 | 38895 | TTCN_7169 | 52954 |
| GTCN_2048 | 38896 | ATCN_4923 | 52955 |
| ATCN_2289 | 38897 | CTCN_8731 | 52956 |
| CTCN_3894 | 38898 | CTCN_8732 | 52957 |
| ATCN_2290 | 38899 | TTCN_7170 | 52958 |
| ATCN_2291 | 38900 | TTCN_7171 | 52959 |
| TTCN_3210 | 38901 | ATCN_4924 | 52960 |
| TTCN_3211 | 38902 | TTCN_7172 | 52961 |
| TTCN_3212 | 38903 | TTCN_7173 | 52962 |
| ATCN_2292 | 38904 | ATCN_4925 | 52963 |
| CTCN_3895 | 38905 | TTCN_7174 | 52964 |
| CTCN_3896 | 38906 | CTCN_8733 | 52965 |
| TTCN_3213 | 38907 | CTCN_8734 | 52966 |
| ATCN_2293 | 38908 | TTCN_7175 | 52967 |
| TTCN_3214 | 38909 | GTCN_4676 | 52968 |
| TTCN_3215 | 38910 | CTCN_8735 | 52969 |
| ATCN_2294 | 38911 | CTCN_8736 | 52970 |
| TTCN_3216 | 38912 | TTCN_7176 | 52971 |
| GTCN_2049 | 38913 | GTCN_4677 | 52972 |
| GTCN_2050 | 38914 | CTCN_8737 | 52973 |
| ATCN_2295 | 38915 | TTCN_7177 | 52974 |
| CTCN_3897 | 38916 | ATCN_4926 | 52975 |
| ATCN_2296 | 38917 | TTCN_7178 | 52976 |
| CTCN_3898 | 38918 | GTCN_4678 | 52977 |
| CTCN_3899 | 38919 | TTCN_7179 | 52978 |
| ATCN_2297 | 38920 | TTCN_7180 | 52979 |
| TTCN_3217 | 38921 | ATCN_4927 | 52980 |
| CTCN_3900 | 38922 | GTCN_4679 | 52981 |
| TTCN_3218 | 38923 | ATCN_4928 | 52982 |
| TTCN_3219 | 38924 | GTCN_4680 | 52983 |
| ATCN_2298 | 38925 | GTCN_4681 | 52984 |
| CTCN_3901 | 38926 | TTCN_7181 | 52985 |
| ATCN_2299 | 38927 | ATCN_4929 | 52986 |
| ATCN_2300 | 38928 | CTCN_8738 | 52987 |
| TTCN_3220 | 38929 | TTCN_7182 | 52988 |
| CTCN_3902 | 38930 | TTCN_7183 | 52989 |
| TTCN_3221 | 38931 | TTCN_7184 | 52990 |

| | | | |
|---|---|---|---|
| TTCN_3222 | 38932 | CTCN_8739 | 52991 |
| TTCN_3223 | 38933 | CTCN_8740 | 52992 |
| TTCN_3224 | 38934 | ATCN_4930 | 52993 |
| CTCN_3903 | 38935 | CTCN_8741 | 52994 |
| GTCN_2051 | 38936 | ATCN_4931 | 52995 |
| GTCN_2052 | 38937 | ATCN_4932 | 52996 |
| CTCN_3904 | 38938 | TTCN_7185 | 52997 |
| CTCN_3905 | 38939 | GTCN_4682 | 52998 |
| TTCN_3225 | 38940 | CTCN_8742 | 52999 |
| CTCN_3906 | 38941 | TTCN_7186 | 53000 |
| ATCN_2301 | 38942 | CTCN_8743 | 53001 |
| TTCN_3226 | 38943 | CTCN_8744 | 53002 |
| CTCN_3907 | 38944 | TTCN_7187 | 53003 |
| TTCN_3227 | 38945 | ATCN_4933 | 53004 |
| CTCN_3908 | 38946 | TTCN_7188 | 53005 |
| CTCN_3909 | 38947 | TTCN_7189 | 53006 |
| CTCN_3910 | 38948 | GTCN_4683 | 53007 |
| TTCN_3228 | 38949 | ATCN_4934 | 53008 |
| GTCN_2053 | 38950 | CTCN_8745 | 53009 |
| GTCN_2054 | 38951 | CTCN_8746 | 53010 |
| TTCN_3229 | 38952 | TTCN_7190 | 53011 |
| CTCN_3911 | 38953 | TTCN_7191 | 53012 |
| GTCN_2055 | 38954 | TTCN_7192 | 53013 |
| CTCN_3912 | 38955 | ATCN_4935 | 53014 |
| TTCN_3230 | 38956 | CTCN_8747 | 53015 |
| GTCN_2056 | 38957 | CTCN_8748 | 53016 |
| ATCN_2302 | 38958 | CTCN_8749 | 53017 |
| CTCN_3913 | 38959 | TTCN_7193 | 53018 |
| CTCN_3914 | 38960 | GTCN_4684 | 53019 |
| ATCN_2303 | 38961 | CTCN_8750 | 53020 |
| ATCN_2304 | 38962 | GTCN_4685 | 53021 |
| TTCN_3231 | 38963 | TTCN_7194 | 53022 |
| CTCN_3915 | 38964 | CTCN_8751 | 53023 |
| TTCN_3232 | 38965 | TTCN_7195 | 53024 |
| CTCN_3916 | 38966 | TTCN_7196 | 53025 |
| CTCN_3917 | 38967 | ATCN_4936 | 53026 |
| TTCN_3233 | 38968 | CTCN_8752 | 53027 |
| GTCN_2057 | 38969 | CTCN_8753 | 53028 |
| TTCN_3234 | 38970 | ATCN_4937 | 53029 |
| TTCN_3235 | 38971 | GTCN_4686 | 53030 |
| TTCN_3236 | 38972 | TTCN_7197 | 53031 |
| ATCN_2305 | 38973 | CTCN_8754 | 53032 |
| CTCN_3918 | 38974 | TTCN_7198 | 53033 |

FIG. 37 (continued)

| | | | |
|---|---|---|---|
| ATCN_2306 | 38975 | TTCN_7199 | 53034 |
| TTCN_3237 | 38976 | CTCN_8755 | 53035 |
| CTCN_3919 | 38977 | CTCN_8756 | 53036 |
| ATCN_2307 | 38978 | TTCN_7200 | 53037 |
| TTCN_3238 | 38979 | ATCN_4938 | 53038 |
| CTCN_3920 | 38980 | CTCN_8757 | 53039 |
| GTCN_2058 | 38981 | GTCN_4687 | 53040 |
| ATCN_2308 | 38982 | ATCN_4939 | 53041 |
| ATCN_2309 | 38983 | TTCN_7201 | 53042 |
| TTCN_3239 | 38984 | GTCN_4688 | 53043 |
| CTCN_3921 | 38985 | CTCN_8758 | 53044 |
| CTCN_3922 | 38986 | TTCN_7202 | 53045 |
| CTCN_3923 | 38987 | CTCN_8759 | 53046 |
| GTCN_2059 | 38988 | TTCN_7203 | 53047 |
| CTCN_3924 | 38989 | CTCN_8760 | 53048 |
| GTCN_2060 | 38990 | GTCN_4689 | 53049 |
| CTCN_3925 | 38991 | CTCN_8761 | 53050 |
| CTCN_3926 | 38992 | TTCN_7204 | 53051 |
| GTCN_2061 | 38993 | CTCN_8762 | 53052 |
| TTCN_3240 | 38994 | CTCN_8763 | 53053 |
| CTCN_3927 | 38995 | CTCN_8764 | 53054 |
| ATCN_2310 | 38996 | CTCN_8765 | 53055 |
| TTCN_3241 | 38997 | TTCN_7205 | 53056 |
| TTCN_3242 | 38998 | CTCN_8766 | 53057 |
| TTCN_3243 | 38999 | CTCN_8767 | 53058 |
| CTCN_3928 | 39000 | CTCN_8768 | 53059 |
| CTCN_3929 | 39001 | TTCN_7206 | 53060 |
| CTCN_3930 | 39002 | ATCN_4940 | 53061 |
| GTCN_2062 | 39003 | GTCN_4690 | 53062 |
| CTCN_3931 | 39004 | GTCN_4691 | 53063 |
| CTCN_3932 | 39005 | CTCN_8769 | 53064 |
| CTCN_3933 | 39006 | CTCN_8770 | 53065 |
| CTCN_3934 | 39007 | CTCN_8771 | 53066 |
| GTCN_2063 | 39008 | GTCN_4692 | 53067 |
| CTCN_3935 | 39009 | CTCN_8772 | 53068 |
| CTCN_3936 | 39010 | CTCN_8773 | 53069 |
| GTCN_2064 | 39011 | TTCN_7207 | 53070 |
| GTCN_2065 | 39012 | TTCN_7208 | 53071 |
| CTCN_3937 | 39013 | ATCN_4941 | 53072 |
| ATCN_2311 | 39014 | CTCN_8774 | 53073 |
| ATCN_2312 | 39015 | CTCN_8775 | 53074 |
| CTCN_3938 | 39016 | TTCN_7209 | 53075 |
| TTCN_3244 | 39017 | CTCN_8776 | 53076 |

| | | | |
|---|---|---|---|
| ATCN_2313 | 39018 | GTCN_4693 | 53077 |
| GTCN_2066 | 39019 | CTCN_8777 | 53078 |
| TTCN_3245 | 39020 | GTCN_4694 | 53079 |
| CTCN_3939 | 39021 | CTCN_8778 | 53080 |
| GTCN_2067 | 39022 | CTCN_8779 | 53081 |
| CTCN_3940 | 39023 | GTCN_4695 | 53082 |
| CTCN_3941 | 39024 | CTCN_8780 | 53083 |
| GTCN_2068 | 39025 | CTCN_8781 | 53084 |
| ATCN_2314 | 39026 | GTCN_4696 | 53085 |
| CTCN_3942 | 39027 | CTCN_8782 | 53086 |
| CTCN_3943 | 39028 | GTCN_4697 | 53087 |
| ATCN_2315 | 39029 | CTCN_8783 | 53088 |
| TTCN_3246 | 39030 | CTCN_8784 | 53089 |
| CTCN_3944 | 39031 | CTCN_8785 | 53090 |
| GTCN_2069 | 39032 | ATCN_4942 | 53091 |
| CTCN_3945 | 39033 | CTCN_8786 | 53092 |
| TTCN_3247 | 39034 | GTCN_4698 | 53093 |
| CTCN_3946 | 39035 | CTCN_8787 | 53094 |
| CTCN_3947 | 39036 | TTCN_7210 | 53095 |
| GTCN_2070 | 39037 | GTCN_4699 | 53096 |
| GTCN_2071 | 39038 | GTCN_4700 | 53097 |
| CTCN_3948 | 39039 | CTCN_8788 | 53098 |
| GTCN_2072 | 39040 | CTCN_8789 | 53099 |
| CTCN_3949 | 39041 | TTCN_7211 | 53100 |
| GTCN_2073 | 39042 | TTCN_7212 | 53101 |
| CTCN_3950 | 39043 | GTCN_4701 | 53102 |
| TTCN_3248 | 39044 | CTCN_8790 | 53103 |
| CTCN_3951 | 39045 | CTCN_8791 | 53104 |
| CTCN_3952 | 39046 | TTCN_7213 | 53105 |
| ATCN_2316 | 39047 | CTCN_8792 | 53106 |
| CTCN_3953 | 39048 | GTCN_4702 | 53107 |
| TTCN_3249 | 39049 | CTCN_8793 | 53108 |
| GTCN_2074 | 39050 | ATCN_4943 | 53109 |
| ATCN_2317 | 39051 | TTCN_7214 | 53110 |
| TTCN_3250 | 39052 | GTCN_4703 | 53111 |
| CTCN_3954 | 39053 | ATCN_4944 | 53112 |
| CTCN_3955 | 39054 | ATCN_4945 | 53113 |
| CTCN_3956 | 39055 | ATCN_4946 | 53114 |
| TTCN_3251 | 39056 | GTCN_4704 | 53115 |
| CTCN_3957 | 39057 | TTCN_7215 | 53116 |
| CTCN_3958 | 39058 | TTCN_7216 | 53117 |
| CTCN_3959 | 39059 | CTCN_8794 | 53118 |
| ATCN_2318 | 39060 | CTCN_8795 | 53119 |

FIG. 37 (continued)

| | | | |
|---|---|---|---|
| CTCN_3960 | 39061 | ATCN_4947 | 53120 |
| GTCN_2075 | 39062 | TTCN_7217 | 53121 |
| GTCN_2076 | 39063 | GTCN_4705 | 53122 |
| GTCN_2077 | 39064 | ATCN_4948 | 53123 |
| TTCN_3252 | 39065 | ATCN_4949 | 53124 |
| GTCN_2078 | 39066 | TTCN_7218 | 53125 |
| CTCN_3961 | 39067 | CTCN_8796 | 53126 |
| CTCN_3962 | 39068 | GTCN_4706 | 53127 |
| CTCN_3963 | 39069 | CTCN_8797 | 53128 |
| ATCN_2319 | 39070 | TTCN_7219 | 53129 |
| GTCN_2079 | 39071 | GTCN_4707 | 53130 |
| CTCN_3964 | 39072 | GTCN_4708 | 53131 |
| CTCN_3965 | 39073 | CTCN_8798 | 53132 |
| ATCN_2320 | 39074 | TTCN_7220 | 53133 |
| GTCN_2080 | 39075 | TTCN_7221 | 53134 |
| CTCN_3966 | 39076 | TTCN_7222 | 53135 |
| ATCN_2321 | 39077 | TTCN_7223 | 53136 |
| CTCN_3967 | 39078 | TTCN_7224 | 53137 |
| TTCN_3253 | 39079 | TTCN_7225 | 53138 |
| CTCN_3968 | 39080 | ATCN_4950 | 53139 |
| TTCN_3254 | 39081 | ATCN_4951 | 53140 |
| TTCN_3255 | 39082 | ATCN_4952 | 53141 |
| ATCN_2322 | 39083 | CTCN_8799 | 53142 |
| CTCN_3969 | 39084 | CTCN_8800 | 53143 |
| ATCN_2323 | 39085 | CTCN_8801 | 53144 |
| CTCN_3970 | 39086 | GTCN_4709 | 53145 |
| TTCN_3256 | 39087 | CTCN_8802 | 53146 |
| ATCN_2324 | 39088 | CTCN_8803 | 53147 |
| CTCN_3971 | 39089 | TTCN_7226 | 53148 |
| CTCN_3972 | 39090 | CTCN_8804 | 53149 |
| TTCN_3257 | 39091 | CTCN_8805 | 53150 |
| TTCN_3258 | 39092 | GTCN_4710 | 53151 |
| TTCN_3259 | 39093 | TTCN_7227 | 53152 |
| ATCN_2325 | 39094 | TTCN_7228 | 53153 |
| CTCN_3973 | 39095 | CTCN_8806 | 53154 |
| TTCN_3260 | 39096 | GTCN_4711 | 53155 |
| CTCN_3974 | 39097 | CTCN_8807 | 53156 |
| TTCN_3261 | 39098 | ATCN_4953 | 53157 |
| CTCN_3975 | 39099 | CTCN_8808 | 53158 |
| CTCN_3976 | 39100 | ATCN_4954 | 53159 |
| TTCN_3262 | 39101 | GTCN_4712 | 53160 |
| TTCN_3263 | 39102 | TTCN_7229 | 53161 |
| ATCN_2326 | 39103 | GTCN_4713 | 53162 |

| | | | |
|---|---|---|---|
| GTCN_2081 | 39104 | TTCN_7230 | 53163 |
| TTCN_3264 | 39105 | TTCN_7231 | 53164 |
| CTCN_3977 | 39106 | ATCN_4955 | 53165 |
| TTCN_3265 | 39107 | GTCN_4714 | 53166 |
| GTCN_2082 | 39108 | CTCN_8809 | 53167 |
| GTCN_2083 | 39109 | TTCN_7232 | 53168 |
| ATCN_2327 | 39110 | CTCN_8810 | 53169 |
| TTCN_3266 | 39111 | GTCN_4715 | 53170 |
| ATCN_2328 | 39112 | TTCN_7233 | 53171 |
| ATCN_2329 | 39113 | CTCN_8811 | 53172 |
| ATCN_2330 | 39114 | TTCN_7234 | 53173 |
| CTCN_3978 | 39115 | GTCN_4716 | 53174 |
| GTCN_2084 | 39116 | ATCN_4956 | 53175 |
| CTCN_3979 | 39117 | ATCN_4957 | 53176 |
| TTCN_3267 | 39118 | TTCN_7235 | 53177 |
| CTCN_3980 | 39119 | CTCN_8812 | 53178 |
| TTCN_3268 | 39120 | GTCN_4717 | 53179 |
| CTCN_3981 | 39121 | GTCN_4718 | 53180 |
| CTCN_3982 | 39122 | CTCN_8813 | 53181 |
| TTCN_3269 | 39123 | CTCN_8814 | 53182 |
| ATCN_2331 | 39124 | CTCN_8815 | 53183 |
| CTCN_3983 | 39125 | GTCN_4719 | 53184 |
| CTCN_3984 | 39126 | TTCN_7236 | 53185 |
| GTCN_2085 | 39127 | CTCN_8816 | 53186 |
| ATCN_2332 | 39128 | GTCN_4720 | 53187 |
| GTCN_2086 | 39129 | CTCN_8817 | 53188 |
| ATCN_2333 | 39130 | CTCN_8818 | 53189 |
| CTCN_3985 | 39131 | TTCN_7237 | 53190 |
| CTCN_3986 | 39132 | TTCN_7238 | 53191 |
| CTCN_3987 | 39133 | ATCN_4958 | 53192 |
| ATCN_2334 | 39134 | CTCN_8819 | 53193 |
| CTCN_3988 | 39135 | TTCN_7239 | 53194 |
| CTCN_3989 | 39136 | ATCN_4959 | 53195 |
| TTCN_3270 | 39137 | CTCN_8820 | 53196 |
| GTCN_2087 | 39138 | CTCN_8821 | 53197 |
| CTCN_3990 | 39139 | CTCN_8822 | 53198 |
| TTCN_3271 | 39140 | ATCN_4960 | 53199 |
| ATCN_2335 | 39141 | GTCN_4721 | 53200 |
| CTCN_3991 | 39142 | CTCN_8823 | 53201 |
| CTCN_3992 | 39143 | TTCN_7240 | 53202 |
| GTCN_2088 | 39144 | TTCN_7241 | 53203 |
| CTCN_3993 | 39145 | GTCN_4722 | 53204 |
| CTCN_3994 | 39146 | TTCN_7242 | 53205 |

FIG. 37 (continued)

| | | | |
|---|---|---|---|
| CTCN_3995 | 39147 | CTCN_8824 | 53206 |
| GTCN_2089 | 39148 | TTCN_7243 | 53207 |
| CTCN_3996 | 39149 | CTCN_8825 | 53208 |
| GTCN_2090 | 39150 | TTCN_7244 | 53209 |
| CTCN_3997 | 39151 | TTCN_7245 | 53210 |
| ATCN_2336 | 39152 | CTCN_8826 | 53211 |
| CTCN_3998 | 39153 | TTCN_7246 | 53212 |
| CTCN_3999 | 39154 | TTCN_7247 | 53213 |
| TTCN_3272 | 39155 | ATCN_4961 | 53214 |
| CTCN_4000 | 39156 | GTCN_4723 | 53215 |
| ATCN_2337 | 39157 | TTCN_7248 | 53216 |
| ATCN_2338 | 39158 | CTCN_8827 | 53217 |
| CTCN_4001 | 39159 | ATCN_4962 | 53218 |
| CTCN_4002 | 39160 | TTCN_7249 | 53219 |
| TTCN_3273 | 39161 | TTCN_7250 | 53220 |
| CTCN_4003 | 39162 | CTCN_8828 | 53221 |
| GTCN_2091 | 39163 | GTCN_4724 | 53222 |
| TTCN_3274 | 39164 | TTCN_7251 | 53223 |
| ATCN_2339 | 39165 | ATCN_4963 | 53224 |
| TTCN_3275 | 39166 | ATCN_4964 | 53225 |
| CTCN_4004 | 39167 | CTCN_8829 | 53226 |
| CTCN_4005 | 39168 | GTCN_4725 | 53227 |
| ATCN_2340 | 39169 | TTCN_7252 | 53228 |
| TTCN_3276 | 39170 | TTCN_7253 | 53229 |
| CTCN_4006 | 39171 | ATCN_4965 | 53230 |
| GTCN_2092 | 39172 | CTCN_8830 | 53231 |
| GTCN_2093 | 39173 | CTCN_8831 | 53232 |
| CTCN_4007 | 39174 | CTCN_8832 | 53233 |
| TTCN_3277 | 39175 | TTCN_7254 | 53234 |
| TTCN_3278 | 39176 | CTCN_8833 | 53235 |
| TTCN_3279 | 39177 | CTCN_8834 | 53236 |
| GTCN_2094 | 39178 | CTCN_8835 | 53237 |
| TTCN_3280 | 39179 | CTCN_8836 | 53238 |
| ATCN_2341 | 39180 | CTCN_8837 | 53239 |
| CTCN_4008 | 39181 | TTCN_7255 | 53240 |
| GTCN_2095 | 39182 | CTCN_8838 | 53241 |
| ATCN_2342 | 39183 | CTCN_8839 | 53242 |
| TTCN_3281 | 39184 | CTCN_8840 | 53243 |
| TTCN_3282 | 39185 | GTCN_4726 | 53244 |
| GTCN_2096 | 39186 | CTCN_8841 | 53245 |
| CTCN_4009 | 39187 | GTCN_4727 | 53246 |
| CTCN_4010 | 39188 | CTCN_8842 | 53247 |
| CTCN_4011 | 39189 | GTCN_4728 | 53248 |

| | | | |
|---|---|---|---|
| CTCN_4012 | 39190 | CTCN_8843 | 53249 |
| ATCN_2343 | 39191 | CTCN_8844 | 53250 |
| TTCN_3283 | 39192 | CTCN_8845 | 53251 |
| ATCN_2344 | 39193 | CTCN_8846 | 53252 |
| TTCN_3284 | 39194 | GTCN_4729 | 53253 |
| CTCN_4013 | 39195 | CTCN_8847 | 53254 |
| ATCN_2345 | 39196 | CTCN_8848 | 53255 |
| GTCN_2097 | 39197 | CTCN_8849 | 53256 |
| TTCN_3285 | 39198 | CTCN_8850 | 53257 |
| ATCN_2346 | 39199 | GTCN_4730 | 53258 |
| GTCN_2098 | 39200 | CTCN_8851 | 53259 |
| GTCN_2099 | 39201 | CTCN_8852 | 53260 |
| CTCN_4014 | 39202 | CTCN_8853 | 53261 |
| GTCN_2100 | 39203 | CTCN_8854 | 53262 |
| GTCN_2101 | 39204 | CTCN_8855 | 53263 |
| CTCN_4015 | 39205 | CTCN_8856 | 53264 |
| TTCN_3286 | 39206 | GTCN_4731 | 53265 |
| GTCN_2102 | 39207 | TTCN_7256 | 53266 |
| ATCN_2347 | 39208 | TTCN_7257 | 53267 |
| CTCN_4016 | 39209 | CTCN_8857 | 53268 |
| GTCN_2103 | 39210 | TTCN_7258 | 53269 |
| CTCN_4017 | 39211 | CTCN_8858 | 53270 |
| ATCN_2348 | 39212 | TTCN_7259 | 53271 |
| TTCN_3287 | 39213 | CTCN_8859 | 53272 |
| CTCN_4018 | 39214 | GTCN_4732 | 53273 |
| GTCN_2104 | 39215 | CTCN_8860 | 53274 |
| CTCN_4019 | 39216 | CTCN_8861 | 53275 |
| ATCN_2349 | 39217 | ATCN_4966 | 53276 |
| TTCN_3288 | 39218 | CTCN_8862 | 53277 |
| GTCN_2105 | 39219 | GTCN_4733 | 53278 |
| TTCN_3289 | 39220 | GTCN_4734 | 53279 |
| ATCN_2350 | 39221 | GTCN_4735 | 53280 |
| CTCN_4020 | 39222 | CTCN_8863 | 53281 |
| TTCN_3290 | 39223 | GTCN_4736 | 53282 |
| CTCN_4021 | 39224 | GTCN_4737 | 53283 |
| TTCN_3291 | 39225 | ATCN_4967 | 53284 |
| TTCN_3292 | 39226 | CTCN_8864 | 53285 |
| ATCN_2351 | 39227 | TTCN_7260 | 53286 |
| ATCN_2352 | 39228 | GTCN_4738 | 53287 |
| TTCN_3293 | 39229 | GTCN_4739 | 53288 |
| CTCN_4022 | 39230 | CTCN_8865 | 53289 |
| GTCN_2106 | 39231 | CTCN_8866 | 53290 |
| TTCN_3294 | 39232 | ATCN_4968 | 53291 |

FIG. 37 (continued)

| | | | |
|---|---|---|---|
| CTCN_4023 | 39233 | CTCN_8867 | 53292 |
| TTCN_3295 | 39234 | CTCN_8868 | 53293 |
| CTCN_4024 | 39235 | TTCN_7261 | 53294 |
| TTCN_3296 | 39236 | CTCN_8869 | 53295 |
| ATCN_2353 | 39237 | GTCN_4740 | 53296 |
| TTCN_3297 | 39238 | CTCN_8870 | 53297 |
| TTCN_3298 | 39239 | CTCN_8871 | 53298 |
| CTCN_4025 | 39240 | CTCN_8872 | 53299 |
| ATCN_2354 | 39241 | CTCN_8873 | 53300 |
| CTCN_4026 | 39242 | GTCN_4741 | 53301 |
| CTCN_4027 | 39243 | CTCN_8874 | 53302 |
| CTCN_4028 | 39244 | GTCN_4742 | 53303 |
| TTCN_3299 | 39245 | TTCN_7262 | 53304 |
| TTCN_3300 | 39246 | TTCN_7263 | 53305 |
| CTCN_4029 | 39247 | ATCN_4969 | 53306 |
| GTCN_2107 | 39248 | GTCN_4743 | 53307 |
| TTCN_3301 | 39249 | GTCN_4744 | 53308 |
| ATCN_2355 | 39250 | CTCN_8875 | 53309 |
| TTCN_3302 | 39251 | CTCN_8876 | 53310 |
| TTCN_3303 | 39252 | CTCN_8877 | 53311 |
| TTCN_3304 | 39253 | TTCN_7264 | 53312 |
| CTCN_4030 | 39254 | CTCN_8878 | 53313 |
| CTCN_4031 | 39255 | TTCN_7265 | 53314 |
| TTCN_3305 | 39256 | CTCN_8879 | 53315 |
| CTCN_4032 | 39257 | CTCN_8880 | 53316 |
| CTCN_4033 | 39258 | CTCN_8881 | 53317 |
| GTCN_2108 | 39259 | CTCN_8882 | 53318 |
| TTCN_3306 | 39260 | CTCN_8883 | 53319 |
| CTCN_4034 | 39261 | ATCN_4970 | 53320 |
| CTCN_4035 | 39262 | TTCN_7266 | 53321 |
| CTCN_4036 | 39263 | ATCN_4971 | 53322 |
| GTCN_2109 | 39264 | CTCN_8884 | 53323 |
| TTCN_3307 | 39265 | CTCN_8885 | 53324 |
| TTCN_3308 | 39266 | CTCN_8886 | 53325 |
| ATCN_2356 | 39267 | CTCN_8887 | 53326 |
| TTCN_3309 | 39268 | CTCN_8888 | 53327 |
| CTCN_4037 | 39269 | ATCN_4972 | 53328 |
| CTCN_4038 | 39270 | TTCN_7267 | 53329 |
| CTCN_4039 | 39271 | CTCN_8889 | 53330 |
| CTCN_4040 | 39272 | CTCN_8890 | 53331 |
| CTCN_4041 | 39273 | CTCN_8891 | 53332 |
| ATCN_2357 | 39274 | ATCN_4973 | 53333 |
| TTCN_3310 | 39275 | CTCN_8892 | 53334 |

| | | | |
|---|---|---|---|
| GTCN_2110 | 39276 | GTCN_4745 | 53335 |
| CTCN_4042 | 39277 | GTCN_4746 | 53336 |
| ATCN_2358 | 39278 | TTCN_7268 | 53337 |
| CTCN_4043 | 39279 | GTCN_4747 | 53338 |
| GTCN_2111 | 39280 | CTCN_8893 | 53339 |
| CTCN_4044 | 39281 | ATCN_4974 | 53340 |
| TTCN_3311 | 39282 | ATCN_4975 | 53341 |
| CTCN_4045 | 39283 | CTCN_8894 | 53342 |
| ATCN_2359 | 39284 | ATCN_4976 | 53343 |
| GTCN_2112 | 39285 | CTCN_8895 | 53344 |
| TTCN_3312 | 39286 | ATCN_4977 | 53345 |
| GTCN_2113 | 39287 | ATCN_4978 | 53346 |
| CTCN_4046 | 39288 | CTCN_8896 | 53347 |
| CTCN_4047 | 39289 | CTCN_8897 | 53348 |
| GTCN_2114 | 39290 | CTCN_8898 | 53349 |
| GTCN_2115 | 39291 | CTCN_8899 | 53350 |
| CTCN_4048 | 39292 | CTCN_8900 | 53351 |
| CTCN_4049 | 39293 | GTCN_4748 | 53352 |
| TTCN_3313 | 39294 | CTCN_8901 | 53353 |
| ATCN_2360 | 39295 | CTCN_8902 | 53354 |
| ATCN_2361 | 39296 | CTCN_8903 | 53355 |
| CTCN_4050 | 39297 | CTCN_8904 | 53356 |
| TTCN_3314 | 39298 | TTCN_7269 | 53357 |
| TTCN_3315 | 39299 | ATCN_4979 | 53358 |
| GTCN_2116 | 39300 | TTCN_7270 | 53359 |
| CTCN_4051 | 39301 | CTCN_8905 | 53360 |
| ATCN_2362 | 39302 | GTCN_4749 | 53361 |
| ATCN_2363 | 39303 | CTCN_8906 | 53362 |
| GTCN_2117 | 39304 | ATCN_4980 | 53363 |
| GTCN_2118 | 39305 | ATCN_4981 | 53364 |
| GTCN_2119 | 39306 | CTCN_8907 | 53365 |
| GTCN_2120 | 39307 | GTCN_4750 | 53366 |
| GTCN_2121 | 39308 | CTCN_8908 | 53367 |
| CTCN_4052 | 39309 | GTCN_4751 | 53368 |
| GTCN_2122 | 39310 | ATCN_4982 | 53369 |
| CTCN_4053 | 39311 | GTCN_4752 | 53370 |
| CTCN_4054 | 39312 | CTCN_8909 | 53371 |
| CTCN_4055 | 39313 | ATCN_4983 | 53372 |
| TTCN_3316 | 39314 | TTCN_7271 | 53373 |
| GTCN_2123 | 39315 | TTCN_7272 | 53374 |
| CTCN_4056 | 39316 | CTCN_8910 | 53375 |
| TTCN_3317 | 39317 | GTCN_4753 | 53376 |
| ATCN_2364 | 39318 | CTCN_8911 | 53377 |

FIG. 37 (continued)

| | | | |
|---|---|---|---|
| ATCN_2365 | 39319 | TTCN_7273 | 53378 |
| ATCN_2366 | 39320 | TTCN_7274 | 53379 |
| ATCN_2367 | 39321 | CTCN_8912 | 53380 |
| TTCN_3318 | 39322 | CTCN_8913 | 53381 |
| TTCN_3319 | 39323 | TTCN_7275 | 53382 |
| GTCN_2124 | 39324 | TTCN_7276 | 53383 |
| GTCN_2125 | 39325 | GTCN_4754 | 53384 |
| ATCN_2368 | 39326 | TTCN_7277 | 53385 |
| ATCN_2369 | 39327 | GTCN_4755 | 53386 |
| TTCN_3320 | 39328 | CTCN_8914 | 53387 |
| TTCN_3321 | 39329 | CTCN_8915 | 53388 |
| ATCN_2370 | 39330 | CTCN_8916 | 53389 |
| ATCN_2371 | 39331 | ATCN_4984 | 53390 |
| ATCN_2372 | 39332 | CTCN_8917 | 53391 |
| CTCN_4057 | 39333 | CTCN_8918 | 53392 |
| ATCN_2373 | 39334 | CTCN_8919 | 53393 |
| CTCN_4058 | 39335 | TTCN_7278 | 53394 |
| GTCN_2126 | 39336 | TTCN_7279 | 53395 |
| CTCN_4059 | 39337 | ATCN_4985 | 53396 |
| CTCN_4060 | 39338 | TTCN_7280 | 53397 |
| CTCN_4061 | 39339 | GTCN_4756 | 53398 |
| ATCN_2374 | 39340 | CTCN_8920 | 53399 |
| ATCN_2375 | 39341 | CTCN_8921 | 53400 |
| CTCN_4062 | 39342 | CTCN_8922 | 53401 |
| ATCN_2376 | 39343 | CTCN_8923 | 53402 |
| ATCN_2377 | 39344 | ATCN_4986 | 53403 |
| CTCN_4063 | 39345 | TTCN_7281 | 53404 |
| TTCN_3322 | 39346 | ATCN_4987 | 53405 |
| ATCN_2378 | 39347 | CTCN_8924 | 53406 |
| TTCN_3323 | 39348 | GTCN_4757 | 53407 |
| CTCN_4064 | 39349 | TTCN_7282 | 53408 |
| CTCN_4065 | 39350 | ATCN_4988 | 53409 |
| CTCN_4066 | 39351 | TTCN_7283 | 53410 |
| CTCN_4067 | 39352 | CTCN_8925 | 53411 |
| TTCN_3324 | 39353 | CTCN_8926 | 53412 |
| GTCN_2127 | 39354 | TTCN_7284 | 53413 |
| TTCN_3325 | 39355 | TTCN_7285 | 53414 |
| CTCN_4068 | 39356 | ATCN_4989 | 53415 |
| GTCN_2128 | 39357 | GTCN_4758 | 53416 |
| GTCN_2129 | 39358 | CTCN_8927 | 53417 |
| CTCN_4069 | 39359 | GTCN_4759 | 53418 |
| TTCN_3326 | 39360 | TTCN_7286 | 53419 |
| CTCN_4070 | 39361 | CTCN_8928 | 53420 |

| | | | |
|---|---|---|---|
| ATCN_2379 | 39362 | GTCN_4760 | 53421 |
| ATCN_2380 | 39363 | ATCN_4990 | 53422 |
| CTCN_4071 | 39364 | CTCN_8929 | 53423 |
| ATCN_2381 | 39365 | CTCN_8930 | 53424 |
| ATCN_2382 | 39366 | CTCN_8931 | 53425 |
| CTCN_4072 | 39367 | GTCN_4761 | 53426 |
| GTCN_2130 | 39368 | TTCN_7287 | 53427 |
| CTCN_4073 | 39369 | TTCN_7288 | 53428 |
| ATCN_2383 | 39370 | GTCN_4762 | 53429 |
| CTCN_4074 | 39371 | CTCN_8932 | 53430 |
| ATCN_2384 | 39372 | TTCN_7289 | 53431 |
| ATCN_2385 | 39373 | CTCN_8933 | 53432 |
| TTCN_3327 | 39374 | CTCN_8934 | 53433 |
| CTCN_4075 | 39375 | CTCN_8935 | 53434 |
| TTCN_3328 | 39376 | CTCN_8936 | 53435 |
| TTCN_3329 | 39377 | CTCN_8937 | 53436 |
| GTCN_2131 | 39378 | GTCN_4763 | 53437 |
| CTCN_4076 | 39379 | TTCN_7290 | 53438 |
| ATCN_2386 | 39380 | GTCN_4764 | 53439 |
| CTCN_4077 | 39381 | CTCN_8938 | 53440 |
| ATCN_2387 | 39382 | GTCN_4765 | 53441 |
| CTCN_4078 | 39383 | CTCN_8939 | 53442 |
| ATCN_2388 | 39384 | CTCN_8940 | 53443 |
| TTCN_3330 | 39385 | CTCN_8941 | 53444 |
| CTCN_4079 | 39386 | ATCN_4991 | 53445 |
| TTCN_3331 | 39387 | ATCN_4992 | 53446 |
| GTCN_2132 | 39388 | CTCN_8942 | 53447 |
| CTCN_4080 | 39389 | GTCN_4766 | 53448 |
| CTCN_4081 | 39390 | ATCN_4993 | 53449 |
| GTCN_2133 | 39391 | CTCN_8943 | 53450 |
| CTCN_4082 | 39392 | CTCN_8944 | 53451 |
| ATCN_2389 | 39393 | CTCN_8945 | 53452 |
| TTCN_3332 | 39394 | TTCN_7291 | 53453 |
| CTCN_4083 | 39395 | GTCN_4767 | 53454 |
| ATCN_2390 | 39396 | TTCN_7292 | 53455 |
| CTCN_4084 | 39397 | TTCN_7293 | 53456 |
| CTCN_4085 | 39398 | CTCN_8946 | 53457 |
| GTCN_2134 | 39399 | TTCN_7294 | 53458 |
| GTCN_2135 | 39400 | CTCN_8947 | 53459 |
| CTCN_4086 | 39401 | TTCN_7295 | 53460 |
| CTCN_4087 | 39402 | TTCN_7296 | 53461 |
| GTCN_2136 | 39403 | GTCN_4768 | 53462 |
| CTCN_4088 | 39404 | CTCN_8948 | 53463 |

FIG. 37 (continued)

| | | | |
|---|---|---|---|
| TTCN_3333 | 39405 | TTCN_7297 | 53464 |
| CTCN_4089 | 39406 | GTCN_4769 | 53465 |
| ATCN_2391 | 39407 | CTCN_8949 | 53466 |
| ATCN_2392 | 39408 | TTCN_7298 | 53467 |
| ATCN_2393 | 39409 | CTCN_8950 | 53468 |
| CTCN_4090 | 39410 | GTCN_4770 | 53469 |
| CTCN_4091 | 39411 | CTCN_8951 | 53470 |
| CTCN_4092 | 39412 | CTCN_8952 | 53471 |
| ATCN_2394 | 39413 | GTCN_4771 | 53472 |
| TTCN_3334 | 39414 | CTCN_8953 | 53473 |
| ATCN_2395 | 39415 | TTCN_7299 | 53474 |
| TTCN_3335 | 39416 | ATCN_4994 | 53475 |
| CTCN_4093 | 39417 | CTCN_8954 | 53476 |
| TTCN_3336 | 39418 | ATCN_4995 | 53477 |
| GTCN_2137 | 39419 | TTCN_7300 | 53478 |
| TTCN_3337 | 39420 | TTCN_7301 | 53479 |
| TTCN_3338 | 39421 | TTCN_7302 | 53480 |
| CTCN_4094 | 39422 | TTCN_7303 | 53481 |
| CTCN_4095 | 39423 | TTCN_7304 | 53482 |
| TTCN_3339 | 39424 | GTCN_4772 | 53483 |
| TTCN_3340 | 39425 | TTCN_7305 | 53484 |
| TTCN_3341 | 39426 | CTCN_8955 | 53485 |
| TTCN_3342 | 39427 | GTCN_4773 | 53486 |
| TTCN_3343 | 39428 | TTCN_7306 | 53487 |
| ATCN_2396 | 39429 | CTCN_8956 | 53488 |
| ATCN_2397 | 39430 | GTCN_4774 | 53489 |
| TTCN_3344 | 39431 | TTCN_7307 | 53490 |
| TTCN_3345 | 39432 | CTCN_8957 | 53491 |
| CTCN_4096 | 39433 | TTCN_7308 | 53492 |
| CTCN_4097 | 39434 | TTCN_7309 | 53493 |
| CTCN_4098 | 39435 | GTCN_4775 | 53494 |
| TTCN_3346 | 39436 | ATCN_4996 | 53495 |
| TTCN_3347 | 39437 | CTCN_8958 | 53496 |
| GTCN_2138 | 39438 | ATCN_4997 | 53497 |
| CTCN_4099 | 39439 | CTCN_8959 | 53498 |
| CTCN_4100 | 39440 | CTCN_8960 | 53499 |
| TTCN_3348 | 39441 | TTCN_7310 | 53500 |
| TTCN_3349 | 39442 | GTCN_4776 | 53501 |
| CTCN_4101 | 39443 | CTCN_8961 | 53502 |
| TTCN_3350 | 39444 | TTCN_7311 | 53503 |
| ATCN_2398 | 39445 | TTCN_7312 | 53504 |
| TTCN_3351 | 39446 | TTCN_7313 | 53505 |
| CTCN_4102 | 39447 | TTCN_7314 | 53506 |

| | | | |
|---|---|---|---|
| CTCN_4103 | 39448 | ATCN_4998 | 53507 |
| ATCN_2399 | 39449 | ATCN_4999 | 53508 |
| TTCN_3352 | 39450 | TTCN_7315 | 53509 |
| CTCN_4104 | 39451 | CTCN_8962 | 53510 |
| TTCN_3353 | 39452 | TTCN_7316 | 53511 |
| ATCN_2400 | 39453 | TTCN_7317 | 53512 |
| CTCN_4105 | 39454 | TTCN_7318 | 53513 |
| ATCN_2401 | 39455 | CTCN_8963 | 53514 |
| CTCN_4106 | 39456 | ATCN_5000 | 53515 |
| TTCN_3354 | 39457 | CTCN_8964 | 53516 |
| TTCN_3355 | 39458 | GTCN_4777 | 53517 |
| TTCN_3356 | 39459 | CTCN_8965 | 53518 |
| CTCN_4107 | 39460 | ATCN_5001 | 53519 |
| TTCN_3357 | 39461 | TTCN_7319 | 53520 |
| CTCN_4108 | 39462 | TTCN_7320 | 53521 |
| CTCN_4109 | 39463 | TTCN_7321 | 53522 |
| GTCN_2139 | 39464 | TTCN_7322 | 53523 |
| ATCN_2402 | 39465 | TTCN_7323 | 53524 |
| ATCN_2403 | 39466 | CTCN_8966 | 53525 |
| CTCN_4110 | 39467 | TTCN_7324 | 53526 |
| ATCN_2404 | 39468 | GTCN_4778 | 53527 |
| ATCN_2405 | 39469 | GTCN_4779 | 53528 |
| TTCN_3358 | 39470 | TTCN_7325 | 53529 |
| ATCN_2406 | 39471 | TTCN_7326 | 53530 |
| CTCN_4111 | 39472 | GTCN_4780 | 53531 |
| CTCN_4112 | 39473 | TTCN_7327 | 53532 |
| ATCN_2407 | 39474 | CTCN_8967 | 53533 |
| CTCN_4113 | 39475 | GTCN_4781 | 53534 |
| TTCN_3359 | 39476 | CTCN_8968 | 53535 |
| CTCN_4114 | 39477 | TTCN_7328 | 53536 |
| TTCN_3360 | 39478 | TTCN_7329 | 53537 |
| ATCN_2408 | 39479 | TTCN_7330 | 53538 |
| TTCN_3361 | 39480 | CTCN_8969 | 53539 |
| GTCN_2140 | 39481 | TTCN_7331 | 53540 |
| CTCN_4115 | 39482 | TTCN_7332 | 53541 |
| GTCN_2141 | 39483 | CTCN_8970 | 53542 |
| CTCN_4116 | 39484 | CTCN_8971 | 53543 |
| CTCN_4117 | 39485 | TTCN_7333 | 53544 |
| CTCN_4118 | 39486 | ATCN_5002 | 53545 |
| GTCN_2142 | 39487 | CTCN_8972 | 53546 |
| CTCN_4119 | 39488 | ATCN_5003 | 53547 |
| CTCN_4120 | 39489 | TTCN_7334 | 53548 |
| CTCN_4121 | 39490 | CTCN_8973 | 53549 |

FIG. 37 (continued)

| | | | |
|---|---|---|---|
| ATCN_2409 | 39491 | GTCN_4782 | 53550 |
| ATCN_2410 | 39492 | CTCN_8974 | 53551 |
| TTCN_3362 | 39493 | TTCN_7335 | 53552 |
| TTCN_3363 | 39494 | TTCN_7336 | 53553 |
| CTCN_4122 | 39495 | CTCN_8975 | 53554 |
| TTCN_3364 | 39496 | CTCN_8976 | 53555 |
| TTCN_3365 | 39497 | ATCN_5004 | 53556 |
| CTCN_4123 | 39498 | TTCN_7337 | 53557 |
| TTCN_3366 | 39499 | GTCN_4783 | 53558 |
| ATCN_2411 | 39500 | CTCN_8977 | 53559 |
| ATCN_2412 | 39501 | TTCN_7338 | 53560 |
| CTCN_4124 | 39502 | CTCN_8978 | 53561 |
| ATCN_2413 | 39503 | CTCN_8979 | 53562 |
| ATCN_2414 | 39504 | CTCN_8980 | 53563 |
| CTCN_4125 | 39505 | CTCN_8981 | 53564 |
| GTCN_2143 | 39506 | TTCN_7339 | 53565 |
| CTCN_4126 | 39507 | TTCN_7340 | 53566 |
| TTCN_3367 | 39508 | ATCN_5005 | 53567 |
| CTCN_4127 | 39509 | ATCN_5006 | 53568 |
| GTCN_2144 | 39510 | ATCN_5007 | 53569 |
| TTCN_3368 | 39511 | CTCN_8982 | 53570 |
| GTCN_2145 | 39512 | CTCN_8983 | 53571 |
| CTCN_4128 | 39513 | GTCN_4784 | 53572 |
| GTCN_2146 | 39514 | TTCN_7341 | 53573 |
| ATCN_2415 | 39515 | CTCN_8984 | 53574 |
| CTCN_4129 | 39516 | GTCN_4785 | 53575 |
| CTCN_4130 | 39517 | GTCN_4786 | 53576 |
| TTCN_3369 | 39518 | CTCN_8985 | 53577 |
| ATCN_2416 | 39519 | GTCN_4787 | 53578 |
| CTCN_4131 | 39520 | ATCN_5008 | 53579 |
| CTCN_4132 | 39521 | ATCN_5009 | 53580 |
| CTCN_4133 | 39522 | ATCN_5010 | 53581 |
| CTCN_4134 | 39523 | CTCN_8986 | 53582 |
| ATCN_2417 | 39524 | CTCN_8987 | 53583 |
| CTCN_4135 | 39525 | GTCN_4788 | 53584 |
| ATCN_2418 | 39526 | TTCN_7342 | 53585 |
| ATCN_2419 | 39527 | CTCN_8988 | 53586 |
| ATCN_2420 | 39528 | ATCN_5011 | 53587 |
| CTCN_4136 | 39529 | ATCN_5012 | 53588 |
| CTCN_4137 | 39530 | CTCN_8989 | 53589 |
| CTCN_4138 | 39531 | CTCN_8990 | 53590 |
| TTCN_3370 | 39532 | GTCN_4789 | 53591 |
| GTCN_2147 | 39533 | CTCN_8991 | 53592 |

| | | | |
|---|---|---|---|
| CTCN_4139 | 39534 | GTCN_4790 | 53593 |
| GTCN_2148 | 39535 | GTCN_4791 | 53594 |
| CTCN_4140 | 39536 | CTCN_8992 | 53595 |
| CTCN_4141 | 39537 | GTCN_4792 | 53596 |
| GTCN_2149 | 39538 | TTCN_7343 | 53597 |
| ATCN_2421 | 39539 | CTCN_8993 | 53598 |
| CTCN_4142 | 39540 | CTCN_8994 | 53599 |
| TTCN_3371 | 39541 | ATCN_5013 | 53600 |
| TTCN_3372 | 39542 | ATCN_5014 | 53601 |
| TTCN_3373 | 39543 | CTCN_8995 | 53602 |
| CTCN_4143 | 39544 | CTCN_8996 | 53603 |
| TTCN_3374 | 39545 | ATCN_5015 | 53604 |
| TTCN_3375 | 39546 | CTCN_8997 | 53605 |
| CTCN_4144 | 39547 | TTCN_7344 | 53606 |
| GTCN_2150 | 39548 | TTCN_7345 | 53607 |
| TTCN_3376 | 39549 | TTCN_7346 | 53608 |
| TTCN_3377 | 39550 | TTCN_7347 | 53609 |
| ATCN_2422 | 39551 | TTCN_7348 | 53610 |
| TTCN_3378 | 39552 | TTCN_7349 | 53611 |
| GTCN_2151 | 39553 | TTCN_7350 | 53612 |
| ATCN_2423 | 39554 | CTCN_8998 | 53613 |
| CTCN_4145 | 39555 | CTCN_8999 | 53614 |
| ATCN_2424 | 39556 | TTCN_7351 | 53615 |
| CTCN_4146 | 39557 | TTCN_7352 | 53616 |
| TTCN_3379 | 39558 | ATCN_5016 | 53617 |
| ATCN_2425 | 39559 | TTCN_7353 | 53618 |
| CTCN_4147 | 39560 | TTCN_7354 | 53619 |
| CTCN_4148 | 39561 | CTCN_9000 | 53620 |
| CTCN_4149 | 39562 | ATCN_5017 | 53621 |
| GTCN_2152 | 39563 | GTCN_4793 | 53622 |
| CTCN_4150 | 39564 | TTCN_7355 | 53623 |
| TTCN_3380 | 39565 | CTCN_9001 | 53624 |
| ATCN_2426 | 39566 | CTCN_9002 | 53625 |
| CTCN_4151 | 39567 | CTCN_9003 | 53626 |
| TTCN_3381 | 39568 | TTCN_7356 | 53627 |
| GTCN_2153 | 39569 | CTCN_9004 | 53628 |
| CTCN_4152 | 39570 | TTCN_7357 | 53629 |
| CTCN_4153 | 39571 | GTCN_4794 | 53630 |
| CTCN_4154 | 39572 | TTCN_7358 | 53631 |
| CTCN_4155 | 39573 | GTCN_4795 | 53632 |
| ATCN_2427 | 39574 | TTCN_7359 | 53633 |
| CTCN_4156 | 39575 | TTCN_7360 | 53634 |
| CTCN_4157 | 39576 | TTCN_7361 | 53635 |

FIG. 37 (continued)

| | | | | | | | |
|---|---|---|---|---|---|---|---|
| TTCN_3382 | 39577 | TTCN_7362 | 53636 | CTCN_4174 | 39620 | CTCN_9023 | 53679 |
| GTCN_2154 | 39578 | GTCN_4796 | 53637 | ATCN_2440 | 39621 | CTCN_9024 | 53680 |
| ATCN_2428 | 39579 | GTCN_4797 | 53638 | ATCN_2441 | 39622 | GTCN_4805 | 53681 |
| GTCN_2155 | 39580 | ATCN_5018 | 53639 | CTCN_4175 | 39623 | ATCN_5025 | 53682 |
| CTCN_4158 | 39581 | TTCN_7363 | 53640 | CTCN_4176 | 39624 | TTCN_7371 | 53683 |
| GTCN_2156 | 39582 | TTCN_7364 | 53641 | CTCN_4177 | 39625 | ATCN_5026 | 53684 |
| ATCN_2429 | 39583 | TTCN_7365 | 53642 | CTCN_4178 | 39626 | CTCN_9025 | 53685 |
| CTCN_4159 | 39584 | CTCN_9005 | 53643 | CTCN_4179 | 39627 | TTCN_7372 | 53686 |
| ATCN_2430 | 39585 | GTCN_4798 | 53644 | TTCN_3386 | 39628 | GTCN_4806 | 53687 |
| ATCN_2431 | 39586 | CTCN_9006 | 53645 | GTCN_2165 | 39629 | ATCN_5027 | 53688 |
| GTCN_2157 | 39587 | CTCN_9007 | 53646 | TTCN_3387 | 39630 | ATCN_5028 | 53689 |
| GTCN_2158 | 39588 | GTCN_4799 | 53647 | CTCN_4180 | 39631 | CTCN_9026 | 53690 |
| GTCN_2159 | 39589 | CTCN_9008 | 53648 | CTCN_4181 | 39632 | CTCN_9027 | 53691 |
| CTCN_4160 | 39590 | ATCN_5019 | 53649 | CTCN_4182 | 39633 | GTCN_4807 | 53692 |
| CTCN_4161 | 39591 | ATCN_5020 | 53650 | CTCN_4183 | 39634 | ATCN_5029 | 53693 |
| GTCN_2160 | 39592 | CTCN_9009 | 53651 | GTCN_2166 | 39635 | GTCN_4808 | 53694 |
| CTCN_4162 | 39593 | CTCN_9010 | 53652 | CTCN_4184 | 39636 | TTCN_7373 | 53695 |
| ATCN_2432 | 39594 | CTCN_9011 | 53653 | ATCN_2442 | 39637 | GTCN_4809 | 53696 |
| ATCN_2433 | 39595 | CTCN_9012 | 53654 | GTCN_2167 | 39638 | CTCN_9028 | 53697 |
| CTCN_4163 | 39596 | TTCN_7366 | 53655 | CTCN_4185 | 39639 | GTCN_4810 | 53698 |
| CTCN_4164 | 39597 | ATCN_5021 | 53656 | CTCN_4186 | 39640 | ATCN_5030 | 53699 |
| CTCN_4165 | 39598 | TTCN_7367 | 53657 | TTCN_3388 | 39641 | TTCN_7374 | 53700 |
| CTCN_4166 | 39599 | CTCN_9013 | 53658 | GTCN_2168 | 39642 | TTCN_7375 | 53701 |
| ATCN_2434 | 39600 | CTCN_9014 | 53659 | GTCN_2169 | 39643 | ATCN_5031 | 53702 |
| ATCN_2435 | 39601 | GTCN_4800 | 53660 | TTCN_3389 | 39644 | ATCN_5032 | 53703 |
| TTCN_3383 | 39602 | GTCN_4801 | 53661 | CTCN_4187 | 39645 | GTCN_4811 | 53704 |
| GTCN_2161 | 39603 | TTCN_7368 | 53662 | GTCN_2170 | 39646 | TTCN_7376 | 53705 |
| GTCN_2162 | 39604 | CTCN_9015 | 53663 | TTCN_3390 | 39647 | CTCN_9029 | 53706 |
| CTCN_4167 | 39605 | GTCN_4802 | 53664 | GTCN_2171 | 39648 | ATCN_5033 | 53707 |
| TTCN_3384 | 39606 | ATCN_5022 | 53665 | ATCN_2443 | 39649 | TTCN_7377 | 53708 |
| ATCN_2436 | 39607 | CTCN_9016 | 53666 | ATCN_2444 | 39650 | ATCN_5034 | 53709 |
| ATCN_2437 | 39608 | TTCN_7369 | 53667 | ATCN_2445 | 39651 | ATCN_5035 | 53710 |
| CTCN_4168 | 39609 | CTCN_9017 | 53668 | CTCN_4188 | 39652 | GTCN_4812 | 53711 |
| CTCN_4169 | 39610 | GTCN_4803 | 53669 | TTCN_3391 | 39653 | TTCN_7378 | 53712 |
| GTCN_2163 | 39611 | CTCN_9018 | 53670 | CTCN_4189 | 39654 | CTCN_9030 | 53713 |
| CTCN_4170 | 39612 | ATCN_5023 | 53671 | CTCN_4190 | 39655 | ATCN_5036 | 53714 |
| CTCN_4171 | 39613 | ATCN_5024 | 53672 | ATCN_2446 | 39656 | TTCN_7379 | 53715 |
| TTCN_3385 | 39614 | CTCN_9019 | 53673 | CTCN_4191 | 39657 | CTCN_9031 | 53716 |
| CTCN_4172 | 39615 | CTCN_9020 | 53674 | TTCN_3392 | 39658 | GTCN_4813 | 53717 |
| GTCN_2164 | 39616 | CTCN_9021 | 53675 | ATCN_2447 | 39659 | CTCN_9032 | 53718 |
| CTCN_4173 | 39617 | TTCN_7370 | 53676 | TTCN_3393 | 39660 | ATCN_5037 | 53719 |
| ATCN_2438 | 39618 | CTCN_9022 | 53677 | CTCN_4192 | 39661 | ATCN_5038 | 53720 |
| ATCN_2439 | 39619 | GTCN_4804 | 53678 | GTCN_2172 | 39662 | TTCN_7380 | 53721 |

FIG. 37 (continued)

| | | | |
|---|---|---|---|
| GTCN_2173 | 39663 | GTCN_4814 | 53722 |
| TTCN_3394 | 39664 | CTCN_9033 | 53723 |
| CTCN_4193 | 39665 | GTCN_4815 | 53724 |
| ATCN_2448 | 39666 | TTCN_7381 | 53725 |
| GTCN_2174 | 39667 | TTCN_7382 | 53726 |
| TTCN_3395 | 39668 | ATCN_5039 | 53727 |
| CTCN_4194 | 39669 | TTCN_7383 | 53728 |
| CTCN_4195 | 39670 | CTCN_9034 | 53729 |
| TTCN_3396 | 39671 | TTCN_7384 | 53730 |
| ATCN_2449 | 39672 | TTCN_7385 | 53731 |
| TTCN_3397 | 39673 | TTCN_7386 | 53732 |
| GTCN_2175 | 39674 | TTCN_7387 | 53733 |
| CTCN_4196 | 39675 | GTCN_4816 | 53734 |
| CTCN_4197 | 39676 | ATCN_5040 | 53735 |
| CTCN_4198 | 39677 | GTCN_4817 | 53736 |
| TTCN_3398 | 39678 | TTCN_7388 | 53737 |
| TTCN_3399 | 39679 | TTCN_7389 | 53738 |
| TTCN_3400 | 39680 | GTCN_4818 | 53739 |
| CTCN_4199 | 39681 | ATCN_5041 | 53740 |
| CTCN_4200 | 39682 | GTCN_4819 | 53741 |
| CTCN_4201 | 39683 | CTCN_9035 | 53742 |
| CTCN_4202 | 39684 | CTCN_9036 | 53743 |
| CTCN_4203 | 39685 | CTCN_9037 | 53744 |
| GTCN_2176 | 39686 | GTCN_4820 | 53745 |
| CTCN_4204 | 39687 | TTCN_7390 | 53746 |
| CTCN_4205 | 39688 | ATCN_5042 | 53747 |
| GTCN_2177 | 39689 | GTCN_4821 | 53748 |
| CTCN_4206 | 39690 | CTCN_9038 | 53749 |
| GTCN_2178 | 39691 | ATCN_5043 | 53750 |
| TTCN_3401 | 39692 | ATCN_5044 | 53751 |
| CTCN_4207 | 39693 | TTCN_7391 | 53752 |
| CTCN_4208 | 39694 | TTCN_7392 | 53753 |
| ATCN_2450 | 39695 | GTCN_4822 | 53754 |
| CTCN_4209 | 39696 | CTCN_9039 | 53755 |
| CTCN_4210 | 39697 | TTCN_7393 | 53756 |
| CTCN_4211 | 39698 | CTCN_9040 | 53757 |
| ATCN_2451 | 39699 | CTCN_9041 | 53758 |
| GTCN_2179 | 39700 | GTCN_4823 | 53759 |
| CTCN_4212 | 39701 | CTCN_9042 | 53760 |
| GTCN_2180 | 39702 | ATCN_5045 | 53761 |
| CTCN_4213 | 39703 | ATCN_5046 | 53762 |
| GTCN_2181 | 39704 | CTCN_9043 | 53763 |
| CTCN_4214 | 39705 | TTCN_7394 | 53764 |

| | | | |
|---|---|---|---|
| CTCN_4215 | 39706 | GTCN_4824 | 53765 |
| GTCN_2182 | 39707 | GTCN_4825 | 53766 |
| TTCN_3402 | 39708 | GTCN_4826 | 53767 |
| TTCN_3403 | 39709 | CTCN_9044 | 53768 |
| CTCN_4216 | 39710 | ATCN_5047 | 53769 |
| GTCN_2183 | 39711 | CTCN_9045 | 53770 |
| CTCN_4217 | 39712 | CTCN_9046 | 53771 |
| CTCN_4218 | 39713 | TTCN_7395 | 53772 |
| CTCN_4219 | 39714 | CTCN_9047 | 53773 |
| CTCN_4220 | 39715 | TTCN_7396 | 53774 |
| CTCN_4221 | 39716 | ATCN_5048 | 53775 |
| GTCN_2184 | 39717 | CTCN_9048 | 53776 |
| CTCN_4222 | 39718 | TTCN_7397 | 53777 |
| CTCN_4223 | 39719 | CTCN_9049 | 53778 |
| GTCN_2185 | 39720 | CTCN_9050 | 53779 |
| CTCN_4224 | 39721 | TTCN_7398 | 53780 |
| GTCN_2186 | 39722 | CTCN_9051 | 53781 |
| CTCN_4225 | 39723 | ATCN_5049 | 53782 |
| GTCN_2187 | 39724 | ATCN_5050 | 53783 |
| CTCN_4226 | 39725 | CTCN_9052 | 53784 |
| CTCN_4227 | 39726 | TTCN_7399 | 53785 |
| GTCN_2188 | 39727 | GTCN_4827 | 53786 |
| ATCN_2452 | 39728 | GTCN_4828 | 53787 |
| CTCN_4228 | 39729 | CTCN_9053 | 53788 |
| GTCN_2189 | 39730 | GTCN_4829 | 53789 |
| TTCN_3404 | 39731 | CTCN_9054 | 53790 |
| ATCN_2453 | 39732 | GTCN_4830 | 53791 |
| GTCN_2190 | 39733 | CTCN_9055 | 53792 |
| CTCN_4229 | 39734 | TTCN_7400 | 53793 |
| GTCN_2191 | 39735 | CTCN_9056 | 53794 |
| ATCN_2454 | 39736 | ATCN_5051 | 53795 |
| GTCN_2192 | 39737 | GTCN_4831 | 53796 |
| CTCN_4230 | 39738 | CTCN_9057 | 53797 |
| GTCN_2193 | 39739 | ATCN_5052 | 53798 |
| CTCN_4231 | 39740 | TTCN_7401 | 53799 |
| TTCN_3405 | 39741 | GTCN_4832 | 53800 |
| TTCN_3406 | 39742 | TTCN_7402 | 53801 |
| CTCN_4232 | 39743 | TTCN_7403 | 53802 |
| TTCN_3407 | 39744 | GTCN_4833 | 53803 |
| CTCN_4233 | 39745 | TTCN_7404 | 53804 |
| CTCN_4234 | 39746 | ATCN_5053 | 53805 |
| TTCN_3408 | 39747 | GTCN_4834 | 53806 |
| ATCN_2455 | 39748 | CTCN_9058 | 53807 |

FIG. 37 (continued)

| | | | | | | | |
|---|---|---|---|---|---|---|---|
| GTCN_2194 | 39749 | TTCN_7405 | 53808 | CTCN_4257 | 39792 | TTCN_7420 | 53851 |
| CTCN_4235 | 39750 | GTCN_4835 | 53809 | ATCN_2460 | 39793 | GTCN_4844 | 53852 |
| CTCN_4236 | 39751 | TTCN_7406 | 53810 | CTCN_4258 | 39794 | TTCN_7421 | 53853 |
| GTCN_2195 | 39752 | GTCN_4836 | 53811 | CTCN_4259 | 39795 | TTCN_7422 | 53854 |
| TTCN_3409 | 39753 | CTCN_9059 | 53812 | GTCN_2201 | 39796 | TTCN_7423 | 53855 |
| TTCN_3410 | 39754 | ATCN_5054 | 53813 | CTCN_4260 | 39797 | CTCN_9072 | 53856 |
| CTCN_4237 | 39755 | CTCN_9060 | 53814 | GTCN_2202 | 39798 | TTCN_7424 | 53857 |
| GTCN_2196 | 39756 | CTCN_9061 | 53815 | TTCN_3419 | 39799 | CTCN_9073 | 53858 |
| CTCN_4238 | 39757 | GTCN_4837 | 53816 | CTCN_4261 | 39800 | ATCN_5060 | 53859 |
| TTCN_3411 | 39758 | CTCN_9062 | 53817 | TTCN_3420 | 39801 | TTCN_7425 | 53860 |
| ATCN_2456 | 39759 | TTCN_7407 | 53818 | CTCN_4262 | 39802 | CTCN_9074 | 53861 |
| ATCN_2457 | 39760 | CTCN_9063 | 53819 | GTCN_2203 | 39803 | TTCN_7426 | 53862 |
| TTCN_3412 | 39761 | TTCN_7408 | 53820 | ATCN_2461 | 39804 | TTCN_7427 | 53863 |
| CTCN_4239 | 39762 | GTCN_4838 | 53821 | GTCN_2204 | 39805 | TTCN_7428 | 53864 |
| CTCN_4240 | 39763 | GTCN_4839 | 53822 | CTCN_4263 | 39806 | CTCN_9075 | 53865 |
| CTCN_4241 | 39764 | CTCN_9064 | 53823 | GTCN_2205 | 39807 | GTCN_4845 | 53866 |
| ATCN_2458 | 39765 | TTCN_7409 | 53824 | CTCN_4264 | 39808 | GTCN_4846 | 53867 |
| CTCN_4242 | 39766 | TTCN_7410 | 53825 | CTCN_4265 | 39809 | TTCN_7429 | 53868 |
| GTCN_2197 | 39767 | CTCN_9065 | 53826 | TTCN_3421 | 39810 | ATCN_5061 | 53869 |
| TTCN_3413 | 39768 | CTCN_9066 | 53827 | ATCN_2462 | 39811 | TTCN_7430 | 53870 |
| TTCN_3414 | 39769 | TTCN_7411 | 53828 | TTCN_3422 | 39812 | CTCN_9076 | 53871 |
| CTCN_4243 | 39770 | TTCN_7412 | 53829 | CTCN_4266 | 39813 | CTCN_9077 | 53872 |
| TTCN_3415 | 39771 | TTCN_7413 | 53830 | CTCN_4267 | 39814 | TTCN_7431 | 53873 |
| GTCN_2198 | 39772 | TTCN_7414 | 53831 | ATCN_2463 | 39815 | TTCN_7432 | 53874 |
| CTCN_4244 | 39773 | CTCN_9067 | 53832 | CTCN_4268 | 39816 | GTCN_4847 | 53875 |
| CTCN_4245 | 39774 | TTCN_7415 | 53833 | ATCN_2464 | 39817 | TTCN_7433 | 53876 |
| CTCN_4246 | 39775 | CTCN_9068 | 53834 | CTCN_4269 | 39818 | CTCN_9078 | 53877 |
| CTCN_4247 | 39776 | GTCN_4840 | 53835 | CTCN_4270 | 39819 | TTCN_7434 | 53878 |
| TTCN_3416 | 39777 | ATCN_5055 | 53836 | CTCN_4271 | 39820 | CTCN_9079 | 53879 |
| CTCN_4248 | 39778 | ATCN_5056 | 53837 | CTCN_4272 | 39821 | CTCN_9080 | 53880 |
| CTCN_4249 | 39779 | TTCN_7416 | 53838 | CTCN_4273 | 39822 | TTCN_7435 | 53881 |
| CTCN_4250 | 39780 | GTCN_4841 | 53839 | CTCN_4274 | 39823 | TTCN_7436 | 53882 |
| CTCN_4251 | 39781 | CTCN_9069 | 53840 | TTCN_3423 | 39824 | GTCN_4848 | 53883 |
| TTCN_3417 | 39782 | TTCN_7417 | 53841 | CTCN_4275 | 39825 | TTCN_7437 | 53884 |
| CTCN_4252 | 39783 | ATCN_5057 | 53842 | GTCN_2206 | 39826 | TTCN_7438 | 53885 |
| CTCN_4253 | 39784 | ATCN_5058 | 53843 | TTCN_3424 | 39827 | TTCN_7439 | 53886 |
| ATCN_2459 | 39785 | ATCN_5059 | 53844 | GTCN_2207 | 39828 | GTCN_4849 | 53887 |
| CTCN_4254 | 39786 | GTCN_4842 | 53845 | GTCN_2208 | 39829 | ATCN_5062 | 53888 |
| GTCN_2199 | 39787 | CTCN_9070 | 53846 | TTCN_3425 | 39830 | ATCN_5063 | 53889 |
| TTCN_3418 | 39788 | CTCN_9071 | 53847 | ATCN_2465 | 39831 | ATCN_5064 | 53890 |
| CTCN_4255 | 39789 | TTCN_7418 | 53848 | CTCN_4276 | 39832 | ATCN_5065 | 53891 |
| GTCN_2200 | 39790 | GTCN_4843 | 53849 | GTCN_2209 | 39833 | TTCN_7440 | 53892 |
| CTCN_4256 | 39791 | TTCN_7419 | 53850 | GTCN_2210 | 39834 | CTCN_9081 | 53893 |

FIG. 37 (continued)

| | | | |
|---|---|---|---|
| CTCN_4277 | 39835 | TTCN_7441 | 53894 |
| TTCN_3426 | 39836 | GTCN_4850 | 53895 |
| TTCN_3427 | 39837 | TTCN_7442 | 53896 |
| CTCN_4278 | 39838 | TTCN_7443 | 53897 |
| TTCN_3428 | 39839 | GTCN_4851 | 53898 |
| CTCN_4279 | 39840 | GTCN_4852 | 53899 |
| CTCN_4280 | 39841 | ATCN_5066 | 53900 |
| GTCN_2211 | 39842 | TTCN_7444 | 53901 |
| CTCN_4281 | 39843 | CTCN_9082 | 53902 |
| CTCN_4282 | 39844 | TTCN_7445 | 53903 |
| CTCN_4283 | 39845 | GTCN_4853 | 53904 |
| TTCN_3429 | 39846 | ATCN_5067 | 53905 |
| CTCN_4284 | 39847 | TTCN_7446 | 53906 |
| CTCN_4285 | 39848 | CTCN_9083 | 53907 |
| CTCN_4286 | 39849 | TTCN_7447 | 53908 |
| TTCN_3430 | 39850 | CTCN_9084 | 53909 |
| CTCN_4287 | 39851 | ATCN_5068 | 53910 |
| TTCN_3431 | 39852 | CTCN_9085 | 53911 |
| GTCN_2212 | 39853 | GTCN_4854 | 53912 |
| ATCN_2466 | 39854 | ATCN_5069 | 53913 |
| TTCN_3432 | 39855 | GTCN_4855 | 53914 |
| CTCN_4288 | 39856 | GTCN_4856 | 53915 |
| TTCN_3433 | 39857 | GTCN_4857 | 53916 |
| TTCN_3434 | 39858 | TTCN_7448 | 53917 |
| ATCN_2467 | 39859 | GTCN_4858 | 53918 |
| ATCN_2468 | 39860 | GTCN_4859 | 53919 |
| ATCN_2469 | 39861 | TTCN_7449 | 53920 |
| ATCN_2470 | 39862 | GTCN_4860 | 53921 |
| ATCN_2471 | 39863 | TTCN_7450 | 53922 |
| TTCN_3435 | 39864 | CTCN_9086 | 53923 |
| GTCN_2213 | 39865 | GTCN_4861 | 53924 |
| CTCN_4289 | 39866 | TTCN_7451 | 53925 |
| GTCN_2214 | 39867 | ATCN_5070 | 53926 |
| ATCN_2472 | 39868 | TTCN_7452 | 53927 |
| TTCN_3436 | 39869 | TTCN_7453 | 53928 |
| TTCN_3437 | 39870 | TTCN_7454 | 53929 |
| TTCN_3438 | 39871 | TTCN_7455 | 53930 |
| GTCN_2215 | 39872 | ATCN_5071 | 53931 |
| GTCN_2216 | 39873 | ATCN_5072 | 53932 |
| ATCN_2473 | 39874 | ATCN_5073 | 53933 |
| CTCN_4290 | 39875 | CTCN_9087 | 53934 |
| TTCN_3439 | 39876 | CTCN_9088 | 53935 |
| ATCN_2474 | 39877 | CTCN_9089 | 53936 |

| | | | |
|---|---|---|---|
| CTCN_4291 | 39878 | ATCN_5074 | 53937 |
| ATCN_2475 | 39879 | ATCN_5075 | 53938 |
| TTCN_3440 | 39880 | GTCN_4862 | 53939 |
| TTCN_3441 | 39881 | TTCN_7456 | 53940 |
| GTCN_2217 | 39882 | TTCN_7457 | 53941 |
| CTCN_4292 | 39883 | ATCN_5076 | 53942 |
| TTCN_3442 | 39884 | ATCN_5077 | 53943 |
| TTCN_3443 | 39885 | ATCN_5078 | 53944 |
| TTCN_3444 | 39886 | CTCN_9090 | 53945 |
| TTCN_3445 | 39887 | GTCN_4863 | 53946 |
| CTCN_4293 | 39888 | CTCN_9091 | 53947 |
| CTCN_4294 | 39889 | TTCN_7458 | 53948 |
| TTCN_3446 | 39890 | GTCN_4864 | 53949 |
| TTCN_3447 | 39891 | GTCN_4865 | 53950 |
| ATCN_2476 | 39892 | ATCN_5079 | 53951 |
| CTCN_4295 | 39893 | GTCN_4866 | 53952 |
| GTCN_2218 | 39894 | ATCN_5080 | 53953 |
| TTCN_3448 | 39895 | CTCN_9092 | 53954 |
| TTCN_3449 | 39896 | ATCN_5081 | 53955 |
| TTCN_3450 | 39897 | GTCN_4867 | 53956 |
| CTCN_4296 | 39898 | GTCN_4868 | 53957 |
| CTCN_4297 | 39899 | GTCN_4869 | 53958 |
| TTCN_3451 | 39900 | GTCN_4870 | 53959 |
| TTCN_3452 | 39901 | TTCN_7459 | 53960 |
| CTCN_4298 | 39902 | GTCN_4871 | 53961 |
| GTCN_2219 | 39903 | CTCN_9093 | 53962 |
| TTCN_3453 | 39904 | TTCN_7460 | 53963 |
| CTCN_4299 | 39905 | GTCN_4872 | 53964 |
| TTCN_3454 | 39906 | TTCN_7461 | 53965 |
| GTCN_2220 | 39907 | TTCN_7462 | 53966 |
| GTCN_2221 | 39908 | TTCN_7463 | 53967 |
| GTCN_2222 | 39909 | CTCN_9094 | 53968 |
| CTCN_4300 | 39910 | TTCN_7464 | 53969 |
| CTCN_4301 | 39911 | CTCN_9095 | 53970 |
| CTCN_4302 | 39912 | GTCN_4873 | 53971 |
| CTCN_4303 | 39913 | CTCN_9096 | 53972 |
| GTCN_2223 | 39914 | CTCN_9097 | 53973 |
| CTCN_4304 | 39915 | CTCN_9098 | 53974 |
| GTCN_2224 | 39916 | TTCN_7465 | 53975 |
| CTCN_4305 | 39917 | ATCN_5082 | 53976 |
| GTCN_2225 | 39918 | GTCN_4874 | 53977 |
| TTCN_3455 | 39919 | CTCN_9099 | 53978 |
| CTCN_4306 | 39920 | TTCN_7466 | 53979 |

FIG. 37 (continued)

| | | | | | | | |
|---|---|---|---|---|---|---|---|
| CTCN_4307 | 39921 | CTCN_9100 | 53980 | TTCN_3468 | 39964 | ATCN_5092 | 54023 |
| TTCN_3456 | 39922 | CTCN_9101 | 53981 | ATCN_2480 | 39965 | TTCN_7478 | 54024 |
| TTCN_3457 | 39923 | GTCN_4875 | 53982 | GTCN_2235 | 39966 | CTCN_9114 | 54025 |
| ATCN_2477 | 39924 | CTCN_9102 | 53983 | CTCN_4326 | 39967 | ATCN_5093 | 54026 |
| CTCN_4308 | 39925 | GTCN_4876 | 53984 | TTCN_3469 | 39968 | CTCN_9115 | 54027 |
| TTCN_3458 | 39926 | ATCN_5083 | 53985 | CTCN_4327 | 39969 | CTCN_9116 | 54028 |
| GTCN_2226 | 39927 | TTCN_7467 | 53986 | CTCN_4328 | 39970 | CTCN_9117 | 54029 |
| TTCN_3459 | 39928 | TTCN_7468 | 53987 | TTCN_3470 | 39971 | ATCN_5094 | 54030 |
| ATCN_2478 | 39929 | ATCN_5084 | 53988 | CTCN_4329 | 39972 | ATCN_5095 | 54031 |
| TTCN_3460 | 39930 | TTCN_7469 | 53989 | ATCN_2481 | 39973 | CTCN_9118 | 54032 |
| GTCN_2227 | 39931 | CTCN_9103 | 53990 | TTCN_3471 | 39974 | GTCN_4884 | 54033 |
| TTCN_3461 | 39932 | CTCN_9104 | 53991 | GTCN_2236 | 39975 | CTCN_9119 | 54034 |
| GTCN_2228 | 39933 | GTCN_4877 | 53992 | CTCN_4330 | 39976 | TTCN_7479 | 54035 |
| CTCN_4309 | 39934 | CTCN_9105 | 53993 | GTCN_2237 | 39977 | CTCN_9120 | 54036 |
| CTCN_4310 | 39935 | ATCN_5085 | 53994 | GTCN_2238 | 39978 | GTCN_4885 | 54037 |
| CTCN_4311 | 39936 | GTCN_4878 | 53995 | GTCN_2239 | 39979 | CTCN_9121 | 54038 |
| CTCN_4312 | 39937 | TTCN_7470 | 53996 | CTCN_4331 | 39980 | TTCN_7480 | 54039 |
| CTCN_4313 | 39938 | GTCN_4879 | 53997 | GTCN_2240 | 39981 | TTCN_7481 | 54040 |
| CTCN_4314 | 39939 | CTCN_9106 | 53998 | TTCN_3472 | 39982 | CTCN_9122 | 54041 |
| ATCN_2479 | 39940 | ATCN_5086 | 53999 | GTCN_2241 | 39983 | TTCN_7482 | 54042 |
| CTCN_4315 | 39941 | TTCN_7471 | 54000 | ATCN_2482 | 39984 | GTCN_4886 | 54043 |
| TTCN_3462 | 39942 | TTCN_7472 | 54001 | TTCN_3473 | 39985 | CTCN_9123 | 54044 |
| CTCN_4316 | 39943 | TTCN_7473 | 54002 | GTCN_2242 | 39986 | CTCN_9124 | 54045 |
| GTCN_2229 | 39944 | TTCN_7474 | 54003 | TTCN_3474 | 39987 | GTCN_4887 | 54046 |
| GTCN_2230 | 39945 | ATCN_5087 | 54004 | TTCN_3475 | 39988 | TTCN_7483 | 54047 |
| TTCN_3463 | 39946 | CTCN_9107 | 54005 | TTCN_3476 | 39989 | GTCN_4888 | 54048 |
| CTCN_4317 | 39947 | CTCN_9108 | 54006 | TTCN_3477 | 39990 | CTCN_9125 | 54049 |
| GTCN_2231 | 39948 | ATCN_5088 | 54007 | ATCN_2483 | 39991 | GTCN_4889 | 54050 |
| TTCN_3464 | 39949 | ATCN_5089 | 54008 | CTCN_4332 | 39992 | TTCN_7484 | 54051 |
| GTCN_2232 | 39950 | GTCN_4880 | 54009 | CTCN_4333 | 39993 | ATCN_5096 | 54052 |
| CTCN_4318 | 39951 | CTCN_9109 | 54010 | GTCN_2243 | 39994 | TTCN_7485 | 54053 |
| GTCN_2233 | 39952 | TTCN_7475 | 54011 | ATCN_2484 | 39995 | TTCN_7486 | 54054 |
| CTCN_4319 | 39953 | GTCN_4881 | 54012 | ATCN_2485 | 39996 | CTCN_9126 | 54055 |
| TTCN_3465 | 39954 | TTCN_7476 | 54013 | CTCN_4334 | 39997 | ATCN_5097 | 54056 |
| CTCN_4320 | 39955 | ATCN_5090 | 54014 | CTCN_4335 | 39998 | TTCN_7487 | 54057 |
| GTCN_2234 | 39956 | CTCN_9110 | 54015 | TTCN_3478 | 39999 | GTCN_4890 | 54058 |
| CTCN_4321 | 39957 | ATCN_5091 | 54016 | TTCN_3479 | 40000 | TTCN_7488 | 54059 |
| CTCN_4322 | 39958 | GTCN_4882 | 54017 | ATCN_2486 | 40001 | ATCN_5098 | 54060 |
| CTCN_4323 | 39959 | GTCN_4883 | 54018 | GTCN_2244 | 40002 | TTCN_7489 | 54061 |
| CTCN_4324 | 39960 | CTCN_9111 | 54019 | CTCN_4336 | 40003 | CTCN_9127 | 54062 |
| CTCN_4325 | 39961 | CTCN_9112 | 54020 | ATCN_2487 | 40004 | TTCN_7490 | 54063 |
| TTCN_3466 | 39962 | CTCN_9113 | 54021 | ATCN_2488 | 40005 | GTCN_4891 | 54064 |
| TTCN_3467 | 39963 | TTCN_7477 | 54022 | TTCN_3480 | 40006 | GTCN_4892 | 54065 |

FIG. 37 (continued)

| | | | |
|---|---|---|---|
| GTCN_2245 | 40007 | TTCN_7491 | 54066 |
| GTCN_2246 | 40008 | CTCN_9128 | 54067 |
| CTCN_4337 | 40009 | TTCN_7492 | 54068 |
| GTCN_2247 | 40010 | CTCN_9129 | 54069 |
| TTCN_3481 | 40011 | CTCN_9130 | 54070 |
| ATCN_2489 | 40012 | ATCN_5099 | 54071 |
| ATCN_2490 | 40013 | GTCN_4893 | 54072 |
| TTCN_3482 | 40014 | CTCN_9131 | 54073 |
| TTCN_3483 | 40015 | GTCN_4894 | 54074 |
| CTCN_4338 | 40016 | TTCN_7493 | 54075 |
| CTCN_4339 | 40017 | ATCN_5100 | 54076 |
| CTCN_4340 | 40018 | GTCN_4895 | 54077 |
| ATCN_2491 | 40019 | GTCN_4896 | 54078 |
| ATCN_2492 | 40020 | TTCN_7494 | 54079 |
| CTCN_4341 | 40021 | TTCN_7495 | 54080 |
| CTCN_4342 | 40022 | CTCN_9132 | 54081 |
| CTCN_4343 | 40023 | TTCN_7496 | 54082 |
| ATCN_2493 | 40024 | CTCN_9133 | 54083 |
| GTCN_2248 | 40025 | TTCN_7497 | 54084 |
| ATCN_2494 | 40026 | TTCN_7498 | 54085 |
| ATCN_2495 | 40027 | GTCN_4897 | 54086 |
| ATCN_2496 | 40028 | CTCN_9134 | 54087 |
| GTCN_2249 | 40029 | TTCN_7499 | 54088 |
| ATCN_2497 | 40030 | CTCN_9135 | 54089 |
| ATCN_2498 | 40031 | CTCN_9136 | 54090 |
| GTCN_2250 | 40032 | ATCN_5101 | 54091 |
| TTCN_3484 | 40033 | ATCN_5102 | 54092 |
| CTCN_4344 | 40034 | TTCN_7500 | 54093 |
| CTCN_4345 | 40035 | CTCN_9137 | 54094 |
| ATCN_2499 | 40036 | TTCN_7501 | 54095 |
| CTCN_4346 | 40037 | TTCN_7502 | 54096 |
| CTCN_4347 | 40038 | ATCN_5103 | 54097 |
| CTCN_4348 | 40039 | GTCN_4898 | 54098 |
| GTCN_2251 | 40040 | TTCN_7503 | 54099 |
| GTCN_2252 | 40041 | TTCN_7504 | 54100 |
| CTCN_4349 | 40042 | ATCN_5104 | 54101 |
| GTCN_2253 | 40043 | ATCN_5105 | 54102 |
| ATCN_2500 | 40044 | CTCN_9138 | 54103 |
| ATCN_2501 | 40045 | TTCN_7505 | 54104 |
| CTCN_4350 | 40046 | ATCN_5106 | 54105 |
| GTCN_2254 | 40047 | GTCN_4899 | 54106 |
| TTCN_3485 | 40048 | GTCN_4900 | 54107 |
| ATCN_2502 | 40049 | CTCN_9139 | 54108 |

| | | | |
|---|---|---|---|
| TTCN_3486 | 40050 | CTCN_9140 | 54109 |
| ATCN_2503 | 40051 | TTCN_7506 | 54110 |
| GTCN_2255 | 40052 | GTCN_4901 | 54111 |
| CTCN_4351 | 40053 | GTCN_4902 | 54112 |
| GTCN_2256 | 40054 | TTCN_7507 | 54113 |
| CTCN_4352 | 40055 | ATCN_5107 | 54114 |
| TTCN_3487 | 40056 | TTCN_7508 | 54115 |
| CTCN_4353 | 40057 | TTCN_7509 | 54116 |
| CTCN_4354 | 40058 | TTCN_7510 | 54117 |
| GTCN_2257 | 40059 | GTCN_4903 | 54118 |
| CTCN_4355 | 40060 | TTCN_7511 | 54119 |
| TTCN_3488 | 40061 | GTCN_4904 | 54120 |
| TTCN_3489 | 40062 | CTCN_9141 | 54121 |
| CTCN_4356 | 40063 | ATCN_5108 | 54122 |
| TTCN_3490 | 40064 | CTCN_9142 | 54123 |
| GTCN_2258 | 40065 | TTCN_7512 | 54124 |
| CTCN_4357 | 40066 | CTCN_9143 | 54125 |
| CTCN_4358 | 40067 | GTCN_4905 | 54126 |
| TTCN_3491 | 40068 | ATCN_5109 | 54127 |
| GTCN_2259 | 40069 | TTCN_7513 | 54128 |
| TTCN_3492 | 40070 | GTCN_4906 | 54129 |
| CTCN_4359 | 40071 | CTCN_9144 | 54130 |
| ATCN_2504 | 40072 | TTCN_7514 | 54131 |
| GTCN_2260 | 40073 | CTCN_9145 | 54132 |
| GTCN_2261 | 40074 | ATCN_5110 | 54133 |
| TTCN_3493 | 40075 | TTCN_7515 | 54134 |
| TTCN_3494 | 40076 | CTCN_9146 | 54135 |
| CTCN_4360 | 40077 | TTCN_7516 | 54136 |
| ATCN_2505 | 40078 | GTCN_4907 | 54137 |
| ATCN_2506 | 40079 | TTCN_7517 | 54138 |
| ATCN_2507 | 40080 | ATCN_5111 | 54139 |
| CTCN_4361 | 40081 | CTCN_9147 | 54140 |
| TTCN_3495 | 40082 | ATCN_5112 | 54141 |
| ATCN_2508 | 40083 | TTCN_7518 | 54142 |
| TTCN_3496 | 40084 | ATCN_5113 | 54143 |
| CTCN_4362 | 40085 | CTCN_9148 | 54144 |
| TTCN_3497 | 40086 | ATCN_5114 | 54145 |
| TTCN_3498 | 40087 | GTCN_4908 | 54146 |
| TTCN_3499 | 40088 | ATCN_5115 | 54147 |
| GTCN_2262 | 40089 | ATCN_5116 | 54148 |
| CTCN_4363 | 40090 | GTCN_4909 | 54149 |
| TTCN_3500 | 40091 | ATCN_5117 | 54150 |
| CTCN_4364 | 40092 | TTCN_7519 | 54151 |

FIG. 37 (continued)

| | | | |
|---|---|---|---|
| ATCN_2509 | 40093 | CTCN_9149 | 54152 |
| TTCN_3501 | 40094 | TTCN_7520 | 54153 |
| GTCN_2263 | 40095 | ATCN_5118 | 54154 |
| GTCN_2264 | 40096 | GTCN_4910 | 54155 |
| TTCN_3502 | 40097 | ATCN_5119 | 54156 |
| ATCN_2510 | 40098 | CTCN_9150 | 54157 |
| CTCN_4365 | 40099 | GTCN_4911 | 54158 |
| TTCN_3503 | 40100 | TTCN_7521 | 54159 |
| CTCN_4366 | 40101 | GTCN_4912 | 54160 |
| CTCN_4367 | 40102 | ATCN_5120 | 54161 |
| TTCN_3504 | 40103 | TTCN_7522 | 54162 |
| GTCN_2265 | 40104 | TTCN_7523 | 54163 |
| CTCN_4368 | 40105 | GTCN_4913 | 54164 |
| GTCN_2266 | 40106 | CTCN_9151 | 54165 |
| CTCN_4369 | 40107 | ATCN_5121 | 54166 |
| CTCN_4370 | 40108 | ATCN_5122 | 54167 |
| GTCN_2267 | 40109 | TTCN_7524 | 54168 |
| GTCN_2268 | 40110 | CTCN_9152 | 54169 |
| ATCN_2511 | 40111 | GTCN_4914 | 54170 |
| CTCN_4371 | 40112 | ATCN_5123 | 54171 |
| CTCN_4372 | 40113 | CTCN_9153 | 54172 |
| CTCN_4373 | 40114 | CTCN_9154 | 54173 |
| CTCN_4374 | 40115 | ATCN_5124 | 54174 |
| GTCN_2269 | 40116 | CTCN_9155 | 54175 |
| GTCN_2270 | 40117 | GTCN_4915 | 54176 |
| TTCN_3505 | 40118 | ATCN_5125 | 54177 |
| CTCN_4375 | 40119 | CTCN_9156 | 54178 |
| CTCN_4376 | 40120 | ATCN_5126 | 54179 |
| ATCN_2512 | 40121 | CTCN_9157 | 54180 |
| ATCN_2513 | 40122 | GTCN_4916 | 54181 |
| TTCN_3506 | 40123 | ATCN_5127 | 54182 |
| TTCN_3507 | 40124 | CTCN_9158 | 54183 |
| CTCN_4377 | 40125 | TTCN_7525 | 54184 |
| ATCN_2514 | 40126 | GTCN_4917 | 54185 |
| TTCN_3508 | 40127 | CTCN_9159 | 54186 |
| CTCN_4378 | 40128 | CTCN_9160 | 54187 |
| CTCN_4379 | 40129 | TTCN_7526 | 54188 |
| CTCN_4380 | 40130 | TTCN_7527 | 54189 |
| CTCN_4381 | 40131 | CTCN_9161 | 54190 |
| CTCN_4382 | 40132 | CTCN_9162 | 54191 |
| TTCN_3509 | 40133 | CTCN_9163 | 54192 |
| TTCN_3510 | 40134 | ATCN_5128 | 54193 |
| TTCN_3511 | 40135 | TTCN_7528 | 54194 |

| | | | |
|---|---|---|---|
| TTCN_3512 | 40136 | GTCN_4918 | 54195 |
| ATCN_2515 | 40137 | ATCN_5129 | 54196 |
| ATCN_2516 | 40138 | ATCN_5130 | 54197 |
| TTCN_3513 | 40139 | GTCN_4919 | 54198 |
| GTCN_2271 | 40140 | CTCN_9164 | 54199 |
| TTCN_3514 | 40141 | ATCN_5131 | 54200 |
| CTCN_4383 | 40142 | TTCN_7529 | 54201 |
| ATCN_2517 | 40143 | TTCN_7530 | 54202 |
| GTCN_2272 | 40144 | TTCN_7531 | 54203 |
| CTCN_4384 | 40145 | TTCN_7532 | 54204 |
| GTCN_2273 | 40146 | CTCN_9165 | 54205 |
| TTCN_3515 | 40147 | TTCN_7533 | 54206 |
| CTCN_4385 | 40148 | CTCN_9166 | 54207 |
| TTCN_3516 | 40149 | TTCN_7534 | 54208 |
| GTCN_2274 | 40150 | CTCN_9167 | 54209 |
| CTCN_4386 | 40151 | CTCN_9168 | 54210 |
| TTCN_3517 | 40152 | GTCN_4920 | 54211 |
| ATCN_2518 | 40153 | TTCN_7535 | 54212 |
| CTCN_4387 | 40154 | CTCN_9169 | 54213 |
| CTCN_4388 | 40155 | TTCN_7536 | 54214 |
| TTCN_3518 | 40156 | CTCN_9170 | 54215 |
| ATCN_2519 | 40157 | GTCN_4921 | 54216 |
| TTCN_3519 | 40158 | TTCN_7537 | 54217 |
| TTCN_3520 | 40159 | TTCN_7538 | 54218 |
| TTCN_3521 | 40160 | ATCN_5132 | 54219 |
| CTCN_4389 | 40161 | CTCN_9171 | 54220 |
| ATCN_2520 | 40162 | TTCN_7539 | 54221 |
| ATCN_2521 | 40163 | ATCN_5133 | 54222 |
| TTCN_3522 | 40164 | TTCN_7540 | 54223 |
| GTCN_2275 | 40165 | CTCN_9172 | 54224 |
| ATCN_2522 | 40166 | CTCN_9173 | 54225 |
| TTCN_3523 | 40167 | TTCN_7541 | 54226 |
| TTCN_3524 | 40168 | CTCN_9174 | 54227 |
| GTCN_2276 | 40169 | GTCN_4922 | 54228 |
| ATCN_2523 | 40170 | GTCN_4923 | 54229 |
| TTCN_3525 | 40171 | CTCN_9175 | 54230 |
| GTCN_2277 | 40172 | GTCN_4924 | 54231 |
| GTCN_2278 | 40173 | CTCN_9176 | 54232 |
| CTCN_4390 | 40174 | ATCN_5134 | 54233 |
| GTCN_2279 | 40175 | ATCN_5135 | 54234 |
| TTCN_3526 | 40176 | TTCN_7542 | 54235 |
| CTCN_4391 | 40177 | TTCN_7543 | 54236 |
| GTCN_2280 | 40178 | GTCN_4925 | 54237 |

FIG. 37 (continued)

| | | | |
|---|---|---|---|
| CTCN_4392 | 40179 | GTCN_4926 | 54238 |
| CTCN_4393 | 40180 | CTCN_9177 | 54239 |
| GTCN_2281 | 40181 | TTCN_7544 | 54240 |
| GTCN_2282 | 40182 | GTCN_4927 | 54241 |
| GTCN_2283 | 40183 | CTCN_9178 | 54242 |
| CTCN_4394 | 40184 | CTCN_9179 | 54243 |
| CTCN_4395 | 40185 | CTCN_9180 | 54244 |
| TTCN_3527 | 40186 | TTCN_7545 | 54245 |
| ATCN_2524 | 40187 | ATCN_5136 | 54246 |
| ATCN_2525 | 40188 | TTCN_7546 | 54247 |
| GTCN_2284 | 40189 | CTCN_9181 | 54248 |
| TTCN_3528 | 40190 | CTCN_9182 | 54249 |
| TTCN_3529 | 40191 | CTCN_9183 | 54250 |
| TTCN_3530 | 40192 | CTCN_9184 | 54251 |
| TTCN_3531 | 40193 | ATCN_5137 | 54252 |
| TTCN_3532 | 40194 | ATCN_5138 | 54253 |
| TTCN_3533 | 40195 | TTCN_7547 | 54254 |
| TTCN_3534 | 40196 | CTCN_9185 | 54255 |
| CTCN_4396 | 40197 | GTCN_4928 | 54256 |
| CTCN_4397 | 40198 | CTCN_9186 | 54257 |
| TTCN_3535 | 40199 | CTCN_9187 | 54258 |
| TTCN_3536 | 40200 | GTCN_4929 | 54259 |
| TTCN_3537 | 40201 | CTCN_9188 | 54260 |
| TTCN_3538 | 40202 | GTCN_4930 | 54261 |
| TTCN_3539 | 40203 | CTCN_9189 | 54262 |
| TTCN_3540 | 40204 | CTCN_9190 | 54263 |
| TTCN_3541 | 40205 | TTCN_7548 | 54264 |
| TTCN_3542 | 40206 | CTCN_9191 | 54265 |
| CTCN_4398 | 40207 | GTCN_4931 | 54266 |
| CTCN_4399 | 40208 | GTCN_4932 | 54267 |
| TTCN_3543 | 40209 | TTCN_7549 | 54268 |
| TTCN_3544 | 40210 | ATCN_5139 | 54269 |
| CTCN_4400 | 40211 | GTCN_4933 | 54270 |
| TTCN_3545 | 40212 | CTCN_9192 | 54271 |
| TTCN_3546 | 40213 | TTCN_7550 | 54272 |
| TTCN_3547 | 40214 | TTCN_7551 | 54273 |
| TTCN_3548 | 40215 | CTCN_9193 | 54274 |
| TTCN_3549 | 40216 | CTCN_9194 | 54275 |
| TTCN_3550 | 40217 | GTCN_4934 | 54276 |
| TTCN_3551 | 40218 | ATCN_5140 | 54277 |
| CTCN_4401 | 40219 | GTCN_4935 | 54278 |
| CTCN_4402 | 40220 | CTCN_9195 | 54279 |
| CTCN_4403 | 40221 | GTCN_4936 | 54280 |

| | | | |
|---|---|---|---|
| TTCN_3552 | 40222 | ATCN_5141 | 54281 |
| TTCN_3553 | 40223 | ATCN_5142 | 54282 |
| TTCN_3554 | 40224 | CTCN_9196 | 54283 |
| CTCN_4404 | 40225 | GTCN_4937 | 54284 |
| CTCN_4405 | 40226 | ATCN_5143 | 54285 |
| TTCN_3555 | 40227 | ATCN_5144 | 54286 |
| TTCN_3556 | 40228 | ATCN_5145 | 54287 |
| TTCN_3557 | 40229 | CTCN_9197 | 54288 |
| TTCN_3558 | 40230 | TTCN_7552 | 54289 |
| TTCN_3559 | 40231 | GTCN_4938 | 54290 |
| TTCN_3560 | 40232 | TTCN_7553 | 54291 |
| CTCN_4406 | 40233 | CTCN_9198 | 54292 |
| CTCN_4407 | 40234 | CTCN_9199 | 54293 |
| TTCN_3561 | 40235 | GTCN_4939 | 54294 |
| TTCN_3562 | 40236 | CTCN_9200 | 54295 |
| TTCN_3563 | 40237 | GTCN_4940 | 54296 |
| TTCN_3564 | 40238 | ATCN_5146 | 54297 |
| CTCN_4408 | 40239 | ATCN_5147 | 54298 |
| CTCN_4409 | 40240 | ATCN_5148 | 54299 |
| CTCN_4410 | 40241 | TTCN_7554 | 54300 |
| CTCN_4411 | 40242 | CTCN_9201 | 54301 |
| CTCN_4412 | 40243 | ATCN_5149 | 54302 |
| CTCN_4413 | 40244 | CTCN_9202 | 54303 |
| TTCN_3565 | 40245 | GTCN_4941 | 54304 |
| TTCN_3566 | 40246 | CTCN_9203 | 54305 |
| CTCN_4414 | 40247 | TTCN_7555 | 54306 |
| CTCN_4415 | 40248 | TTCN_7556 | 54307 |
| ATCN_2526 | 40249 | TTCN_7557 | 54308 |
| CTCN_4416 | 40250 | CTCN_9204 | 54309 |
| CTCN_4417 | 40251 | GTCN_4942 | 54310 |
| CTCN_4418 | 40252 | CTCN_9205 | 54311 |
| TTCN_3567 | 40253 | CTCN_9206 | 54312 |
| TTCN_3568 | 40254 | GTCN_4943 | 54313 |
| TTCN_3569 | 40255 | GTCN_4944 | 54314 |
| TTCN_3570 | 40256 | TTCN_7558 | 54315 |
| TTCN_3571 | 40257 | CTCN_9207 | 54316 |
| TTCN_3572 | 40258 | CTCN_9208 | 54317 |
| TTCN_3573 | 40259 | CTCN_9209 | 54318 |
| TTCN_3574 | 40260 | TTCN_7559 | 54319 |
| TTCN_3575 | 40261 | TTCN_7560 | 54320 |
| CTCN_4419 | 40262 | TTCN_7561 | 54321 |
| CTCN_4420 | 40263 | ATCN_5150 | 54322 |
| TTCN_3576 | 40264 | TTCN_7562 | 54323 |

FIG. 37 (continued)

| | | | |
|---|---|---|---|
| CTCN_4421 | 40265 | CTCN_9210 | 54324 |
| TTCN_3577 | 40266 | TTCN_7563 | 54325 |
| TTCN_3578 | 40267 | CTCN_9211 | 54326 |
| TTCN_3579 | 40268 | CTCN_9212 | 54327 |
| TTCN_3580 | 40269 | GTCN_4945 | 54328 |
| CTCN_4422 | 40270 | GTCN_4946 | 54329 |
| TTCN_3581 | 40271 | ATCN_5151 | 54330 |
| TTCN_3582 | 40272 | ATCN_5152 | 54331 |
| CTCN_4423 | 40273 | ATCN_5153 | 54332 |
| TTCN_3583 | 40274 | ATCN_5154 | 54333 |
| TTCN_3584 | 40275 | TTCN_7564 | 54334 |
| CTCN_4424 | 40276 | ATCN_5155 | 54335 |
| TTCN_3585 | 40277 | CTCN_9213 | 54336 |
| TTCN_3586 | 40278 | ATCN_5156 | 54337 |
| CTCN_4425 | 40279 | CTCN_9214 | 54338 |
| TTCN_3587 | 40280 | ATCN_5157 | 54339 |
| TTCN_3588 | 40281 | ATCN_5158 | 54340 |
| TTCN_3589 | 40282 | CTCN_9215 | 54341 |
| TTCN_3590 | 40283 | GTCN_4947 | 54342 |
| TTCN_3591 | 40284 | CTCN_9216 | 54343 |
| TTCN_3592 | 40285 | TTCN_7565 | 54344 |
| TTCN_3593 | 40286 | GTCN_4948 | 54345 |
| TTCN_3594 | 40287 | GTCN_4949 | 54346 |
| TTCN_3595 | 40288 | CTCN_9217 | 54347 |
| TTCN_3596 | 40289 | GTCN_4950 | 54348 |
| CTCN_4426 | 40290 | CTCN_9218 | 54349 |
| CTCN_4427 | 40291 | CTCN_9219 | 54350 |
| GTCN_2285 | 40292 | CTCN_9220 | 54351 |
| CTCN_4428 | 40293 | CTCN_9221 | 54352 |
| GTCN_2286 | 40294 | GTCN_4951 | 54353 |
| CTCN_4429 | 40295 | TTCN_7566 | 54354 |
| CTCN_4430 | 40296 | CTCN_9222 | 54355 |
| TTCN_3597 | 40297 | CTCN_9223 | 54356 |
| ATCN_2527 | 40298 | CTCN_9224 | 54357 |
| CTCN_4431 | 40299 | CTCN_9225 | 54358 |
| CTCN_4432 | 40300 | ATCN_5159 | 54359 |
| CTCN_4433 | 40301 | CTCN_9226 | 54360 |
| CTCN_4434 | 40302 | GTCN_4952 | 54361 |
| ATCN_2528 | 40303 | TTCN_7567 | 54362 |
| ATCN_2529 | 40304 | CTCN_9227 | 54363 |
| CTCN_4435 | 40305 | GTCN_4953 | 54364 |
| CTCN_4436 | 40306 | CTCN_9228 | 54365 |
| CTCN_4437 | 40307 | ATCN_5160 | 54366 |

| | | | |
|---|---|---|---|
| GTCN_2287 | 40308 | CTCN_9229 | 54367 |
| GTCN_2288 | 40309 | TTCN_7568 | 54368 |
| CTCN_4438 | 40310 | CTCN_9230 | 54369 |
| GTCN_2289 | 40311 | TTCN_7569 | 54370 |
| ATCN_2530 | 40312 | CTCN_9231 | 54371 |
| TTCN_3598 | 40313 | GTCN_4954 | 54372 |
| GTCN_2290 | 40314 | ATCN_5161 | 54373 |
| GTCN_2291 | 40315 | TTCN_7570 | 54374 |
| CTCN_4439 | 40316 | ATCN_5162 | 54375 |
| CTCN_4440 | 40317 | TTCN_7571 | 54376 |
| CTCN_4441 | 40318 | CTCN_9232 | 54377 |
| CTCN_4442 | 40319 | GTCN_4955 | 54378 |
| ATCN_2531 | 40320 | ATCN_5163 | 54379 |
| CTCN_4443 | 40321 | GTCN_4956 | 54380 |
| CTCN_4444 | 40322 | CTCN_9233 | 54381 |
| CTCN_4445 | 40323 | CTCN_9234 | 54382 |
| ATCN_2532 | 40324 | CTCN_9235 | 54383 |
| CTCN_4446 | 40325 | CTCN_9236 | 54384 |
| CTCN_4447 | 40326 | ATCN_5164 | 54385 |
| TTCN_3599 | 40327 | GTCN_4957 | 54386 |
| CTCN_4448 | 40328 | CTCN_9237 | 54387 |
| TTCN_3600 | 40329 | CTCN_9238 | 54388 |
| ATCN_2533 | 40330 | TTCN_7572 | 54389 |
| CTCN_4449 | 40331 | GTCN_4958 | 54390 |
| ATCN_2534 | 40332 | TTCN_7573 | 54391 |
| CTCN_4450 | 40333 | TTCN_7574 | 54392 |
| CTCN_4451 | 40334 | TTCN_7575 | 54393 |
| CTCN_4452 | 40335 | TTCN_7576 | 54394 |
| GTCN_2292 | 40336 | ATCN_5165 | 54395 |
| ATCN_2535 | 40337 | TTCN_7577 | 54396 |
| ATCN_2536 | 40338 | CTCN_9239 | 54397 |
| CTCN_4453 | 40339 | TTCN_7578 | 54398 |
| CTCN_4454 | 40340 | GTCN_4959 | 54399 |
| TTCN_3601 | 40341 | CTCN_9240 | 54400 |
| CTCN_4455 | 40342 | ATCN_5166 | 54401 |
| GTCN_2293 | 40343 | ATCN_5167 | 54402 |
| ATCN_2537 | 40344 | ATCN_5168 | 54403 |
| GTCN_2294 | 40345 | CTCN_9241 | 54404 |
| GTCN_2295 | 40346 | CTCN_9242 | 54405 |
| GTCN_2296 | 40347 | GTCN_4960 | 54406 |
| CTCN_4456 | 40348 | TTCN_7579 | 54407 |
| TTCN_3602 | 40349 | CTCN_9243 | 54408 |
| TTCN_3603 | 40350 | TTCN_7580 | 54409 |

FIG. 37 (continued)

| | | | |
|---|---|---|---|
| TTCN_3604 | 40351 | GTCN_4961 | 54410 |
| TTCN_3605 | 40352 | CTCN_9244 | 54411 |
| GTCN_2297 | 40353 | CTCN_9245 | 54412 |
| ATCN_2538 | 40354 | CTCN_9246 | 54413 |
| ATCN_2539 | 40355 | CTCN_9247 | 54414 |
| ATCN_2540 | 40356 | CTCN_9248 | 54415 |
| ATCN_2541 | 40357 | GTCN_4962 | 54416 |
| TTCN_3606 | 40358 | GTCN_4963 | 54417 |
| CTCN_4457 | 40359 | CTCN_9249 | 54418 |
| TTCN_3607 | 40360 | GTCN_4964 | 54419 |
| CTCN_4458 | 40361 | CTCN_9250 | 54420 |
| ATCN_2542 | 40362 | GTCN_4965 | 54421 |
| GTCN_2298 | 40363 | CTCN_9251 | 54422 |
| CTCN_4459 | 40364 | GTCN_4966 | 54423 |
| GTCN_2299 | 40365 | CTCN_9252 | 54424 |
| TTCN_3608 | 40366 | TTCN_7581 | 54425 |
| ATCN_2543 | 40367 | CTCN_9253 | 54426 |
| ATCN_2544 | 40368 | CTCN_9254 | 54427 |
| CTCN_4460 | 40369 | GTCN_4967 | 54428 |
| ATCN_2545 | 40370 | GTCN_4968 | 54429 |
| CTCN_4461 | 40371 | TTCN_7582 | 54430 |
| CTCN_4462 | 40372 | GTCN_4969 | 54431 |
| CTCN_4463 | 40373 | CTCN_9255 | 54432 |
| TTCN_3609 | 40374 | GTCN_4970 | 54433 |
| TTCN_3610 | 40375 | CTCN_9256 | 54434 |
| CTCN_4464 | 40376 | GTCN_4971 | 54435 |
| CTCN_4465 | 40377 | CTCN_9257 | 54436 |
| CTCN_4466 | 40378 | GTCN_4972 | 54437 |
| ATCN_2546 | 40379 | TTCN_7583 | 54438 |
| CTCN_4467 | 40380 | ATCN_5169 | 54439 |
| GTCN_2300 | 40381 | CTCN_9258 | 54440 |
| GTCN_2301 | 40382 | TTCN_7584 | 54441 |
| TTCN_3611 | 40383 | GTCN_4973 | 54442 |
| CTCN_4468 | 40384 | GTCN_4974 | 54443 |
| CTCN_4469 | 40385 | TTCN_7585 | 54444 |
| ATCN_2547 | 40386 | CTCN_9259 | 54445 |
| TTCN_3612 | 40387 | CTCN_9260 | 54446 |
| CTCN_4470 | 40388 | GTCN_4975 | 54447 |
| CTCN_4471 | 40389 | CTCN_9261 | 54448 |
| CTCN_4472 | 40390 | TTCN_7586 | 54449 |
| ATCN_2548 | 40391 | ATCN_5170 | 54450 |
| TTCN_3613 | 40392 | GTCN_4976 | 54451 |
| ATCN_2549 | 40393 | CTCN_9262 | 54452 |

| | | | |
|---|---|---|---|
| CTCN_4473 | 40394 | CTCN_9263 | 54453 |
| ATCN_2550 | 40395 | CTCN_9264 | 54454 |
| CTCN_4474 | 40396 | TTCN_7587 | 54455 |
| CTCN_4475 | 40397 | CTCN_9265 | 54456 |
| TTCN_3614 | 40398 | CTCN_9266 | 54457 |
| GTCN_2302 | 40399 | TTCN_7588 | 54458 |
| GTCN_2303 | 40400 | TTCN_7589 | 54459 |
| GTCN_2304 | 40401 | ATCN_5171 | 54460 |
| ATCN_2551 | 40402 | TTCN_7590 | 54461 |
| ATCN_2552 | 40403 | ATCN_5172 | 54462 |
| TTCN_3615 | 40404 | CTCN_9267 | 54463 |
| ATCN_2553 | 40405 | ATCN_5173 | 54464 |
| CTCN_4476 | 40406 | TTCN_7591 | 54465 |
| CTCN_4477 | 40407 | TTCN_7592 | 54466 |
| GTCN_2305 | 40408 | TTCN_7593 | 54467 |
| CTCN_4478 | 40409 | CTCN_9268 | 54468 |
| CTCN_4479 | 40410 | GTCN_4977 | 54469 |
| GTCN_2306 | 40411 | TTCN_7594 | 54470 |
| GTCN_2307 | 40412 | CTCN_9269 | 54471 |
| GTCN_2308 | 40413 | CTCN_9270 | 54472 |
| ATCN_2554 | 40414 | CTCN_9271 | 54473 |
| CTCN_4480 | 40415 | GTCN_4978 | 54474 |
| CTCN_4481 | 40416 | CTCN_9272 | 54475 |
| ATCN_2555 | 40417 | ATCN_5174 | 54476 |
| ATCN_2556 | 40418 | TTCN_7595 | 54477 |
| CTCN_4482 | 40419 | TTCN_7596 | 54478 |
| TTCN_3616 | 40420 | CTCN_9273 | 54479 |
| GTCN_2309 | 40421 | TTCN_7597 | 54480 |
| CTCN_4483 | 40422 | ATCN_5175 | 54481 |
| TTCN_3617 | 40423 | CTCN_9274 | 54482 |
| CTCN_4484 | 40424 | CTCN_9275 | 54483 |
| GTCN_2310 | 40425 | CTCN_9276 | 54484 |
| GTCN_2311 | 40426 | CTCN_9277 | 54485 |
| CTCN_4485 | 40427 | ATCN_5176 | 54486 |
| ATCN_2557 | 40428 | TTCN_7598 | 54487 |
| TTCN_3618 | 40429 | CTCN_9278 | 54488 |
| TTCN_3619 | 40430 | CTCN_9279 | 54489 |
| GTCN_2312 | 40431 | CTCN_9280 | 54490 |
| TTCN_3620 | 40432 | ATCN_5177 | 54491 |
| CTCN_4486 | 40433 | CTCN_9281 | 54492 |
| TTCN_3621 | 40434 | GTCN_4979 | 54493 |
| TTCN_3622 | 40435 | GTCN_4980 | 54494 |
| TTCN_3623 | 40436 | GTCN_4981 | 54495 |

FIG. 37 (continued)

| | | | |
|---|---|---|---|
| TTCN_3624 | 40437 | CTCN_9282 | 54496 |
| ATCN_2558 | 40438 | CTCN_9283 | 54497 |
| ATCN_2559 | 40439 | TTCN_7599 | 54498 |
| TTCN_3625 | 40440 | ATCN_5178 | 54499 |
| CTCN_4487 | 40441 | ATCN_5179 | 54500 |
| TTCN_3626 | 40442 | TTCN_7600 | 54501 |
| TTCN_3627 | 40443 | TTCN_7601 | 54502 |
| CTCN_4488 | 40444 | ATCN_5180 | 54503 |
| ATCN_2560 | 40445 | TTCN_7602 | 54504 |
| ATCN_2561 | 40446 | GTCN_4982 | 54505 |
| CTCN_4489 | 40447 | TTCN_7603 | 54506 |
| GTCN_2313 | 40448 | ATCN_5181 | 54507 |
| TTCN_3628 | 40449 | TTCN_7604 | 54508 |
| CTCN_4490 | 40450 | ATCN_5182 | 54509 |
| CTCN_4491 | 40451 | GTCN_4983 | 54510 |
| TTCN_3629 | 40452 | CTCN_9284 | 54511 |
| CTCN_4492 | 40453 | TTCN_7605 | 54512 |
| TTCN_3630 | 40454 | ATCN_5183 | 54513 |
| TTCN_3631 | 40455 | TTCN_7606 | 54514 |
| TTCN_3632 | 40456 | TTCN_7607 | 54515 |
| TTCN_3633 | 40457 | GTCN_4984 | 54516 |
| TTCN_3634 | 40458 | CTCN_9285 | 54517 |
| GTCN_2314 | 40459 | GTCN_4985 | 54518 |
| TTCN_3635 | 40460 | ATCN_5184 | 54519 |
| TTCN_3636 | 40461 | TTCN_7608 | 54520 |
| CTCN_4493 | 40462 | TTCN_7609 | 54521 |
| TTCN_3637 | 40463 | ATCN_5185 | 54522 |
| GTCN_2315 | 40464 | ATCN_5186 | 54523 |
| CTCN_4494 | 40465 | GTCN_4986 | 54524 |
| ATCN_2562 | 40466 | TTCN_7610 | 54525 |
| GTCN_2316 | 40467 | ATCN_5187 | 54526 |
| GTCN_2317 | 40468 | CTCN_9286 | 54527 |
| ATCN_2563 | 40469 | ATCN_5188 | 54528 |
| TTCN_3638 | 40470 | GTCN_4987 | 54529 |
| CTCN_4495 | 40471 | TTCN_7611 | 54530 |
| GTCN_2318 | 40472 | TTCN_7612 | 54531 |
| TTCN_3639 | 40473 | CTCN_9287 | 54532 |
| CTCN_4496 | 40474 | TTCN_7613 | 54533 |
| GTCN_2319 | 40475 | TTCN_7614 | 54534 |
| TTCN_3640 | 40476 | GTCN_4988 | 54535 |
| TTCN_3641 | 40477 | CTCN_9288 | 54536 |
| GTCN_2320 | 40478 | CTCN_9289 | 54537 |
| CTCN_4497 | 40479 | CTCN_9290 | 54538 |

| | | | |
|---|---|---|---|
| TTCN_3642 | 40480 | TTCN_7615 | 54539 |
| ATCN_2564 | 40481 | ATCN_5189 | 54540 |
| CTCN_4498 | 40482 | TTCN_7616 | 54541 |
| CTCN_4499 | 40483 | CTCN_9291 | 54542 |
| CTCN_4500 | 40484 | CTCN_9292 | 54543 |
| CTCN_4501 | 40485 | CTCN_9293 | 54544 |
| CTCN_4502 | 40486 | ATCN_5190 | 54545 |
| TTCN_3643 | 40487 | ATCN_5191 | 54546 |
| CTCN_4503 | 40488 | GTCN_4989 | 54547 |
| TTCN_3644 | 40489 | GTCN_4990 | 54548 |
| CTCN_4504 | 40490 | CTCN_9294 | 54549 |
| TTCN_3645 | 40491 | ATCN_5192 | 54550 |
| CTCN_4505 | 40492 | TTCN_7617 | 54551 |
| CTCN_4506 | 40493 | ATCN_5193 | 54552 |
| TTCN_3646 | 40494 | ATCN_5194 | 54553 |
| TTCN_3647 | 40495 | TTCN_7618 | 54554 |
| CTCN_4507 | 40496 | GTCN_4991 | 54555 |
| ATCN_2565 | 40497 | CTCN_9295 | 54556 |
| ATCN_2566 | 40498 | CTCN_9296 | 54557 |
| CTCN_4508 | 40499 | CTCN_9297 | 54558 |
| TTCN_3648 | 40500 | CTCN_9298 | 54559 |
| CTCN_4509 | 40501 | CTCN_9299 | 54560 |
| CTCN_4510 | 40502 | TTCN_7619 | 54561 |
| GTCN_2321 | 40503 | GTCN_4992 | 54562 |
| CTCN_4511 | 40504 | TTCN_7620 | 54563 |
| CTCN_4512 | 40505 | TTCN_7621 | 54564 |
| TTCN_3649 | 40506 | TTCN_7622 | 54565 |
| TTCN_3650 | 40507 | ATCN_5195 | 54566 |
| TTCN_3651 | 40508 | TTCN_7623 | 54567 |
| TTCN_3652 | 40509 | TTCN_7624 | 54568 |
| TTCN_3653 | 40510 | CTCN_9300 | 54569 |
| TTCN_3654 | 40511 | CTCN_9301 | 54570 |
| TTCN_3655 | 40512 | CTCN_9302 | 54571 |
| TTCN_3656 | 40513 | GTCN_4993 | 54572 |
| TTCN_3657 | 40514 | GTCN_4994 | 54573 |
| CTCN_4513 | 40515 | CTCN_9303 | 54574 |
| TTCN_3658 | 40516 | TTCN_7625 | 54575 |
| TTCN_3659 | 40517 | CTCN_9304 | 54576 |
| TTCN_3660 | 40518 | GTCN_4995 | 54577 |
| TTCN_3661 | 40519 | CTCN_9305 | 54578 |
| TTCN_3662 | 40520 | ATCN_5196 | 54579 |
| TTCN_3663 | 40521 | ATCN_5197 | 54580 |
| TTCN_3664 | 40522 | GTCN_4996 | 54581 |

FIG. 37 (continued)

| | | | |
|---|---|---|---|
| TTCN_3665 | 40523 | CTCN_9306 | 54582 |
| TTCN_3666 | 40524 | GTCN_4997 | 54583 |
| TTCN_3667 | 40525 | CTCN_9307 | 54584 |
| CTCN_4514 | 40526 | TTCN_7626 | 54585 |
| CTCN_4515 | 40527 | GTCN_4998 | 54586 |
| GTCN_2322 | 40528 | TTCN_7627 | 54587 |
| CTCN_4516 | 40529 | ATCN_5198 | 54588 |
| CTCN_4517 | 40530 | ATCN_5199 | 54589 |
| GTCN_2323 | 40531 | ATCN_5200 | 54590 |
| CTCN_4518 | 40532 | GTCN_4999 | 54591 |
| ATCN_2567 | 40533 | ATCN_5201 | 54592 |
| CTCN_4519 | 40534 | GTCN_5000 | 54593 |
| GTCN_2324 | 40535 | TTCN_7628 | 54594 |
| CTCN_4520 | 40536 | TTCN_7629 | 54595 |
| CTCN_4521 | 40537 | TTCN_7630 | 54596 |
| CTCN_4522 | 40538 | TTCN_7631 | 54597 |
| CTCN_4523 | 40539 | GTCN_5001 | 54598 |
| GTCN_2325 | 40540 | ATCN_5202 | 54599 |
| ATCN_2568 | 40541 | CTCN_9308 | 54600 |
| TTCN_3668 | 40542 | TTCN_7632 | 54601 |
| CTCN_4524 | 40543 | CTCN_9309 | 54602 |
| CTCN_4525 | 40544 | TTCN_7633 | 54603 |
| CTCN_4526 | 40545 | ATCN_5203 | 54604 |
| CTCN_4527 | 40546 | CTCN_9310 | 54605 |
| GTCN_2326 | 40547 | ATCN_5204 | 54606 |
| GTCN_2327 | 40548 | TTCN_7634 | 54607 |
| ATCN_2569 | 40549 | CTCN_9311 | 54608 |
| CTCN_4528 | 40550 | GTCN_5002 | 54609 |
| GTCN_2328 | 40551 | TTCN_7635 | 54610 |
| TTCN_3669 | 40552 | GTCN_5003 | 54611 |
| ATCN_2570 | 40553 | ATCN_5205 | 54612 |
| GTCN_2329 | 40554 | TTCN_7636 | 54613 |
| CTCN_4529 | 40555 | TTCN_7637 | 54614 |
| ATCN_2571 | 40556 | TTCN_7638 | 54615 |
| TTCN_3670 | 40557 | TTCN_7639 | 54616 |
| GTCN_2330 | 40558 | TTCN_7640 | 54617 |
| CTCN_4530 | 40559 | CTCN_9312 | 54618 |
| ATCN_2572 | 40560 | TTCN_7641 | 54619 |
| ATCN_2573 | 40561 | ATCN_5206 | 54620 |
| CTCN_4531 | 40562 | TTCN_7642 | 54621 |
| CTCN_4532 | 40563 | TTCN_7643 | 54622 |
| ATCN_2574 | 40564 | ATCN_5207 | 54623 |
| CTCN_4533 | 40565 | TTCN_7644 | 54624 |

| | | | |
|---|---|---|---|
| CTCN_4534 | 40566 | GTCN_5004 | 54625 |
| CTCN_4535 | 40567 | CTCN_9313 | 54626 |
| GTCN_2331 | 40568 | TTCN_7645 | 54627 |
| TTCN_3671 | 40569 | CTCN_9314 | 54628 |
| GTCN_2332 | 40570 | GTCN_5005 | 54629 |
| CTCN_4536 | 40571 | ATCN_5208 | 54630 |
| CTCN_4537 | 40572 | TTCN_7646 | 54631 |
| ATCN_2575 | 40573 | CTCN_9315 | 54632 |
| CTCN_4538 | 40574 | CTCN_9316 | 54633 |
| CTCN_4539 | 40575 | ATCN_5209 | 54634 |
| ATCN_2576 | 40576 | GTCN_5006 | 54635 |
| ATCN_2577 | 40577 | GTCN_5007 | 54636 |
| CTCN_4540 | 40578 | GTCN_5008 | 54637 |
| CTCN_4541 | 40579 | CTCN_9317 | 54638 |
| GTCN_2333 | 40580 | GTCN_5009 | 54639 |
| TTCN_3672 | 40581 | CTCN_9318 | 54640 |
| ATCN_2578 | 40582 | GTCN_5010 | 54641 |
| CTCN_4542 | 40583 | GTCN_5011 | 54642 |
| GTCN_2334 | 40584 | GTCN_5012 | 54643 |
| CTCN_4543 | 40585 | CTCN_9319 | 54644 |
| CTCN_4544 | 40586 | GTCN_5013 | 54645 |
| CTCN_4545 | 40587 | GTCN_5014 | 54646 |
| TTCN_3673 | 40588 | GTCN_5015 | 54647 |
| ATCN_2579 | 40589 | ATCN_5210 | 54648 |
| TTCN_3674 | 40590 | TTCN_7647 | 54649 |
| CTCN_4546 | 40591 | ATCN_5211 | 54650 |
| CTCN_4547 | 40592 | CTCN_9320 | 54651 |
| CTCN_4548 | 40593 | CTCN_9321 | 54652 |
| CTCN_4549 | 40594 | ATCN_5212 | 54653 |
| ATCN_2580 | 40595 | CTCN_9322 | 54654 |
| ATCN_2581 | 40596 | TTCN_7648 | 54655 |
| GTCN_2335 | 40597 | TTCN_7649 | 54656 |
| ATCN_2582 | 40598 | TTCN_7650 | 54657 |
| GTCN_2336 | 40599 | ATCN_5213 | 54658 |
| CTCN_4550 | 40600 | ATCN_5214 | 54659 |
| CTCN_4551 | 40601 | CTCN_9323 | 54660 |
| GTCN_2337 | 40602 | TTCN_7651 | 54661 |
| ATCN_2583 | 40603 | CTCN_9324 | 54662 |
| CTCN_4552 | 40604 | GTCN_5016 | 54663 |
| TTCN_3675 | 40605 | TTCN_7652 | 54664 |
| CTCN_4553 | 40606 | TTCN_7653 | 54665 |
| TTCN_3676 | 40607 | TTCN_7654 | 54666 |
| CTCN_4554 | 40608 | CTCN_9325 | 54667 |

FIG. 37 (continued)

| | | | |
|---|---|---|---|
| CTCN_4555 | 40609 | CTCN_9326 | 54668 |
| ATCN_2584 | 40610 | CTCN_9327 | 54669 |
| CTCN_4556 | 40611 | GTCN_5017 | 54670 |
| TTCN_3677 | 40612 | CTCN_9328 | 54671 |
| ATCN_2585 | 40613 | ATCN_5215 | 54672 |
| TTCN_3678 | 40614 | CTCN_9329 | 54673 |
| GTCN_2338 | 40615 | GTCN_5018 | 54674 |
| CTCN_4557 | 40616 | TTCN_7655 | 54675 |
| GTCN_2339 | 40617 | CTCN_9330 | 54676 |
| ATCN_2586 | 40618 | GTCN_5019 | 54677 |
| TTCN_3679 | 40619 | TTCN_7656 | 54678 |
| ATCN_2587 | 40620 | GTCN_5020 | 54679 |
| TTCN_3680 | 40621 | ATCN_5216 | 54680 |
| ATCN_2588 | 40622 | GTCN_5021 | 54681 |
| ATCN_2589 | 40623 | TTCN_7657 | 54682 |
| GTCN_2340 | 40624 | CTCN_9331 | 54683 |
| ATCN_2590 | 40625 | TTCN_7658 | 54684 |
| TTCN_3681 | 40626 | CTCN_9332 | 54685 |
| TTCN_3682 | 40627 | CTCN_9333 | 54686 |
| GTCN_2341 | 40628 | TTCN_7659 | 54687 |
| TTCN_3683 | 40629 | TTCN_7660 | 54688 |
| ATCN_2591 | 40630 | GTCN_5022 | 54689 |
| TTCN_3684 | 40631 | ATCN_5217 | 54690 |
| GTCN_2342 | 40632 | ATCN_5218 | 54691 |
| TTCN_3685 | 40633 | ATCN_5219 | 54692 |
| CTCN_4558 | 40634 | GTCN_5023 | 54693 |
| GTCN_2343 | 40635 | GTCN_5024 | 54694 |
| TTCN_3686 | 40636 | CTCN_9334 | 54695 |
| ATCN_2592 | 40637 | TTCN_7661 | 54696 |
| TTCN_3687 | 40638 | GTCN_5025 | 54697 |
| ATCN_2593 | 40639 | CTCN_9335 | 54698 |
| TTCN_3688 | 40640 | GTCN_5026 | 54699 |
| CTCN_4559 | 40641 | CTCN_9336 | 54700 |
| CTCN_4560 | 40642 | ATCN_5220 | 54701 |
| ATCN_2594 | 40643 | ATCN_5221 | 54702 |
| ATCN_2595 | 40644 | ATCN_5222 | 54703 |
| GTCN_2344 | 40645 | TTCN_7662 | 54704 |
| TTCN_3689 | 40646 | CTCN_9337 | 54705 |
| ATCN_2596 | 40647 | CTCN_9338 | 54706 |
| CTCN_4561 | 40648 | CTCN_9339 | 54707 |
| ATCN_2597 | 40649 | GTCN_5027 | 54708 |
| ATCN_2598 | 40650 | CTCN_9340 | 54709 |
| CTCN_4562 | 40651 | GTCN_5028 | 54710 |

| | | | |
|---|---|---|---|
| GTCN_2345 | 40652 | ATCN_5223 | 54711 |
| CTCN_4563 | 40653 | ATCN_5224 | 54712 |
| ATCN_2599 | 40654 | CTCN_9341 | 54713 |
| ATCN_2600 | 40655 | GTCN_5029 | 54714 |
| CTCN_4564 | 40656 | TTCN_7663 | 54715 |
| TTCN_3690 | 40657 | ATCN_5225 | 54716 |
| CTCN_4565 | 40658 | CTCN_9342 | 54717 |
| GTCN_2346 | 40659 | CTCN_9343 | 54718 |
| TTCN_3691 | 40660 | ATCN_5226 | 54719 |
| ATCN_2601 | 40661 | CTCN_9344 | 54720 |
| TTCN_3692 | 40662 | ATCN_5227 | 54721 |
| CTCN_4566 | 40663 | CTCN_9345 | 54722 |
| CTCN_4567 | 40664 | CTCN_9346 | 54723 |
| TTCN_3693 | 40665 | TTCN_7664 | 54724 |
| TTCN_3694 | 40666 | TTCN_7665 | 54725 |
| TTCN_3695 | 40667 | ATCN_5228 | 54726 |
| TTCN_3696 | 40668 | TTCN_7666 | 54727 |
| TTCN_3697 | 40669 | TTCN_7667 | 54728 |
| CTCN_4568 | 40670 | TTCN_7668 | 54729 |
| GTCN_2347 | 40671 | CTCN_9347 | 54730 |
| ATCN_2602 | 40672 | GTCN_5030 | 54731 |
| ATCN_2603 | 40673 | CTCN_9348 | 54732 |
| CTCN_4569 | 40674 | CTCN_9349 | 54733 |
| TTCN_3698 | 40675 | ATCN_5229 | 54734 |
| TTCN_3699 | 40676 | CTCN_9350 | 54735 |
| ATCN_2604 | 40677 | TTCN_7669 | 54736 |
| ATCN_2605 | 40678 | GTCN_5031 | 54737 |
| TTCN_3700 | 40679 | CTCN_9351 | 54738 |
| TTCN_3701 | 40680 | TTCN_7670 | 54739 |
| TTCN_3702 | 40681 | TTCN_7671 | 54740 |
| GTCN_2348 | 40682 | TTCN_7672 | 54741 |
| TTCN_3703 | 40683 | TTCN_7673 | 54742 |
| GTCN_2349 | 40684 | CTCN_9352 | 54743 |
| CTCN_4570 | 40685 | TTCN_7674 | 54744 |
| TTCN_3704 | 40686 | TTCN_7675 | 54745 |
| TTCN_3705 | 40687 | TTCN_7676 | 54746 |
| GTCN_2350 | 40688 | GTCN_5032 | 54747 |
| TTCN_3706 | 40689 | TTCN_7677 | 54748 |
| CTCN_4571 | 40690 | ATCN_5230 | 54749 |
| ATCN_2606 | 40691 | CTCN_9353 | 54750 |
| TTCN_3707 | 40692 | TTCN_7678 | 54751 |
| GTCN_2351 | 40693 | GTCN_5033 | 54752 |
| CTCN_4572 | 40694 | CTCN_9354 | 54753 |

FIG. 37 (continued)

| | | | |
|---|---|---|---|
| ATCN_2607 | 40695 | CTCN_9355 | 54754 |
| ATCN_2608 | 40696 | TTCN_7679 | 54755 |
| GTCN_2352 | 40697 | TTCN_7680 | 54756 |
| CTCN_4573 | 40698 | ATCN_5231 | 54757 |
| ATCN_2609 | 40699 | CTCN_9356 | 54758 |
| ATCN_2610 | 40700 | CTCN_9357 | 54759 |
| CTCN_4574 | 40701 | ATCN_5232 | 54760 |
| TTCN_3708 | 40702 | CTCN_9358 | 54761 |
| CTCN_4575 | 40703 | ATCN_5233 | 54762 |
| ATCN_2611 | 40704 | CTCN_9359 | 54763 |
| CTCN_4576 | 40705 | ATCN_5234 | 54764 |
| CTCN_4577 | 40706 | CTCN_9360 | 54765 |
| CTCN_4578 | 40707 | GTCN_5034 | 54766 |
| GTCN_2353 | 40708 | GTCN_5035 | 54767 |
| CTCN_4579 | 40709 | GTCN_5036 | 54768 |
| CTCN_4580 | 40710 | CTCN_9361 | 54769 |
| CTCN_4581 | 40711 | GTCN_5037 | 54770 |
| ATCN_2612 | 40712 | CTCN_9362 | 54771 |
| ATCN_2613 | 40713 | CTCN_9363 | 54772 |
| CTCN_4582 | 40714 | ATCN_5235 | 54773 |
| TTCN_3709 | 40715 | ATCN_5236 | 54774 |
| CTCN_4583 | 40716 | GTCN_5038 | 54775 |
| TTCN_3710 | 40717 | ATCN_5237 | 54776 |
| GTCN_2354 | 40718 | ATCN_5238 | 54777 |
| GTCN_2355 | 40719 | ATCN_5239 | 54778 |
| GTCN_2356 | 40720 | GTCN_5039 | 54779 |
| TTCN_3711 | 40721 | CTCN_9364 | 54780 |
| GTCN_2357 | 40722 | GTCN_5040 | 54781 |
| TTCN_3712 | 40723 | CTCN_9365 | 54782 |
| CTCN_4584 | 40724 | TTCN_7681 | 54783 |
| TTCN_3713 | 40725 | GTCN_5041 | 54784 |
| ATCN_2614 | 40726 | CTCN_9366 | 54785 |
| ATCN_2615 | 40727 | TTCN_7682 | 54786 |
| TTCN_3714 | 40728 | CTCN_9367 | 54787 |
| CTCN_4585 | 40729 | TTCN_7683 | 54788 |
| TTCN_3715 | 40730 | TTCN_7684 | 54789 |
| CTCN_4586 | 40731 | GTCN_5042 | 54790 |
| CTCN_4587 | 40732 | ATCN_5240 | 54791 |
| GTCN_2358 | 40733 | CTCN_9368 | 54792 |
| CTCN_4588 | 40734 | GTCN_5043 | 54793 |
| ATCN_2616 | 40735 | CTCN_9369 | 54794 |
| CTCN_4589 | 40736 | TTCN_7685 | 54795 |
| CTCN_4590 | 40737 | CTCN_9370 | 54796 |

| | | | |
|---|---|---|---|
| TTCN_3716 | 40738 | CTCN_9371 | 54797 |
| TTCN_3717 | 40739 | CTCN_9372 | 54798 |
| TTCN_3718 | 40740 | CTCN_9373 | 54799 |
| CTCN_4591 | 40741 | TTCN_7686 | 54800 |
| GTCN_2359 | 40742 | GTCN_5044 | 54801 |
| GTCN_2360 | 40743 | TTCN_7687 | 54802 |
| CTCN_4592 | 40744 | CTCN_9374 | 54803 |
| CTCN_4593 | 40745 | CTCN_9375 | 54804 |
| CTCN_4594 | 40746 | CTCN_9376 | 54805 |
| ATCN_2617 | 40747 | ATCN_5241 | 54806 |
| ATCN_2618 | 40748 | CTCN_9377 | 54807 |
| CTCN_4595 | 40749 | GTCN_5045 | 54808 |
| ATCN_2619 | 40750 | CTCN_9378 | 54809 |
| CTCN_4596 | 40751 | TTCN_7688 | 54810 |
| CTCN_4597 | 40752 | CTCN_9379 | 54811 |
| CTCN_4598 | 40753 | GTCN_5046 | 54812 |
| ATCN_2620 | 40754 | CTCN_9380 | 54813 |
| TTCN_3719 | 40755 | CTCN_9381 | 54814 |
| CTCN_4599 | 40756 | CTCN_9382 | 54815 |
| CTCN_4600 | 40757 | CTCN_9383 | 54816 |
| TTCN_3720 | 40758 | TTCN_7689 | 54817 |
| CTCN_4601 | 40759 | ATCN_5242 | 54818 |
| GTCN_2361 | 40760 | TTCN_7690 | 54819 |
| GTCN_2362 | 40761 | CTCN_9384 | 54820 |
| CTCN_4602 | 40762 | CTCN_9385 | 54821 |
| GTCN_2363 | 40763 | CTCN_9386 | 54822 |
| CTCN_4603 | 40764 | GTCN_5047 | 54823 |
| GTCN_2364 | 40765 | TTCN_7691 | 54824 |
| CTCN_4604 | 40766 | TTCN_7692 | 54825 |
| GTCN_2365 | 40767 | CTCN_9387 | 54826 |
| TTCN_3721 | 40768 | GTCN_5048 | 54827 |
| CTCN_4605 | 40769 | CTCN_9388 | 54828 |
| CTCN_4606 | 40770 | TTCN_7693 | 54829 |
| GTCN_2366 | 40771 | ATCN_5243 | 54830 |
| CTCN_4607 | 40772 | ATCN_5244 | 54831 |
| CTCN_4608 | 40773 | ATCN_5245 | 54832 |
| TTCN_3722 | 40774 | CTCN_9389 | 54833 |
| GTCN_2367 | 40775 | ATCN_5246 | 54834 |
| CTCN_4609 | 40776 | CTCN_9390 | 54835 |
| TTCN_3723 | 40777 | GTCN_5049 | 54836 |
| CTCN_4610 | 40778 | CTCN_9391 | 54837 |
| CTCN_4611 | 40779 | ATCN_5247 | 54838 |
| TTCN_3724 | 40780 | ATCN_5248 | 54839 |

FIG. 37 (continued)

| | | | |
|---|---|---|---|
| ATCN_2621 | 40781 | CTCN_9392 | 54840 |
| TTCN_3725 | 40782 | ATCN_5249 | 54841 |
| ATCN_2622 | 40783 | CTCN_9393 | 54842 |
| GTCN_2368 | 40784 | GTCN_5050 | 54843 |
| TTCN_3726 | 40785 | TTCN_7694 | 54844 |
| GTCN_2369 | 40786 | TTCN_7695 | 54845 |
| CTCN_4612 | 40787 | TTCN_7696 | 54846 |
| TTCN_3727 | 40788 | TTCN_7697 | 54847 |
| TTCN_3728 | 40789 | CTCN_9394 | 54848 |
| CTCN_4613 | 40790 | TTCN_7698 | 54849 |
| CTCN_4614 | 40791 | TTCN_7699 | 54850 |
| CTCN_4615 | 40792 | ATCN_5250 | 54851 |
| GTCN_2370 | 40793 | ATCN_5251 | 54852 |
| GTCN_2371 | 40794 | TTCN_7700 | 54853 |
| GTCN_2372 | 40795 | ATCN_5252 | 54854 |
| TTCN_3729 | 40796 | TTCN_7701 | 54855 |
| GTCN_2373 | 40797 | TTCN_7702 | 54856 |
| CTCN_4616 | 40798 | ATCN_5253 | 54857 |
| TTCN_3730 | 40799 | TTCN_7703 | 54858 |
| CTCN_4617 | 40800 | ATCN_5254 | 54859 |
| GTCN_2374 | 40801 | CTCN_9395 | 54860 |
| GTCN_2375 | 40802 | TTCN_7704 | 54861 |
| CTCN_4618 | 40803 | CTCN_9396 | 54862 |
| GTCN_2376 | 40804 | CTCN_9397 | 54863 |
| CTCN_4619 | 40805 | GTCN_5051 | 54864 |
| CTCN_4620 | 40806 | TTCN_7705 | 54865 |
| GTCN_2377 | 40807 | CTCN_9398 | 54866 |
| CTCN_4621 | 40808 | GTCN_5052 | 54867 |
| TTCN_3731 | 40809 | GTCN_5053 | 54868 |
| ATCN_2623 | 40810 | CTCN_9399 | 54869 |
| ATCN_2624 | 40811 | CTCN_9400 | 54870 |
| CTCN_4622 | 40812 | TTCN_7706 | 54871 |
| TTCN_3732 | 40813 | TTCN_7707 | 54872 |
| CTCN_4623 | 40814 | CTCN_9401 | 54873 |
| ATCN_2625 | 40815 | GTCN_5054 | 54874 |
| CTCN_4624 | 40816 | CTCN_9402 | 54875 |
| CTCN_4625 | 40817 | GTCN_5055 | 54876 |
| GTCN_2378 | 40818 | ATCN_5255 | 54877 |
| CTCN_4626 | 40819 | TTCN_7708 | 54878 |
| GTCN_2379 | 40820 | ATCN_5256 | 54879 |
| TTCN_3733 | 40821 | GTCN_5056 | 54880 |
| CTCN_4627 | 40822 | CTCN_9403 | 54881 |
| CTCN_4628 | 40823 | TTCN_7709 | 54882 |

| | | | |
|---|---|---|---|
| ATCN_2626 | 40824 | ATCN_5257 | 54883 |
| ATCN_2627 | 40825 | CTCN_9404 | 54884 |
| ATCN_2628 | 40826 | TTCN_7710 | 54885 |
| CTCN_4629 | 40827 | TTCN_7711 | 54886 |
| CTCN_4630 | 40828 | CTCN_9405 | 54887 |
| TTCN_3734 | 40829 | ATCN_5258 | 54888 |
| TTCN_3735 | 40830 | CTCN_9406 | 54889 |
| CTCN_4631 | 40831 | CTCN_9407 | 54890 |
| GTCN_2380 | 40832 | ATCN_5259 | 54891 |
| CTCN_4632 | 40833 | ATCN_5260 | 54892 |
| CTCN_4633 | 40834 | CTCN_9408 | 54893 |
| CTCN_4634 | 40835 | TTCN_7712 | 54894 |
| CTCN_4635 | 40836 | GTCN_5057 | 54895 |
| GTCN_2381 | 40837 | CTCN_9409 | 54896 |
| CTCN_4636 | 40838 | GTCN_5058 | 54897 |
| GTCN_2382 | 40839 | GTCN_5059 | 54898 |
| ATCN_2629 | 40840 | ATCN_5261 | 54899 |
| TTCN_3736 | 40841 | ATCN_5262 | 54900 |
| TTCN_3737 | 40842 | GTCN_5060 | 54901 |
| CTCN_4637 | 40843 | TTCN_7713 | 54902 |
| GTCN_2383 | 40844 | TTCN_7714 | 54903 |
| TTCN_3738 | 40845 | TTCN_7715 | 54904 |
| CTCN_4638 | 40846 | ATCN_5263 | 54905 |
| CTCN_4639 | 40847 | TTCN_7716 | 54906 |
| TTCN_3739 | 40848 | GTCN_5061 | 54907 |
| ATCN_2630 | 40849 | GTCN_5062 | 54908 |
| CTCN_4640 | 40850 | TTCN_7717 | 54909 |
| CTCN_4641 | 40851 | CTCN_9410 | 54910 |
| ATCN_2631 | 40852 | ATCN_5264 | 54911 |
| CTCN_4642 | 40853 | CTCN_9411 | 54912 |
| ATCN_2632 | 40854 | CTCN_9412 | 54913 |
| GTCN_2384 | 40855 | ATCN_5265 | 54914 |
| ATCN_2633 | 40856 | CTCN_9413 | 54915 |
| ATCN_2634 | 40857 | GTCN_5063 | 54916 |
| TTCN_3740 | 40858 | CTCN_9414 | 54917 |
| ATCN_2635 | 40859 | GTCN_5064 | 54918 |
| GTCN_2385 | 40860 | CTCN_9415 | 54919 |
| ATCN_2636 | 40861 | GTCN_5065 | 54920 |
| ATCN_2637 | 40862 | ATCN_5266 | 54921 |
| TTCN_3741 | 40863 | TTCN_7718 | 54922 |
| GTCN_2386 | 40864 | GTCN_5066 | 54923 |
| TTCN_3742 | 40865 | TTCN_7719 | 54924 |
| CTCN_4643 | 40866 | CTCN_9416 | 54925 |

FIG. 37 (continued)

| | | | |
|---|---|---|---|
| TTCN_3743 | 40867 | CTCN_9417 | 54926 |
| CTCN_4644 | 40868 | TTCN_7720 | 54927 |
| CTCN_4645 | 40869 | TTCN_7721 | 54928 |
| CTCN_4646 | 40870 | CTCN_9418 | 54929 |
| CTCN_4647 | 40871 | CTCN_9419 | 54930 |
| TTCN_3744 | 40872 | CTCN_9420 | 54931 |
| CTCN_4648 | 40873 | CTCN_9421 | 54932 |
| ATCN_2638 | 40874 | ATCN_5267 | 54933 |
| CTCN_4649 | 40875 | CTCN_9422 | 54934 |
| GTCN_2387 | 40876 | CTCN_9423 | 54935 |
| CTCN_4650 | 40877 | CTCN_9424 | 54936 |
| TTCN_3745 | 40878 | GTCN_5067 | 54937 |
| CTCN_4651 | 40879 | CTCN_9425 | 54938 |
| TTCN_3746 | 40880 | ATCN_5268 | 54939 |
| TTCN_3747 | 40881 | CTCN_9426 | 54940 |
| ATCN_2639 | 40882 | ATCN_5269 | 54941 |
| TTCN_3748 | 40883 | CTCN_9427 | 54942 |
| GTCN_2388 | 40884 | GTCN_5068 | 54943 |
| ATCN_2640 | 40885 | CTCN_9428 | 54944 |
| CTCN_4652 | 40886 | GTCN_5069 | 54945 |
| GTCN_2389 | 40887 | GTCN_5070 | 54946 |
| CTCN_4653 | 40888 | TTCN_7722 | 54947 |
| CTCN_4654 | 40889 | TTCN_7723 | 54948 |
| ATCN_2641 | 40890 | GTCN_5071 | 54949 |
| TTCN_3749 | 40891 | CTCN_9429 | 54950 |
| GTCN_2390 | 40892 | ATCN_5270 | 54951 |
| CTCN_4655 | 40893 | ATCN_5271 | 54952 |
| GTCN_2391 | 40894 | CTCN_9430 | 54953 |
| TTCN_3750 | 40895 | GTCN_5072 | 54954 |
| CTCN_4656 | 40896 | CTCN_9431 | 54955 |
| TTCN_3751 | 40897 | GTCN_5073 | 54956 |
| CTCN_4657 | 40898 | ATCN_5272 | 54957 |
| TTCN_3752 | 40899 | GTCN_5074 | 54958 |
| CTCN_4658 | 40900 | CTCN_9432 | 54959 |
| CTCN_4659 | 40901 | CTCN_9433 | 54960 |
| CTCN_4660 | 40902 | TTCN_7724 | 54961 |
| ATCN_2642 | 40903 | ATCN_5273 | 54962 |
| TTCN_3753 | 40904 | ATCN_5274 | 54963 |
| GTCN_2392 | 40905 | ATCN_5275 | 54964 |
| ATCN_2643 | 40906 | ATCN_5276 | 54965 |
| GTCN_2393 | 40907 | ATCN_5277 | 54966 |
| ATCN_2644 | 40908 | TTCN_7725 | 54967 |
| ATCN_2645 | 40909 | CTCN_9434 | 54968 |

| | | | |
|---|---|---|---|
| ATCN_2646 | 40910 | TTCN_7726 | 54969 |
| TTCN_3754 | 40911 | GTCN_5075 | 54970 |
| ATCN_2647 | 40912 | CTCN_9435 | 54971 |
| CTCN_4661 | 40913 | ATCN_5278 | 54972 |
| CTCN_4662 | 40914 | CTCN_9436 | 54973 |
| TTCN_3755 | 40915 | GTCN_5076 | 54974 |
| ATCN_2648 | 40916 | ATCN_5279 | 54975 |
| ATCN_2649 | 40917 | ATCN_5280 | 54976 |
| GTCN_2394 | 40918 | CTCN_9437 | 54977 |
| CTCN_4663 | 40919 | TTCN_7727 | 54978 |
| GTCN_2395 | 40920 | ATCN_5281 | 54979 |
| CTCN_4664 | 40921 | CTCN_9438 | 54980 |
| CTCN_4665 | 40922 | GTCN_5077 | 54981 |
| CTCN_4666 | 40923 | ATCN_5282 | 54982 |
| TTCN_3756 | 40924 | TTCN_7728 | 54983 |
| TTCN_3757 | 40925 | GTCN_5078 | 54984 |
| GTCN_2396 | 40926 | ATCN_5283 | 54985 |
| TTCN_3758 | 40927 | ATCN_5284 | 54986 |
| CTCN_4667 | 40928 | CTCN_9439 | 54987 |
| CTCN_4668 | 40929 | CTCN_9440 | 54988 |
| CTCN_4669 | 40930 | CTCN_9441 | 54989 |
| TTCN_3759 | 40931 | CTCN_9442 | 54990 |
| TTCN_3760 | 40932 | TTCN_7729 | 54991 |
| ATCN_2650 | 40933 | ATCN_5285 | 54992 |
| GTCN_2397 | 40934 | TTCN_7730 | 54993 |
| GTCN_2398 | 40935 | CTCN_9443 | 54994 |
| TTCN_3761 | 40936 | GTCN_5079 | 54995 |
| GTCN_2399 | 40937 | CTCN_9444 | 54996 |
| CTCN_4670 | 40938 | ATCN_5286 | 54997 |
| GTCN_2400 | 40939 | CTCN_9445 | 54998 |
| TTCN_3762 | 40940 | CTCN_9446 | 54999 |
| ATCN_2651 | 40941 | ATCN_5287 | 55000 |
| ATCN_2652 | 40942 | ATCN_5288 | 55001 |
| CTCN_4671 | 40943 | CTCN_9447 | 55002 |
| TTCN_3763 | 40944 | CTCN_9448 | 55003 |
| CTCN_4672 | 40945 | GTCN_5080 | 55004 |
| CTCN_4673 | 40946 | TTCN_7731 | 55005 |
| TTCN_3764 | 40947 | GTCN_5081 | 55006 |
| ATCN_2653 | 40948 | CTCN_9449 | 55007 |
| CTCN_4674 | 40949 | CTCN_9450 | 55008 |
| CTCN_4675 | 40950 | TTCN_7732 | 55009 |
| CTCN_4676 | 40951 | TTCN_7733 | 55010 |
| TTCN_3765 | 40952 | ATCN_5289 | 55011 |

FIG. 37 (continued)

| | | | |
|---|---|---|---|
| ATCN_2654 | 40953 | GTCN_5082 | 55012 |
| GTCN_2401 | 40954 | GTCN_5083 | 55013 |
| ATCN_2655 | 40955 | GTCN_5084 | 55014 |
| TTCN_3766 | 40956 | GTCN_5085 | 55015 |
| ATCN_2656 | 40957 | ATCN_5290 | 55016 |
| TTCN_3767 | 40958 | TTCN_7734 | 55017 |
| CTCN_4677 | 40959 | TTCN_7735 | 55018 |
| TTCN_3768 | 40960 | TTCN_7736 | 55019 |
| TTCN_3769 | 40961 | GTCN_5086 | 55020 |
| ATCN_2657 | 40962 | TTCN_7737 | 55021 |
| TTCN_3770 | 40963 | TTCN_7738 | 55022 |
| ATCN_2658 | 40964 | TTCN_7739 | 55023 |
| TTCN_3771 | 40965 | GTCN_5087 | 55024 |
| TTCN_3772 | 40966 | TTCN_7740 | 55025 |
| ATCN_2659 | 40967 | CTCN_9451 | 55026 |
| TTCN_3773 | 40968 | ATCN_5291 | 55027 |
| ATCN_2660 | 40969 | TTCN_7741 | 55028 |
| TTCN_3774 | 40970 | TTCN_7742 | 55029 |
| GTCN_2402 | 40971 | GTCN_5088 | 55030 |
| TTCN_3775 | 40972 | CTCN_9452 | 55031 |
| CTCN_4678 | 40973 | CTCN_9453 | 55032 |
| CTCN_4679 | 40974 | CTCN_9454 | 55033 |
| ATCN_2661 | 40975 | ATCN_5292 | 55034 |
| CTCN_4680 | 40976 | TTCN_7743 | 55035 |
| CTCN_4681 | 40977 | CTCN_9455 | 55036 |
| ATCN_2662 | 40978 | TTCN_7744 | 55037 |
| TTCN_3776 | 40979 | CTCN_9456 | 55038 |
| ATCN_2663 | 40980 | ATCN_5293 | 55039 |
| CTCN_4682 | 40981 | CTCN_9457 | 55040 |
| GTCN_2403 | 40982 | TTCN_7745 | 55041 |
| TTCN_3777 | 40983 | TTCN_7746 | 55042 |
| CTCN_4683 | 40984 | TTCN_7747 | 55043 |
| GTCN_2404 | 40985 | TTCN_7748 | 55044 |
| ATCN_2664 | 40986 | TTCN_7749 | 55045 |
| GTCN_2405 | 40987 | TTCN_7750 | 55046 |
| CTCN_4684 | 40988 | ATCN_5294 | 55047 |
| TTCN_3778 | 40989 | TTCN_7751 | 55048 |
| ATCN_2665 | 40990 | TTCN_7752 | 55049 |
| TTCN_3779 | 40991 | CTCN_9458 | 55050 |
| CTCN_4685 | 40992 | GTCN_5089 | 55051 |
| CTCN_4686 | 40993 | CTCN_9459 | 55052 |
| GTCN_2406 | 40994 | CTCN_9460 | 55053 |
| TTCN_3780 | 40995 | ATCN_5295 | 55054 |

| | | | |
|---|---|---|---|
| GTCN_2407 | 40996 | TTCN_7753 | 55055 |
| TTCN_3781 | 40997 | CTCN_9461 | 55056 |
| GTCN_2408 | 40998 | ATCN_5296 | 55057 |
| TTCN_3782 | 40999 | CTCN_9462 | 55058 |
| TTCN_3783 | 41000 | CTCN_9463 | 55059 |
| CTCN_4687 | 41001 | CTCN_9464 | 55060 |
| CTCN_4688 | 41002 | CTCN_9465 | 55061 |
| ATCN_2666 | 41003 | CTCN_9466 | 55062 |
| ATCN_2667 | 41004 | CTCN_9467 | 55063 |
| ATCN_2668 | 41005 | CTCN_9468 | 55064 |
| ATCN_2669 | 41006 | GTCN_5090 | 55065 |
| ATCN_2670 | 41007 | TTCN_7754 | 55066 |
| TTCN_3784 | 41008 | CTCN_9469 | 55067 |
| CTCN_4689 | 41009 | GTCN_5091 | 55068 |
| TTCN_3785 | 41010 | CTCN_9470 | 55069 |
| CTCN_4690 | 41011 | ATCN_5297 | 55070 |
| ATCN_2671 | 41012 | TTCN_7755 | 55071 |
| ATCN_2672 | 41013 | ATCN_5298 | 55072 |
| ATCN_2673 | 41014 | TTCN_7756 | 55073 |
| CTCN_4691 | 41015 | CTCN_9471 | 55074 |
| ATCN_2674 | 41016 | ATCN_5299 | 55075 |
| ATCN_2675 | 41017 | CTCN_9472 | 55076 |
| ATCN_2676 | 41018 | TTCN_7757 | 55077 |
| TTCN_3786 | 41019 | CTCN_9473 | 55078 |
| TTCN_3787 | 41020 | TTCN_7758 | 55079 |
| GTCN_2409 | 41021 | TTCN_7759 | 55080 |
| GTCN_2410 | 41022 | TTCN_7760 | 55081 |
| CTCN_4692 | 41023 | CTCN_9474 | 55082 |
| CTCN_4693 | 41024 | TTCN_7761 | 55083 |
| GTCN_2411 | 41025 | CTCN_9475 | 55084 |
| CTCN_4694 | 41026 | CTCN_9476 | 55085 |
| ATCN_2677 | 41027 | CTCN_9477 | 55086 |
| CTCN_4695 | 41028 | TTCN_7762 | 55087 |
| CTCN_4696 | 41029 | ATCN_5300 | 55088 |
| ATCN_2678 | 41030 | CTCN_9478 | 55089 |
| CTCN_4697 | 41031 | ATCN_5301 | 55090 |
| CTCN_4698 | 41032 | TTCN_7763 | 55091 |
| ATCN_2679 | 41033 | TTCN_7764 | 55092 |
| CTCN_4699 | 41034 | CTCN_9479 | 55093 |
| ATCN_2680 | 41035 | GTCN_5092 | 55094 |
| CTCN_4700 | 41036 | TTCN_7765 | 55095 |
| TTCN_3788 | 41037 | ATCN_5302 | 55096 |
| CTCN_4701 | 41038 | TTCN_7766 | 55097 |

FIG. 37 (continued)

| | | | |
|---|---|---|---|
| GTCN_2412 | 41039 | TTCN_7767 | 55098 |
| GTCN_2413 | 41040 | CTCN_9480 | 55099 |
| CTCN_4702 | 41041 | ATCN_5303 | 55100 |
| GTCN_2414 | 41042 | CTCN_9481 | 55101 |
| TTCN_3789 | 41043 | ATCN_5304 | 55102 |
| GTCN_2415 | 41044 | CTCN_9482 | 55103 |
| TTCN_3790 | 41045 | GTCN_5093 | 55104 |
| TTCN_3791 | 41046 | CTCN_9483 | 55105 |
| CTCN_4703 | 41047 | CTCN_9484 | 55106 |
| CTCN_4704 | 41048 | GTCN_5094 | 55107 |
| ATCN_2681 | 41049 | GTCN_5095 | 55108 |
| CTCN_4705 | 41050 | CTCN_9485 | 55109 |
| CTCN_4706 | 41051 | ATCN_5305 | 55110 |
| CTCN_4707 | 41052 | ATCN_5306 | 55111 |
| ATCN_2682 | 41053 | CTCN_9486 | 55112 |
| CTCN_4708 | 41054 | CTCN_9487 | 55113 |
| GTCN_2416 | 41055 | CTCN_9488 | 55114 |
| TTCN_3792 | 41056 | ATCN_5307 | 55115 |
| ATCN_2683 | 41057 | TTCN_7768 | 55116 |
| GTCN_2417 | 41058 | TTCN_7769 | 55117 |
| CTCN_4709 | 41059 | CTCN_9489 | 55118 |
| GTCN_2418 | 41060 | CTCN_9490 | 55119 |
| CTCN_4710 | 41061 | CTCN_9491 | 55120 |
| CTCN_4711 | 41062 | ATCN_5308 | 55121 |
| CTCN_4712 | 41063 | CTCN_9492 | 55122 |
| ATCN_2684 | 41064 | ATCN_5309 | 55123 |
| ATCN_2685 | 41065 | CTCN_9493 | 55124 |
| TTCN_3793 | 41066 | TTCN_7770 | 55125 |
| CTCN_4713 | 41067 | GTCN_5096 | 55126 |
| TTCN_3794 | 41068 | TTCN_7771 | 55127 |
| TTCN_3795 | 41069 | CTCN_9494 | 55128 |
| CTCN_4714 | 41070 | GTCN_5097 | 55129 |
| CTCN_4715 | 41071 | TTCN_7772 | 55130 |
| CTCN_4716 | 41072 | ATCN_5310 | 55131 |
| TTCN_3796 | 41073 | ATCN_5311 | 55132 |
| CTCN_4717 | 41074 | CTCN_9495 | 55133 |
| GTCN_2419 | 41075 | CTCN_9496 | 55134 |
| TTCN_3797 | 41076 | ATCN_5312 | 55135 |
| GTCN_2420 | 41077 | TTCN_7773 | 55136 |
| TTCN_3798 | 41078 | TTCN_7774 | 55137 |
| CTCN_4718 | 41079 | CTCN_9497 | 55138 |
| GTCN_2421 | 41080 | ATCN_5313 | 55139 |
| CTCN_4719 | 41081 | TTCN_7775 | 55140 |

| | | | |
|---|---|---|---|
| ATCN_2686 | 41082 | CTCN_9498 | 55141 |
| ATCN_2687 | 41083 | TTCN_7776 | 55142 |
| CTCN_4720 | 41084 | TTCN_7777 | 55143 |
| CTCN_4721 | 41085 | ATCN_5314 | 55144 |
| ATCN_2688 | 41086 | TTCN_7778 | 55145 |
| CTCN_4722 | 41087 | GTCN_5098 | 55146 |
| TTCN_3799 | 41088 | ATCN_5315 | 55147 |
| ATCN_2689 | 41089 | ATCN_5316 | 55148 |
| TTCN_3800 | 41090 | CTCN_9499 | 55149 |
| CTCN_4723 | 41091 | ATCN_5317 | 55150 |
| ATCN_2690 | 41092 | CTCN_9500 | 55151 |
| ATCN_2691 | 41093 | CTCN_9501 | 55152 |
| ATCN_2692 | 41094 | ATCN_5318 | 55153 |
| TTCN_3801 | 41095 | TTCN_7779 | 55154 |
| CTCN_4724 | 41096 | TTCN_7780 | 55155 |
| CTCN_4725 | 41097 | GTCN_5099 | 55156 |
| GTCN_2422 | 41098 | TTCN_7781 | 55157 |
| ATCN_2693 | 41099 | GTCN_5100 | 55158 |
| TTCN_3802 | 41100 | GTCN_5101 | 55159 |
| TTCN_3803 | 41101 | TTCN_7782 | 55160 |
| GTCN_2423 | 41102 | TTCN_7783 | 55161 |
| GTCN_2424 | 41103 | ATCN_5319 | 55162 |
| TTCN_3804 | 41104 | TTCN_7784 | 55163 |
| CTCN_4726 | 41105 | GTCN_5102 | 55164 |
| TTCN_3805 | 41106 | TTCN_7785 | 55165 |
| GTCN_2425 | 41107 | CTCN_9502 | 55166 |
| ATCN_2694 | 41108 | CTCN_9503 | 55167 |
| TTCN_3806 | 41109 | GTCN_5103 | 55168 |
| TTCN_3807 | 41110 | CTCN_9504 | 55169 |
| CTCN_4727 | 41111 | GTCN_5104 | 55170 |
| GTCN_2426 | 41112 | CTCN_9505 | 55171 |
| TTCN_3808 | 41113 | CTCN_9506 | 55172 |
| GTCN_2427 | 41114 | TTCN_7786 | 55173 |
| CTCN_4728 | 41115 | CTCN_9507 | 55174 |
| TTCN_3809 | 41116 | CTCN_9508 | 55175 |
| CTCN_4729 | 41117 | ATCN_5320 | 55176 |
| CTCN_4730 | 41118 | ATCN_5321 | 55177 |
| ATCN_2695 | 41119 | CTCN_9509 | 55178 |
| CTCN_4731 | 41120 | CTCN_9510 | 55179 |
| GTCN_2428 | 41121 | CTCN_9511 | 55180 |
| CTCN_4732 | 41122 | TTCN_7787 | 55181 |
| TTCN_3810 | 41123 | ATCN_5322 | 55182 |
| TTCN_3811 | 41124 | TTCN_7788 | 55183 |

FIG. 37 (continued)

| | | | |
|---|---|---|---|
| ATCN_2696 | 41125 | TTCN_7789 | 55184 |
| TTCN_3812 | 41126 | CTCN_9512 | 55185 |
| TTCN_3813 | 41127 | GTCN_5105 | 55186 |
| CTCN_4733 | 41128 | CTCN_9513 | 55187 |
| TTCN_3814 | 41129 | ATCN_5323 | 55188 |
| CTCN_4734 | 41130 | ATCN_5324 | 55189 |
| ATCN_2697 | 41131 | CTCN_9514 | 55190 |
| GTCN_2429 | 41132 | CTCN_9515 | 55191 |
| GTCN_2430 | 41133 | CTCN_9516 | 55192 |
| CTCN_4735 | 41134 | ATCN_5325 | 55193 |
| CTCN_4736 | 41135 | GTCN_5106 | 55194 |
| CTCN_4737 | 41136 | TTCN_7790 | 55195 |
| CTCN_4738 | 41137 | CTCN_9517 | 55196 |
| ATCN_2698 | 41138 | ATCN_5326 | 55197 |
| CTCN_4739 | 41139 | GTCN_5107 | 55198 |
| CTCN_4740 | 41140 | ATCN_5327 | 55199 |
| ATCN_2699 | 41141 | TTCN_7791 | 55200 |
| CTCN_4741 | 41142 | GTCN_5108 | 55201 |
| GTCN_2431 | 41143 | TTCN_7792 | 55202 |
| ATCN_2700 | 41144 | CTCN_9518 | 55203 |
| CTCN_4742 | 41145 | ATCN_5328 | 55204 |
| CTCN_4743 | 41146 | TTCN_7793 | 55205 |
| CTCN_4744 | 41147 | TTCN_7794 | 55206 |
| GTCN_2432 | 41148 | TTCN_7795 | 55207 |
| GTCN_2433 | 41149 | GTCN_5109 | 55208 |
| GTCN_2434 | 41150 | TTCN_7796 | 55209 |
| TTCN_3815 | 41151 | CTCN_9519 | 55210 |
| GTCN_2435 | 41152 | ATCN_5329 | 55211 |
| TTCN_3816 | 41153 | ATCN_5330 | 55212 |
| CTCN_4745 | 41154 | GTCN_5110 | 55213 |
| CTCN_4746 | 41155 | TTCN_7797 | 55214 |
| CTCN_4747 | 41156 | CTCN_9520 | 55215 |
| GTCN_2436 | 41157 | CTCN_9521 | 55216 |
| CTCN_4748 | 41158 | GTCN_5111 | 55217 |
| GTCN_2437 | 41159 | CTCN_9522 | 55218 |
| CTCN_4749 | 41160 | GTCN_5112 | 55219 |
| CTCN_4750 | 41161 | CTCN_9523 | 55220 |
| CTCN_4751 | 41162 | TTCN_7798 | 55221 |
| GTCN_2438 | 41163 | TTCN_7799 | 55222 |
| GTCN_2439 | 41164 | GTCN_5113 | 55223 |
| GTCN_2440 | 41165 | CTCN_9524 | 55224 |
| TTCN_3817 | 41166 | CTCN_9525 | 55225 |
| ATCN_2701 | 41167 | CTCN_9526 | 55226 |

| | | | |
|---|---|---|---|
| GTCN_2441 | 41168 | TTCN_7800 | 55227 |
| CTCN_4752 | 41169 | ATCN_5331 | 55228 |
| CTCN_4753 | 41170 | TTCN_7801 | 55229 |
| TTCN_3818 | 41171 | CTCN_9527 | 55230 |
| CTCN_4754 | 41172 | CTCN_9528 | 55231 |
| ATCN_2702 | 41173 | CTCN_9529 | 55232 |
| CTCN_4755 | 41174 | ATCN_5332 | 55233 |
| CTCN_4756 | 41175 | CTCN_9530 | 55234 |
| ATCN_2703 | 41176 | CTCN_9531 | 55235 |
| GTCN_2442 | 41177 | CTCN_9532 | 55236 |
| CTCN_4757 | 41178 | GTCN_5114 | 55237 |
| CTCN_4758 | 41179 | TTCN_7802 | 55238 |
| TTCN_3819 | 41180 | GTCN_5115 | 55239 |
| ATCN_2704 | 41181 | CTCN_9533 | 55240 |
| GTCN_2443 | 41182 | TTCN_7803 | 55241 |
| CTCN_4759 | 41183 | CTCN_9534 | 55242 |
| GTCN_2444 | 41184 | GTCN_5116 | 55243 |
| TTCN_3820 | 41185 | CTCN_9535 | 55244 |
| ATCN_2705 | 41186 | ATCN_5333 | 55245 |
| TTCN_3821 | 41187 | ATCN_5334 | 55246 |
| ATCN_2706 | 41188 | CTCN_9536 | 55247 |
| GTCN_2445 | 41189 | CTCN_9537 | 55248 |
| TTCN_3822 | 41190 | CTCN_9538 | 55249 |
| TTCN_3823 | 41191 | TTCN_7804 | 55250 |
| CTCN_4760 | 41192 | TTCN_7805 | 55251 |
| CTCN_4761 | 41193 | ATCN_5335 | 55252 |
| GTCN_2446 | 41194 | ATCN_5336 | 55253 |
| TTCN_3824 | 41195 | TTCN_7806 | 55254 |
| TTCN_3825 | 41196 | CTCN_9539 | 55255 |
| TTCN_3826 | 41197 | TTCN_7807 | 55256 |
| TTCN_3827 | 41198 | GTCN_5117 | 55257 |
| TTCN_3828 | 41199 | ATCN_5337 | 55258 |
| ATCN_2707 | 41200 | CTCN_9540 | 55259 |
| GTCN_2447 | 41201 | CTCN_9541 | 55260 |
| GTCN_2448 | 41202 | ATCN_5338 | 55261 |
| TTCN_3829 | 41203 | GTCN_5118 | 55262 |
| CTCN_4762 | 41204 | CTCN_9542 | 55263 |
| TTCN_3830 | 41205 | GTCN_5119 | 55264 |
| ATCN_2708 | 41206 | CTCN_9543 | 55265 |
| GTCN_2449 | 41207 | GTCN_5120 | 55266 |
| TTCN_3831 | 41208 | ATCN_5339 | 55267 |
| TTCN_3832 | 41209 | CTCN_9544 | 55268 |
| TTCN_3833 | 41210 | CTCN_9545 | 55269 |

FIG. 37 (continued)

| | | | |
|---|---|---|---|
| TTCN_3834 | 41211 | ATCN_5340 | 55270 |
| GTCN_2450 | 41212 | TTCN_7808 | 55271 |
| GTCN_2451 | 41213 | CTCN_9546 | 55272 |
| GTCN_2452 | 41214 | GTCN_5121 | 55273 |
| TTCN_3835 | 41215 | TTCN_7809 | 55274 |
| TTCN_3836 | 41216 | CTCN_9547 | 55275 |
| CTCN_4763 | 41217 | TTCN_7810 | 55276 |
| CTCN_4764 | 41218 | CTCN_9548 | 55277 |
| GTCN_2453 | 41219 | CTCN_9549 | 55278 |
| TTCN_3837 | 41220 | CTCN_9550 | 55279 |
| ATCN_2709 | 41221 | ATCN_5341 | 55280 |
| GTCN_2454 | 41222 | ATCN_5342 | 55281 |
| CTCN_4765 | 41223 | GTCN_5122 | 55282 |
| CTCN_4766 | 41224 | ATCN_5343 | 55283 |
| GTCN_2455 | 41225 | ATCN_5344 | 55284 |
| CTCN_4767 | 41226 | GTCN_5123 | 55285 |
| GTCN_2456 | 41227 | GTCN_5124 | 55286 |
| CTCN_4768 | 41228 | TTCN_7811 | 55287 |
| GTCN_2457 | 41229 | GTCN_5125 | 55288 |
| ATCN_2710 | 41230 | CTCN_9551 | 55289 |
| CTCN_4769 | 41231 | TTCN_7812 | 55290 |
| CTCN_4770 | 41232 | CTCN_9552 | 55291 |
| TTCN_3838 | 41233 | GTCN_5126 | 55292 |
| CTCN_4771 | 41234 | CTCN_9553 | 55293 |
| GTCN_2458 | 41235 | TTCN_7813 | 55294 |
| CTCN_4772 | 41236 | ATCN_5345 | 55295 |
| CTCN_4773 | 41237 | GTCN_5127 | 55296 |
| TTCN_3839 | 41238 | TTCN_7814 | 55297 |
| CTCN_4774 | 41239 | TTCN_7815 | 55298 |
| CTCN_4775 | 41240 | GTCN_5128 | 55299 |
| CTCN_4776 | 41241 | TTCN_7816 | 55300 |
| TTCN_3840 | 41242 | TTCN_7817 | 55301 |
| CTCN_4777 | 41243 | ATCN_5346 | 55302 |
| CTCN_4778 | 41244 | TTCN_7818 | 55303 |
| TTCN_3841 | 41245 | CTCN_9554 | 55304 |
| CTCN_4779 | 41246 | TTCN_7819 | 55305 |
| GTCN_2459 | 41247 | CTCN_9555 | 55306 |
| CTCN_4780 | 41248 | CTCN_9556 | 55307 |
| GTCN_2460 | 41249 | TTCN_7820 | 55308 |
| ATCN_2711 | 41250 | CTCN_9557 | 55309 |
| TTCN_3842 | 41251 | GTCN_5129 | 55310 |
| TTCN_3843 | 41252 | TTCN_7821 | 55311 |
| ATCN_2712 | 41253 | CTCN_9558 | 55312 |

| | | | |
|---|---|---|---|
| GTCN_2461 | 41254 | TTCN_7822 | 55313 |
| TTCN_3844 | 41255 | CTCN_9559 | 55314 |
| CTCN_4781 | 41256 | TTCN_7823 | 55315 |
| ATCN_2713 | 41257 | TTCN_7824 | 55316 |
| CTCN_4782 | 41258 | ATCN_5347 | 55317 |
| GTCN_2462 | 41259 | CTCN_9560 | 55318 |
| CTCN_4783 | 41260 | GTCN_5130 | 55319 |
| CTCN_4784 | 41261 | ATCN_5348 | 55320 |
| GTCN_2463 | 41262 | GTCN_5131 | 55321 |
| CTCN_4785 | 41263 | CTCN_9561 | 55322 |
| TTCN_3845 | 41264 | GTCN_5132 | 55323 |
| ATCN_2714 | 41265 | TTCN_7825 | 55324 |
| ATCN_2715 | 41266 | CTCN_9562 | 55325 |
| CTCN_4786 | 41267 | CTCN_9563 | 55326 |
| CTCN_4787 | 41268 | TTCN_7826 | 55327 |
| TTCN_3846 | 41269 | TTCN_7827 | 55328 |
| TTCN_3847 | 41270 | TTCN_7828 | 55329 |
| TTCN_3848 | 41271 | GTCN_5133 | 55330 |
| CTCN_4788 | 41272 | CTCN_9564 | 55331 |
| CTCN_4789 | 41273 | TTCN_7829 | 55332 |
| CTCN_4790 | 41274 | TTCN_7830 | 55333 |
| ATCN_2716 | 41275 | TTCN_7831 | 55334 |
| GTCN_2464 | 41276 | GTCN_5134 | 55335 |
| CTCN_4791 | 41277 | CTCN_9565 | 55336 |
| GTCN_2465 | 41278 | TTCN_7832 | 55337 |
| TTCN_3849 | 41279 | TTCN_7833 | 55338 |
| GTCN_2466 | 41280 | ATCN_5349 | 55339 |
| CTCN_4792 | 41281 | TTCN_7834 | 55340 |
| CTCN_4793 | 41282 | TTCN_7835 | 55341 |
| ATCN_2717 | 41283 | TTCN_7836 | 55342 |
| ATCN_2718 | 41284 | TTCN_7837 | 55343 |
| CTCN_4794 | 41285 | TTCN_7838 | 55344 |
| ATCN_2719 | 41286 | ATCN_5350 | 55345 |
| ATCN_2720 | 41287 | GTCN_5135 | 55346 |
| CTCN_4795 | 41288 | CTCN_9566 | 55347 |
| CTCN_4796 | 41289 | ATCN_5351 | 55348 |
| CTCN_4797 | 41290 | TTCN_7839 | 55349 |
| ATCN_2721 | 41291 | CTCN_9567 | 55350 |
| CTCN_4798 | 41292 | TTCN_7840 | 55351 |
| CTCN_4799 | 41293 | CTCN_9568 | 55352 |
| ATCN_2722 | 41294 | ATCN_5352 | 55353 |
| GTCN_2467 | 41295 | ATCN_5353 | 55354 |
| CTCN_4800 | 41296 | CTCN_9569 | 55355 |

FIG. 37 (continued)

| | | | |
|---|---|---|---|
| ATCN_2723 | 41297 | TTCN_7841 | 55356 |
| CTCN_4801 | 41298 | CTCN_9570 | 55357 |
| CTCN_4802 | 41299 | CTCN_9571 | 55358 |
| GTCN_2468 | 41300 | GTCN_5136 | 55359 |
| GTCN_2469 | 41301 | GTCN_5137 | 55360 |
| TTCN_3850 | 41302 | CTCN_9572 | 55361 |
| TTCN_3851 | 41303 | ATCN_5354 | 55362 |
| CTCN_4803 | 41304 | CTCN_9573 | 55363 |
| CTCN_4804 | 41305 | GTCN_5138 | 55364 |
| TTCN_3852 | 41306 | GTCN_5139 | 55365 |
| GTCN_2470 | 41307 | CTCN_9574 | 55366 |
| CTCN_4805 | 41308 | CTCN_9575 | 55367 |
| CTCN_4806 | 41309 | ATCN_5355 | 55368 |
| TTCN_3853 | 41310 | ATCN_5356 | 55369 |
| TTCN_3854 | 41311 | CTCN_9576 | 55370 |
| ATCN_2724 | 41312 | ATCN_5357 | 55371 |
| ATCN_2725 | 41313 | CTCN_9577 | 55372 |
| TTCN_3855 | 41314 | ATCN_5358 | 55373 |
| TTCN_3856 | 41315 | TTCN_7842 | 55374 |
| CTCN_4807 | 41316 | ATCN_5359 | 55375 |
| TTCN_3857 | 41317 | ATCN_5360 | 55376 |
| TTCN_3858 | 41318 | ATCN_5361 | 55377 |
| ATCN_2726 | 41319 | CTCN_9578 | 55378 |
| GTCN_2471 | 41320 | ATCN_5362 | 55379 |
| TTCN_3859 | 41321 | CTCN_9579 | 55380 |
| CTCN_4808 | 41322 | CTCN_9580 | 55381 |
| ATCN_2727 | 41323 | TTCN_7843 | 55382 |
| TTCN_3860 | 41324 | ATCN_5363 | 55383 |
| GTCN_2472 | 41325 | CTCN_9581 | 55384 |
| ATCN_2728 | 41326 | GTCN_5140 | 55385 |
| GTCN_2473 | 41327 | CTCN_9582 | 55386 |
| TTCN_3861 | 41328 | TTCN_7844 | 55387 |
| CTCN_4809 | 41329 | CTCN_9583 | 55388 |
| TTCN_3862 | 41330 | GTCN_5141 | 55389 |
| TTCN_3863 | 41331 | TTCN_7845 | 55390 |
| ATCN_2729 | 41332 | ATCN_5364 | 55391 |
| TTCN_3864 | 41333 | CTCN_9584 | 55392 |
| TTCN_3865 | 41334 | ATCN_5365 | 55393 |
| TTCN_3866 | 41335 | GTCN_5142 | 55394 |
| CTCN_4810 | 41336 | CTCN_9585 | 55395 |
| GTCN_2474 | 41337 | CTCN_9586 | 55396 |
| TTCN_3867 | 41338 | CTCN_9587 | 55397 |
| CTCN_4811 | 41339 | TTCN_7846 | 55398 |

| | | | |
|---|---|---|---|
| ATCN_2730 | 41340 | TTCN_7847 | 55399 |
| ATCN_2731 | 41341 | CTCN_9588 | 55400 |
| TTCN_3868 | 41342 | CTCN_9589 | 55401 |
| TTCN_3869 | 41343 | CTCN_9590 | 55402 |
| TTCN_3870 | 41344 | CTCN_9591 | 55403 |
| CTCN_4812 | 41345 | ATCN_5366 | 55404 |
| TTCN_3871 | 41346 | ATCN_5367 | 55405 |
| GTCN_2475 | 41347 | CTCN_9592 | 55406 |
| CTCN_4813 | 41348 | CTCN_9593 | 55407 |
| TTCN_3872 | 41349 | GTCN_5143 | 55408 |
| TTCN_3873 | 41350 | GTCN_5144 | 55409 |
| TTCN_3874 | 41351 | CTCN_9594 | 55410 |
| TTCN_3875 | 41352 | TTCN_7848 | 55411 |
| GTCN_2476 | 41353 | TTCN_7849 | 55412 |
| TTCN_3876 | 41354 | CTCN_9595 | 55413 |
| TTCN_3877 | 41355 | CTCN_9596 | 55414 |
| CTCN_4814 | 41356 | TTCN_7850 | 55415 |
| GTCN_2477 | 41357 | ATCN_5368 | 55416 |
| CTCN_4815 | 41358 | CTCN_9597 | 55417 |
| TTCN_3878 | 41359 | CTCN_9598 | 55418 |
| CTCN_4816 | 41360 | CTCN_9599 | 55419 |
| GTCN_2478 | 41361 | CTCN_9600 | 55420 |
| TTCN_3879 | 41362 | TTCN_7851 | 55421 |
| ATCN_2732 | 41363 | CTCN_9601 | 55422 |
| ATCN_2733 | 41364 | TTCN_7852 | 55423 |
| ATCN_2734 | 41365 | CTCN_9602 | 55424 |
| CTCN_4817 | 41366 | TTCN_7853 | 55425 |
| GTCN_2479 | 41367 | TTCN_7854 | 55426 |
| CTCN_4818 | 41368 | TTCN_7855 | 55427 |
| TTCN_3880 | 41369 | GTCN_5145 | 55428 |
| TTCN_3881 | 41370 | ATCN_5369 | 55429 |
| TTCN_3882 | 41371 | TTCN_7856 | 55430 |
| TTCN_3883 | 41372 | GTCN_5146 | 55431 |
| GTCN_2480 | 41373 | GTCN_5147 | 55432 |
| ATCN_2735 | 41374 | ATCN_5370 | 55433 |
| ATCN_2736 | 41375 | CTCN_9603 | 55434 |
| ATCN_2737 | 41376 | ATCN_5371 | 55435 |
| TTCN_3884 | 41377 | TTCN_7857 | 55436 |
| TTCN_3885 | 41378 | CTCN_9604 | 55437 |
| TTCN_3886 | 41379 | CTCN_9605 | 55438 |
| TTCN_3887 | 41380 | GTCN_5148 | 55439 |
| CTCN_4819 | 41381 | GTCN_5149 | 55440 |
| GTCN_2481 | 41382 | TTCN_7858 | 55441 |

FIG. 37 (continued)

| | | | |
|---|---|---|---|
| GTCN_2482 | 41383 | GTCN_5150 | 55442 |
| CTCN_4820 | 41384 | CTCN_9606 | 55443 |
| ATCN_2738 | 41385 | CTCN_9607 | 55444 |
| ATCN_2739 | 41386 | TTCN_7859 | 55445 |
| CTCN_4821 | 41387 | CTCN_9608 | 55446 |
| CTCN_4822 | 41388 | CTCN_9609 | 55447 |
| CTCN_4823 | 41389 | CTCN_9610 | 55448 |
| TTCN_3888 | 41390 | CTCN_9611 | 55449 |
| ATCN_2740 | 41391 | ATCN_5372 | 55450 |
| TTCN_3889 | 41392 | ATCN_5373 | 55451 |
| CTCN_4824 | 41393 | ATCN_5374 | 55452 |
| CTCN_4825 | 41394 | CTCN_9612 | 55453 |
| CTCN_4826 | 41395 | GTCN_5151 | 55454 |
| ATCN_2741 | 41396 | TTCN_7860 | 55455 |
| ATCN_2742 | 41397 | TTCN_7861 | 55456 |
| TTCN_3890 | 41398 | TTCN_7862 | 55457 |
| CTCN_4827 | 41399 | TTCN_7863 | 55458 |
| GTCN_2483 | 41400 | ATCN_5375 | 55459 |
| TTCN_3891 | 41401 | GTCN_5152 | 55460 |
| GTCN_2484 | 41402 | GTCN_5153 | 55461 |
| GTCN_2485 | 41403 | GTCN_5154 | 55462 |
| TTCN_3892 | 41404 | GTCN_5155 | 55463 |
| ATCN_2743 | 41405 | TTCN_7864 | 55464 |
| ATCN_2744 | 41406 | TTCN_7865 | 55465 |
| ATCN_2745 | 41407 | TTCN_7866 | 55466 |
| CTCN_4828 | 41408 | ATCN_5376 | 55467 |
| TTCN_3893 | 41409 | GTCN_5156 | 55468 |
| ATCN_2746 | 41410 | ATCN_5377 | 55469 |
| CTCN_4829 | 41411 | TTCN_7867 | 55470 |
| ATCN_2747 | 41412 | GTCN_5157 | 55471 |
| TTCN_3894 | 41413 | GTCN_5158 | 55472 |
| ATCN_2748 | 41414 | TTCN_7868 | 55473 |
| TTCN_3895 | 41415 | TTCN_7869 | 55474 |
| TTCN_3896 | 41416 | ATCN_5378 | 55475 |
| ATCN_2749 | 41417 | GTCN_5159 | 55476 |
| ATCN_2750 | 41418 | ATCN_5379 | 55477 |
| ATCN_2751 | 41419 | ATCN_5380 | 55478 |
| GTCN_2486 | 41420 | ATCN_5381 | 55479 |
| CTCN_4830 | 41421 | GTCN_5160 | 55480 |
| GTCN_2487 | 41422 | GTCN_5161 | 55481 |
| GTCN_2488 | 41423 | TTCN_7870 | 55482 |
| ATCN_2752 | 41424 | CTCN_9613 | 55483 |
| ATCN_2753 | 41425 | ATCN_5382 | 55484 |

| | | | |
|---|---|---|---|
| ATCN_2754 | 41426 | TTCN_7871 | 55485 |
| CTCN_4831 | 41427 | GTCN_5162 | 55486 |
| ATCN_2755 | 41428 | TTCN_7872 | 55487 |
| TTCN_3897 | 41429 | TTCN_7873 | 55488 |
| GTCN_2489 | 41430 | GTCN_5163 | 55489 |
| GTCN_2490 | 41431 | CTCN_9614 | 55490 |
| ATCN_2756 | 41432 | CTCN_9615 | 55491 |
| ATCN_2757 | 41433 | TTCN_7874 | 55492 |
| TTCN_3898 | 41434 | ATCN_5383 | 55493 |
| GTCN_2491 | 41435 | ATCN_5384 | 55494 |
| ATCN_2758 | 41436 | ATCN_5385 | 55495 |
| CTCN_4832 | 41437 | TTCN_7875 | 55496 |
| CTCN_4833 | 41438 | CTCN_9616 | 55497 |
| CTCN_4834 | 41439 | CTCN_9617 | 55498 |
| TTCN_3899 | 41440 | TTCN_7876 | 55499 |
| GTCN_2492 | 41441 | ATCN_5386 | 55500 |
| CTCN_4835 | 41442 | GTCN_5164 | 55501 |
| TTCN_3900 | 41443 | ATCN_5387 | 55502 |
| CTCN_4836 | 41444 | CTCN_9618 | 55503 |
| ATCN_2759 | 41445 | GTCN_5165 | 55504 |
| ATCN_2760 | 41446 | CTCN_9619 | 55505 |
| TTCN_3901 | 41447 | ATCN_5388 | 55506 |
| GTCN_2493 | 41448 | ATCN_5389 | 55507 |
| ATCN_2761 | 41449 | ATCN_5390 | 55508 |
| CTCN_4837 | 41450 | GTCN_5166 | 55509 |
| ATCN_2762 | 41451 | ATCN_5391 | 55510 |
| TTCN_3902 | 41452 | ATCN_5392 | 55511 |
| ATCN_2763 | 41453 | CTCN_9620 | 55512 |
| TTCN_3903 | 41454 | TTCN_7877 | 55513 |
| TTCN_3904 | 41455 | GTCN_5167 | 55514 |
| CTCN_4838 | 41456 | CTCN_9621 | 55515 |
| GTCN_2494 | 41457 | GTCN_5168 | 55516 |
| CTCN_4839 | 41458 | CTCN_9622 | 55517 |
| TTCN_3905 | 41459 | GTCN_5169 | 55518 |
| CTCN_4840 | 41460 | CTCN_9623 | 55519 |
| CTCN_4841 | 41461 | CTCN_9624 | 55520 |
| GTCN_2495 | 41462 | CTCN_9625 | 55521 |
| CTCN_4842 | 41463 | ATCN_5393 | 55522 |
| TTCN_3906 | 41464 | CTCN_9626 | 55523 |
| CTCN_4843 | 41465 | CTCN_9627 | 55524 |
| CTCN_4844 | 41466 | CTCN_9628 | 55525 |
| CTCN_4845 | 41467 | TTCN_7878 | 55526 |
| TTCN_3907 | 41468 | TTCN_7879 | 55527 |

FIG. 37 (continued)

| | | | |
|---|---|---|---|
| TTCN_3908 | 41469 | GTCN_5170 | 55528 |
| CTCN_4846 | 41470 | CTCN_9629 | 55529 |
| CTCN_4847 | 41471 | CTCN_9630 | 55530 |
| CTCN_4848 | 41472 | CTCN_9631 | 55531 |
| CTCN_4849 | 41473 | CTCN_9632 | 55532 |
| CTCN_4850 | 41474 | ATCN_5394 | 55533 |
| ATCN_2764 | 41475 | CTCN_9633 | 55534 |
| CTCN_4851 | 41476 | ATCN_5395 | 55535 |
| GTCN_2496 | 41477 | CTCN_9634 | 55536 |
| TTCN_3909 | 41478 | TTCN_7880 | 55537 |
| CTCN_4852 | 41479 | GTCN_5171 | 55538 |
| GTCN_2497 | 41480 | CTCN_9635 | 55539 |
| GTCN_2498 | 41481 | TTCN_7881 | 55540 |
| CTCN_4853 | 41482 | CTCN_9636 | 55541 |
| CTCN_4854 | 41483 | GTCN_5172 | 55542 |
| GTCN_2499 | 41484 | CTCN_9637 | 55543 |
| ATCN_2765 | 41485 | ATCN_5396 | 55544 |
| ATCN_2766 | 41486 | ATCN_5397 | 55545 |
| CTCN_4855 | 41487 | CTCN_9638 | 55546 |
| CTCN_4856 | 41488 | CTCN_9639 | 55547 |
| ATCN_2767 | 41489 | TTCN_7882 | 55548 |
| CTCN_4857 | 41490 | ATCN_5398 | 55549 |
| CTCN_4858 | 41491 | TTCN_7883 | 55550 |
| TTCN_3910 | 41492 | GTCN_5173 | 55551 |
| CTCN_4859 | 41493 | TTCN_7884 | 55552 |
| TTCN_3911 | 41494 | GTCN_5174 | 55553 |
| ATCN_2768 | 41495 | ATCN_5399 | 55554 |
| GTCN_2500 | 41496 | TTCN_7885 | 55555 |
| TTCN_3912 | 41497 | CTCN_9640 | 55556 |
| ATCN_2769 | 41498 | GTCN_5175 | 55557 |
| GTCN_2501 | 41499 | TTCN_7886 | 55558 |
| GTCN_2502 | 41500 | CTCN_9641 | 55559 |
| CTCN_4860 | 41501 | ATCN_5400 | 55560 |
| TTCN_3913 | 41502 | CTCN_9642 | 55561 |
| ATCN_2770 | 41503 | CTCN_9643 | 55562 |
| GTCN_2503 | 41504 | CTCN_9644 | 55563 |
| CTCN_4861 | 41505 | ATCN_5401 | 55564 |
| ATCN_2771 | 41506 | TTCN_7887 | 55565 |
| TTCN_3914 | 41507 | CTCN_9645 | 55566 |
| TTCN_3915 | 41508 | GTCN_5176 | 55567 |
| TTCN_3916 | 41509 | GTCN_5177 | 55568 |
| CTCN_4862 | 41510 | CTCN_9646 | 55569 |
| GTCN_2504 | 41511 | CTCN_9647 | 55570 |
| GTCN_2505 | 41512 | GTCN_5178 | 55571 |
| TTCN_3917 | 41513 | CTCN_9648 | 55572 |

232782404 v1

COMPOSITIONS AND METHODS FOR USE IN IMMUNOTHERAPY

CROSS REFERENCE TO RELATED APPLICATIONS

This application is a U.S. National Stage Application, filed under 35 U.S.C. § 371, of International Application No. PCT/US2020/050008, filed Sep. 9, 2020, which claims priority to U.S. provisional patent application Nos. 62/897,947, filed on Sep. 9, 2019, and 63/075,041 filed on Sep. 4, 2020, the contents of each of which are incorporated herein by reference in their entireties.

DESCRIPTION OF THE TEXT FILE SUBMITTED ELECTRONICALLY

The contents of the text file submitted electronically herewith are incorporated herein by reference in their entirety: A computer readable format copy of the Sequence Listing (filename: SCRB 016 02US SeqList ST25.txt, date recorded: Mar. 8, 2022, file size 12.0 megabytes).

BACKGROUND

Many approved therapeutics, for example cancer therapeutics, are cytotoxic drugs that kill normal cells as well as diseased cells. The therapeutic benefit of these cytotoxic drugs depends on diseased cells being more sensitive than normal cells, thereby allowing clinical responses to be achieved using doses that do not result in unacceptable side effects. However, essentially all of these non-specific drugs result in some if not severe damage to normal tissues, which often limits treatment suitability.

Genome engineering can offer a different approach to cytotoxic drugs in that it permits the creation of immune cells programmed to specifically bind and kill diseased cells, for example cancer cells. The advent of the chimeric antigen receptor T cell (CAR-T) technology has led to new modalities of therapeutic benefit in certain types of cancers. By engineering cells comprising CAR to reduce a mismatch in the HLA protein, reduce or eliminate the wild-type T cell receptor or other component of the modified cell, in comparison to those of the recipient subject, it reduces or eliminates the potential for host vs. graft disease (GVHD) by eliminating host T cell receptor recognition of and response to mismatched (e.g., allogeneic) graft tissue (see, e.g., Takahiro Kamiya, T. et al. A novel method to generate T-cell receptor-deficient chimeric antigen receptor T cells. Blood Advances 2:517 (2018)). This approach, therefore, could be used to generate immune cells with an improved therapeutic index for immuno-oncologic applications in a subject with a disease such as cancer, autoimmune disease and transplant rejection.

As CRISPR/Cas systems have been adapted for genome editing in eukaryotic cells, the two technologies have the potential to permit the engineering of immune cells that have potent cytotoxicity versus the targeted cells, yet permit the reduction or elimination of cell markers that contribute to triggering unwanted recipient immune responses to transplants of such cells, especially in the case of allogeneic transplants of these cells. Accordingly, there exists a need for modified cells and methods to modify such cells into engineered CAR-T cells that exhibit these properties for use in immunotherapy treatment, for example allogeneic-based immunotherapy treatments.

SUMMARY

In some aspects, the present disclosure provides compositions of CasX:guide nucleic acid systems (CasX:gNA system) and methods used to modify target nucleic acid sequences of cell genes encoding one or more proteins involved in antigen processing, antigen presentation, antigen recognition, and/or antigen response. In the foregoing, the proteins are selected from the group consisting of beta-2-microglobulin (B2M), T cell receptor alpha chain constant region (TRAC, or TCRA), class II major histocompatibility complex transactivator (CIITA), T cell receptor beta constant 1 (TRBC1, or TCRB), T cell receptor beta constant 2 (TRBC2), programmed cell death 1 (PD-1), cytokine inducible SH2 (CISH), T cell immunoreceptor with Ig and ITIM domains (TIGIT), adenosine A2a receptor (ADORA2A), killer cell lectin like receptor C1 (NKG2A), cytotoxic T-lymphocyte-associated protein 4 (CTLA-4), lymphocyte activating 3 (LAG-3), T-cell immunoglobulin and mucin domain 3 (TIM-3), 2B4 (CD244), human leukocyte antigen A (HLA-A), human leukocyte antigen B (HLA-B), TGFβ Receptor 2 (TGFβRII), cluster of differentiation 247 (CD247), CD3d molecule (CD3D), CD3e molecule (CD3E), CD3g molecule (CD3G), CD52 molecule (CD52), human leukocyte antigen C (HLA-C), deoxycytidine kinase (dCK), or FKBP prolyl isomerase 1A (FKBP1A). The CasX:gNA systems can comprise a reference CasX protein, a CasX variant protein with improved properties relative to the reference CasX, a guide nucleic acid (gNA) that is a reference sequence or a gNA variant with improved properties relative to the reference sequence, as well as donor template nucleic acids that can be inserted into the break sites of the target nucleic acid sequences in cells introduced by the CasX nucleases to modify the target nucleic acid sequences. Embodiments of these components are described herein, below. In some aspects, the present disclosure provides gene editing pairs of CasX and gNA as of any of the embodiments described herein complexed as a ribonuclear protein complex (RNP). In some embodiments, the present disclosure provides methods to modify the genes of cells encoding the proteins involved in antigen processing, antigen presentation, antigen recognition, and/or antigen response in which the gene are knocked-down or knocked out from expression of such proteins.

The cells modified by the CasX:gNA systems are useful for, among other things, immunotherapy applications; e.g. preparation and use of immune cells with reduced potential for graft-versus-host disease (GVHD), and that are also modified to express one or more chimeric antigen receptor (CAR) for use in the treatment of cancer or an autoimmune disease in a subject. Such cells also are also engineered to reduce host vs. graft complications. In other embodiments, the CasX-gNA systems are used to knock-in nucleic acids into the cells that encode CAR and/or an engineered T cell receptor (TCR), the CAR and/or the TCR comprising binding domains specific for tumor cell antigens, including those listed herein, below. Such binding domains can be in the form of a linear antibody, a single domain antibody (sdAb) such as a VHH, or a single-chain variable fragment (scFv). The cells that can be used for the preparation of the modified cells include progenitor cells, hematopoietic stem cells, pluripotent stem cells, or immune cells selected from the group consisting of T cells, TREG cells, NK cells, B cells, macrophages, or dendritic cells.

In some aspects, the present disclosure provides polynucleotides and vectors encoding or comprising the CasX proteins, gNAs, the gene editing pairs, or comprising the donor template nucleic acids described herein. In some embodiments, the vectors are viral vectors such as an Adeno-Associated Viral (AAV) vector or a lentiviral vector. In other embodiments, the vectors are non-viral particles such as virus-like particles (VLP) or nanoparticles.

In some aspects, the disclosure provides methods of modifying a target nucleic acid sequence of in a population of cells, comprising introducing into each cell of the population: a) the CasX:gNA system of any of the embodiments disclosed herein; or b) the nucleic acid of any of the embodiments disclosed herein; or c) the vector of any of the embodiments disclosed herein; d) the VLP of any of the embodiments disclosed herein; or e) combinations of two or more of (a)-(d)), above, wherein the target nucleic acid sequence of the cells is modified by the CasX protein (e.g., a single- or double-stranded break, or an insertion, deletion, substitution, duplication, or inversion of one or more nucleotides in the target nucleic acid sequence).

In some aspects, the present disclosure provides populations of cells modified by the ex vivo methods of modification of the target nucleic acid by the CasX:gNA systems, vectors, or VLPs (or combinations thereof) of any of the embodiments described herein, wherein the expression of MHC Class I molecules or T cell receptors or the proteins involved in antigen processing, antigen presentation, antigen recognition, and/or antigen response have been reduced or eliminated in the modified cells. In some embodiments, the present disclosure provides populations of cells modified by the ex vivo methods of modification of the target nucleic acid by the CasX:gNA systems, vectors, or VLPs (or combinations thereof) of any of the embodiments described herein, wherein the modified cells express a detectable level of the CAR and/or TCR of any of the embodiments described herein.

In some aspects, the present disclosure provides methods of providing an anti-tumor immunity in a subject, the method comprising administering to the subject a therapeutically effective amount of the modified cells of any of the embodiments described herein.

In some aspects, the present disclosure provides methods of treating a subject having a disease associated with expression of a tumor antigen, the method comprising administering to the subject a therapeutically effective amount of the modified cells of any one of embodiments described herein.

In another aspect, provided herein are compositions of immune cells modified by CasX and gNA gene editing pairs and, optionally, donor templates and/or polynucleotides encoding CAR and/or TCR for use as a medicament for the treatment of a subject having a disease associated with expression of a tumor antigen. In the foregoing, the CasX can be a CasX variant of any of the embodiments described herein (e.g., the sequences of Table 4) and the gNA can be a gNA variant of any of the embodiments described herein (e.g., the sequences of Table 2). In other embodiments, the disclosure provides compositions cells modified by vectors comprising or encoding the gene editing pairs of CasX and gNA, donor templates and/or polynucleotides encoding CAR for use as a medicament for the treatment of a subject having a disease associated with expression of a tumor antigen.

In some aspects, the present disclosure provides kits comprising the CasX:gNA systems, the vectors, or the VLP described herein, and further comprising an excipient and a container.

In another aspect, provided herein are CasX:gNA systems, compositions comprising CasX:gNA systems, vectors comprising or encoding CasX:gNA systems, VLP comprising CasX:gNA systems, or populations of cells edited using the CasX:gNA systems, for use as a medicament for the treatment of a disease or disorder.

In another aspect, provided herein are CasX:gNA systems, composition comprising g CasX:gNA systems, or vectors comprising or encoding CasX:gNA systems, VLP comprising CasX:gNA systems, populations of cells edited using the CasX:gNA systems, for use in a method of treatment of a disease or disorder.

INCORPORATION BY REFERENCE

All publications, patents, and patent applications mentioned in this specification are herein incorporated by reference to the same extent as if each individual publication, patent, or patent application was specifically and individually indicated to be incorporated by reference. The contents of PCT/US2020/036505, filed on Jun. 5, 2020, which discloses CasX variants and gNA variants, are hereby incorporated by reference in their entirety.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 2 shows the improvement in editing efficiency of a CasX sgRNA variant of SEQ ID NO:5 versus the reference of SEQ ID NO:4 across 10 targets. When averaged across 10 targets, the editing efficiency of sgRNA SEQ ID NO:5 improved 176% compared to SEQ ID NO:4.

FIG. 35 shows Table 3A, a table of gNA targeting sequences (spacers) targeting the B2Mgene (SEQ ID NOs: 725-2100 and 2281-7085).

FIG. 36 shows Table 3B, a table of gNA targeting sequences (spacers) targeting the TRAC gene (SEQ ID NOs: 7086-27454).

FIG. 37 shows Table 3C, a table of gNA targeting sequences (spacers) targeting the CIITA gene (SEQ ID NOs: 27455-55572).

DETAILED DESCRIPTION

Figure 1:
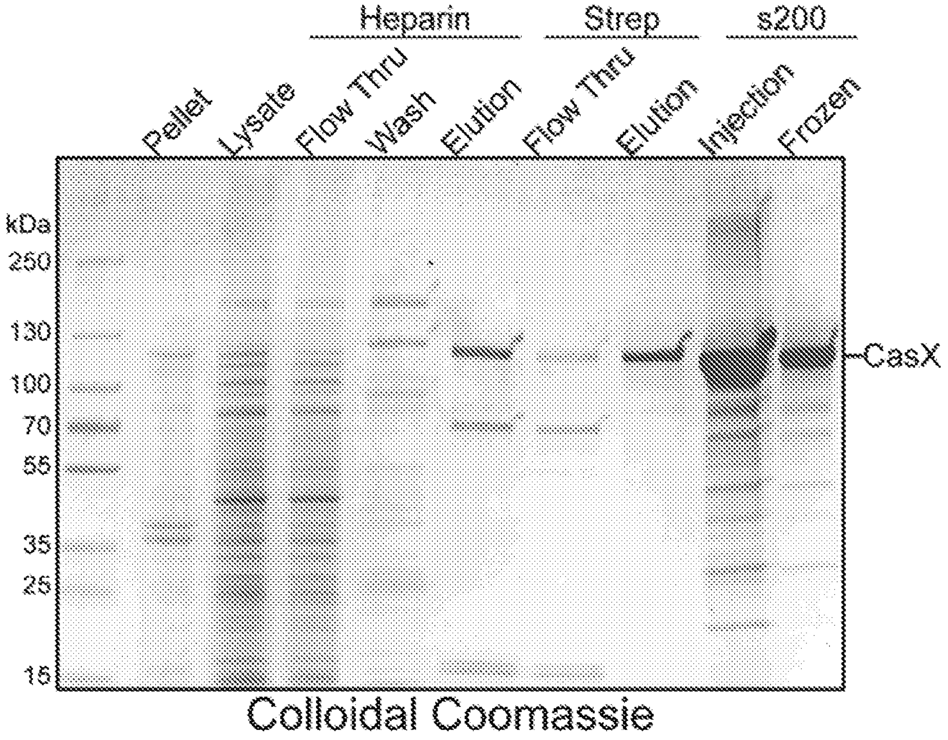
FIG. 1 shows an SDS-PAGE gel of StX2 purification fractions visualized by colloidal Coomassie staining, as described in Example 1.

While exemplary embodiments have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. In case of conflict, the patent specification, including definitions, will control. In addition, the materials, methods, and examples are illustrative only and not intended to be limiting. Numerous variations, changes, and substitutions will now occur to those skilled in the art without departing from the invention.

Definitions

The terms "polynucleotide" and "nucleic acid," used interchangeably herein, refer to a polymeric form of nucleotides of any length, either ribonucleotides or deoxyribonucleotides. Thus, terms "polynucleotide" and "nucleic acid" encompass single-stranded DNA; double-stranded DNA; multi-stranded DNA; single-stranded RNA; double-stranded RNA; multi-stranded RNA; genomic DNA; cDNA; DNA-RNA hybrids; and a polymer comprising purine and pyrimidine bases or other natural, chemically or biochemically modified, non-natural, or derivatized nucleotide bases.

"Hybridizable" or "complementary" are used interchangeably to mean that a nucleic acid (e.g., RNA, DNA) comprises a sequence of nucleotides that enables it to non-covalently bind, i.e., form Watson-Crick base pairs and/or G/U base pairs, "anneal", or "hybridize," to another nucleic acid in a sequence-specific, antiparallel, manner (i.e., a nucleic acid specifically binds to a complementary nucleic acid) under the appropriate in vitro and/or in vivo conditions of temperature and solution ionic strength. It is understood that the sequence of a polynucleotide need not be 100% complementary to that of its target nucleic acid sequence to be specifically hybridizable; it can have at least about 70%, at least about 80%, or at least about 90%, or at least about 95% sequence identity and still hybridize to the target nucleic acid sequence. Moreover, a polynucleotide may hybridize over one or more segments such that intervening or adjacent segments are not involved in the hybridization event (e.g., a loop structure or hairpin structure, a 'bulge', and the like).

A "gene," for the purposes of the present disclosure, includes a DNA region encoding a gene product (e.g., a protein, RNA), as well as all DNA regions which regulate the production of the gene product, whether or not such regulatory sequences are adjacent to coding and/or transcribed sequences. Accordingly, a gene may include regulatory element sequences including, but not necessarily limited to, promoter sequences, terminators, translational regulatory sequences such as ribosome binding sites and internal ribosome entry sites, enhancers, silencers, insulators, boundary elements, replication origins, matrix attachment sites and locus control regions. Coding sequences encode a gene product upon transcription or transcription and translation; the coding sequences of the disclosure may comprise fragments and need not contain a full-length open reading frame. A gene can include both the strand that is transcribed, e.g. the strand containing the coding sequence, as well as the complementary strand.

The term "downstream" refers to a nucleotide sequence that is located 3' to a reference nucleotide sequence. In certain embodiments, downstream nucleotide sequences relate to sequences that follow the starting point of transcription. For example, the translation initiation codon of a gene is located downstream of the start site of transcription.

The term "upstream" refers to a nucleotide sequence that is located 5' to a reference nucleotide sequence. In certain embodiments, upstream nucleotide sequences relate to sequences that are located on the 5' side of a coding region or starting point of transcription. For example, most promoters are located upstream of the start site of transcription.

The term "regulatory element" is used interchangeably herein with the term "regulatory sequence," and is intended to include promoters, enhancers, and other expression regulatory elements (e.g. transcription termination signals, such as polyadenylation signals and poly-U sequences). Exemplary regulatory elements include a transcription promoter such as, but not limited to, CMV, CMV+intron A, SV40, RSV, HIV-Ltr, elongation factor 1 alpha (EF1$\alpha$), MMLV-ltr, internal ribosome entry site (IRES) or P2A peptide to permit translation of multiple genes from a single transcript, metallothionein, a transcription enhancer element, a transcription termination signal, polyadenylation sequences, sequences for optimization of initiation of translation, and translation termination sequences. It will be understood that the choice of the appropriate regulatory element will depend on the encoded component to be expressed (e.g., protein or RNA) or whether the nucleic acid comprises multiple components that require different polymerases or are not intended to be expressed as a fusion protein.

The term "promoter" refers to a DNA sequence that contains an RNA polymerase binding site, transcription start site, TATA box, and/or B recognition element and assists or promotes the transcription and expression of an associated transcribable polynucleotide sequence and/or gene (or transgene). A promoter can be synthetically produced or can be derived from a known or naturally occurring promoter sequence or another promoter sequence. A promoter can be proximal or distal to the gene to be transcribed. A promoter can also include a chimeric promoter comprising a combination of two or more heterologous sequences to confer certain properties. A promoter of the present disclosure can include variants of promoter sequences that are similar in composition, but not identical to, other promoter sequence(s) known or provided herein. A promoter can be classified according to criteria relating to the pattern of expression of an associated coding or transcribable sequence or gene operably linked to the promoter, such as constitutive, developmental, tissue-specific, inducible, etc.

The term "enhancer" refers to regulatory DNA sequences that, when bound by specific proteins called transcription factors, regulate the expression of an associated gene. Enhancers may be located in the intron of the gene, or 5' or 3' of the coding sequence of the gene. Enhancers may be proximal to the gene (i.e., within a few tens or hundreds of base pairs (bp) of the promoter), or may be located distal to the gene (i.e., thousands of bp, hundreds of thousands of bp, or even millions of bp away from the promoter). A single gene may be regulated by more than one enhancer, all of which are envisaged as within the scope of the instant disclosure.

"Recombinant," as used herein, means that a particular nucleic acid (DNA or RNA) is the product of various combinations of cloning, restriction, and/or ligation steps resulting in a construct having a structural coding or non-coding sequence distinguishable from endogenous nucleic acids found in natural systems. Generally, DNA sequences encoding the structural coding sequence can be assembled from cDNA fragments and short oligonucleotide linkers, or from a series of synthetic oligonucleotides, to provide a synthetic nucleic acid which is capable of being expressed from a recombinant transcriptional unit contained in a cell or in a cell-free transcription and translation system. Such sequences can be provided in the form of an open reading frame uninterrupted by internal non-translated sequences, or introns, which are typically present in eukaryotic genes. Genomic DNA comprising the relevant sequences can also be used in the formation of a recombinant gene or transcriptional unit. Sequences of non-translated DNA may be present 5' or 3' from the open reading frame, where such sequences do not interfere with manipulation or expression of the coding regions, and may indeed act to modulate production of a desired product by various mechanisms (see "enhancers" and "promoters", above).

The term "recombinant polynucleotide" or "recombinant nucleic acid" refers to one which is not naturally occurring, e.g., is made by the artificial combination of two otherwise separated segments of sequence through human intervention. This artificial combination is often accomplished by either chemical synthesis means, or by the artificial manipulation of isolated segments of nucleic acids, e.g., by genetic engineering techniques. Such is usually done to replace a codon with a redundant codon encoding the same or a conservative amino acid, while typically introducing or removing a sequence recognition site. Alternatively, it is performed to join together nucleic acid segments of desired functions to generate a desired combination of functions. This artificial combination is often accomplished by either chemical synthesis means, or by the artificial manipulation of isolated segments of nucleic acids, e.g., by genetic engineering techniques.

Similarly, the term "recombinant" polypeptide refers to a polypeptide which is not naturally occurring, e.g., is made by the artificial combination of two otherwise separated segments of amino sequence through human intervention. Thus, e.g., a polypeptide that comprises a heterologous amino acid sequence is recombinant.

As used herein, the term "contacting" means establishing a physical connection between two or more entities. For example, contacting a target nucleic acid sequence with a guide nucleic acid means that the target nucleic acid sequence and the guide nucleic acid are made to share a physical connection; e.g., can hybridize if the sequences share sequence similarity.

"Dissociation constant", or "$K_d$", are used interchangeably and mean the affinity between a ligand "L" and a protein "P"; i.e., how tightly a ligand binds to a particular protein. It can be calculated using the formula $K_d$=[L][P]/[LP], where [P], [L] and [LP] represent molar concentrations of the protein, ligand and complex, respectively.

The term "knock-out" refers to the elimination of a gene or the expression of a gene. For example, a gene can be knocked out by either a deletion or an addition of a nucleotide sequence that leads to a disruption of the reading frame. As another example, a gene may be knocked out by replacing a part of the gene with an irrelevant sequence. The term "knock-down" as used herein refers to reduction in the expression of a gene or its gene product(s). As a result of a gene knock-down, the protein activity or function may be attenuated or the protein levels may be reduced or eliminated.

As used herein, "homology-directed repair" (HDR) refers to the form of DNA repair that takes place during repair of double-strand breaks in cells. This process requires nucleotide sequence homology, and uses a donor template to repair or knock-out a target DNA, and leads to the transfer of genetic information from the donor to the target. Homology-directed repair can result in an alteration of the sequence of the target sequence by insertion, deletion, or mutation if the donor template differs from the target DNA sequence and part or all of the sequence of the donor template is incorporated into the target DNA.

As used herein, "non-homologous end joining" (NHEJ) refers to the repair of double-strand breaks in DNA by direct ligation of the break ends to one another without the need for a homologous template (in contrast to homology-directed repair, which requires a homologous sequence to guide repair). NHEJ often results in the loss (deletion) of nucleotide sequence near the site of the double-strand break.

As used herein "micro-homology mediated end joining" (MMEJ) refers to a mutagenic DSB repair mechanism, which always associates with deletions flanking the break sites without the need for a homologous template (in contrast to homology-directed repair, which requires a homologous sequence to guide repair). MMEJ often results in the loss (deletion) of nucleotide sequence near the site of the double-strand break.

A polynucleotide or polypeptide has a certain percent "sequence similarity" or "sequence identity" to another polynucleotide or polypeptide, meaning that, when aligned, that percentage of bases or amino acids are the same, and in the same relative position, when comparing the two sequences. Sequence similarity (sometimes referred to as percent similarity, percent identity, or homology) can be determined in a number of different manners. To determine sequence similarity, sequences can be aligned using the methods and computer programs that are known in the art, including BLAST, available over the world wide web at ncbi.nlm.nih.gov/BLAST. Percent complementarity between particular stretches of nucleic acid sequences within nucleic acids can be determined using any convenient method. Example methods include BLAST programs (basic local alignment search tools) and PowerBLAST programs (Altschul et al., J. Mol. Biol., 1990, 215, 403-410; Zhang and Madden, Genome Res., 1997, 7, 649-656) or by using the Gap program (Wisconsin Sequence Analysis Package, Version 8 for Unix, Genetics Computer Group, University Research Park, Madison Wis.), e.g., using default settings, which uses the algorithm of Smith and Waterman (Adv. Appl. Math., 1981, 2, 482-489).

The terms "polypeptide," and "protein" are used interchangeably herein, and refer to a polymeric form of amino acids of any length, which can include coded and non-coded amino acids, chemically or biochemically modified or derivatized amino acids, and polypeptides having modified peptide backbones. The term includes fusion proteins, including, but not limited to, fusion proteins with a heterologous amino acid sequence.

A "vector" or "expression vector" is a replicon, such as plasmid, phage, virus, or cosmid, to which another DNA segment, i.e., an "insert", may be attached so as to bring about the replication or expression of the attached segment in a cell.

The term "naturally-occurring" or "unmodified" or "wild type" as used herein as applied to a nucleic acid, a polypeptide, a cell, or an organism, refers to a nucleic acid, polypeptide, cell, or organism that is found in nature.

As used herein, a "mutation" refers to an insertion, deletion, substitution, duplication, or inversion of one or more amino acids or nucleotides as compared to a reference amino acid sequence or to a reference nucleotide sequence.

As used herein the term "isolated" is meant to describe a polynucleotide, a polypeptide, or a cell that is in an environment different from that in which the polynucleotide, the polypeptide, or the cell naturally occurs. An isolated genetically modified host cell may be present in a mixed population of genetically modified host cells.

A "host cell," as used herein, denotes a eukaryotic cell, a prokaryotic cell, or a cell from a multicellular organism (e.g., in a cell line), which eukaryotic or prokaryotic cells are used as recipients for a nucleic acid (e.g., an expression vector), and include the progeny of the original cell which has been genetically modified by the nucleic acid. It is understood that the progeny of a single cell may not necessarily be completely identical in morphology or in genomic or total DNA complement as the original parent, due to natural, accidental, or deliberate mutation. A "recombinant host cell" (also referred to as a "genetically modified host cell") is a host cell into which has been introduced a heterologous nucleic acid, e.g., an expression vector.

The term "conservative amino acid substitution" refers to the interchangeability in proteins of amino acid residues having similar side chains. For example, a group of amino acids having aliphatic side chains consists of glycine, alanine, valine, leucine, and isoleucine; a group of amino acids having aliphatic-hydroxyl side chains consists of serine and threonine; a group of amino acids having amide-containing side chains consists of asparagine and glutamine; a group of amino acids having aromatic side chains consists of phenylalanine, tyrosine, and tryptophan; a group of amino acids having basic side chains consists of lysine, arginine, and histidine; and a group of amino acids having sulfur-containing side chains consists of cysteine and methionine. Exemplary conservative amino acid substitution groups are: valine-leucine-isoleucine, phenylalanine-tyrosine, lysine-arginine, alanine-valine, and asparagine-glutamine.

The term "Chimeric Antigen Receptor" or a "CAR" comprises at least two domains, which when expressed in a cell, provides the cell with specificity for a target antigen, or a target cell bearing a target antigen, typically a diseased cell bearing a specific disease-related antigen. In some embodiments, a CAR comprises at least an extracellular antigen binding domain (e.g., a scFv with binding specificity to the protein involved in a disease (e.g. cancer), a transmembrane domain and a cytoplasmic signaling domain (also referred to herein as "an intracellular signaling domain") comprising a functional signaling domain derived from one or more stimulatory and/or costimulatory molecules as provided below. In some aspects, the set of polypeptides are contiguous with each other. The portion of the CAR of the disclosure comprising antigen binding domain thereof may exist in a variety of forms where the antigen binding domain is expressed as part of a contiguous polypeptide chain including, for example, a single domain antibody fragment (sdAb), a single chain antibody (scFv), a humanized antibody or bispecific antibody (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, N.Y.; Houston et al., 1988, Proc. Natl. Acad. Sci. USA 85:5879-5883; Bird et al., 1988, Science 242:423-426), and may further comprise hinge regions, for example of an immunoglobulin molecule, and spacers, that provide flexibility to the receptor. The hinge, spacer, and transmembrane domains connect the scFv to the activation domains and anchor the CAR in the T-cell membrane. In some embodiments, the CAR composition of the disclosure comprises an antigen binding domain. In a further embodiments, the CAR comprises an antibody fragment that comprises a scFv. The precise amino acid sequence boundaries of a given CDR can be determined using any of a number of well-known schemes, including those described by Kabat et al. (1991), "Sequences of Proteins of Immunological Interest," 5th Ed. Public Health Service, National Institutes of Health, Bethesda, Md. ("Kabat" numbering scheme), Al-Lazikani et al., (1997) JMB 273, 927-948 ("Chothia" numbering scheme), or a combination thereof.

The term "T cell receptor (TCR)" refers to a protein complex found on the surface of T cells that is responsible for recognizing peptide antigens bound to major histocompatibility complex (MHC) molecules. The TCR is composed of multiple subunits, including a TCR alpha and TCR beta chain (encoded by TRAC, or TCRA, and TBRC1, or TCRB, respectively) and within these chains are complementary determining regions (CDRs) which determine the antigen to which the TCR will bind. Additional subunits include CD-epsilon (CD3E), CD3-delta (CD3D), CD3-gamma (CD3G) and CD3-zeta (CD3Z). The extracellular domains of the TCR alpha and TCR beta subunits form the antigen binding site of the native TCR. The CDRs of the extracellular domains of the TCR are the antigen binding sections and a diverse recognition capability leads to efficient protection against foreign antigens or disease cells and the generation of optimal immune responses. Once the TCR is properly engaged with the antigen, conformational changes in the associated CD3 chains are induced that initiates, with other factors, the signaling process and T cell activation.

As used herein, an "engineered TCR" refers to a TCR which has been engineered to include an antigen binding domain with specificity for a target antigen, or a target cell bearing a target antigen, typically a diseased cell bearing a specific disease-related antigen. For example, an engineered TCR may include an antigen binding domain fused to either the TCR alpha or TCR beta subunits of the TCR, or a combination of thereof. Any antigen binding domain, including, for example, a single domain antibody fragment (sdAb), a single chain antibody (scFv), a humanized antibody or bispecific antibody may be used with the engineered TCRs described herein. In addition to the subunit or subunits fused to the antigen binding domain, engineered TCRs may also include wild type subunits that are encoded by the genome of the cell. For example, an engineered TCR may include an antigen binding domain fused to either the TCR alpha or TCR beta subunits of the TCR, as well as wild type CD3-delta, CD3-gamma, CD3-epsilon and CD3-zeta subunits.

"Signaling domain" refers to the functional portion of a protein that acts by transmitting information within the cell to regulate cellular activity via defined signaling pathways by generating second messengers or functioning as effectors by responding to such messengers.

An "intracellular signaling domain" refers to an intracellular portion of a molecule and, as used herein, is a component of the CAR. Examples of T cell-derived signaling domains are derived from polypeptides selected from the group consisting of CD247 molecule (CD3-zeta, or CD3Z), CD27 molecule (CD27), CD28 molecule (CD28), TNF receptor superfamily member 9 (4-1BB, or 41BB), inducible T cell costimulator (ICOS), TNF receptor superfamily member 4 (OX40), or a combination thereof. The intracellular signaling domain generates a signal that promotes an immune effector function of the CAR containing cell, e.g., a CAR-T cell. Examples of immune effector function, e.g., in a CAR-T cell, include cytolytic activity and helper activity, including the secretion of cytokines. An intracellular signaling domain can comprise a signaling motif which is known as an immunoreceptor tyrosine-based activation motif or ITAM. Examples of ITAM containing primary cytoplasmic signaling sequences include, but are not limited to, those derived from CD3zeta, Fc fragment of IgE receptor Ig (common FcR gamma, or FCER1G), Fc fragment of IgG receptor IIa (Fc gamma RIIa, or FCGR2A), Fc receptor gamma RIIB, CD3g molecule (CD3 gamma, or CD3G), CD3d molecule (CD3 delta, or CD3D), CD3e molecule (CD3 epsilon, or CD3E), CD79a, CD79b, DAP10, and DAP12.

The term "zeta" or alternatively "zeta chain", "CD3-zeta" or "TCR-zeta" is defined as the protein provided as GenBan Acc. No. BAG36664.1, or the equivalent residues from a non-human species, e.g., mouse, rodent, or non-human primate, and a "zeta stimulatory domain" or alternatively a "CD3-zeta stimulatory domain" or a "TCR-zeta stimulatory domain" is defined as the amino acid residues from the cytoplasmic domain of the zeta chain, or functional derivatives thereof, that are sufficient to functionally transmit an initial signal necessary for T cell activation. In some embodiments, the cytoplasmic domain of zeta comprises residues 52 through 164 of GenBank Acc. No. BAG36664.1 or the equivalent residues from a non-human species that are functional orthologs thereof.

"Protein involved in antigen processing, antigen presentation, antigen recognition, and/or antigen response" as used herein, refers to extracellular, transmembrane and intracellular proteins or glycoproteins involved in antigen processing, presentation, recognition, and/or response. In some cases, the protein or glycoprotein is expressed on the surface of cells and can conveniently serve as a marker of a specific cell type. For example, T cell and B cell surface proteins identify their lineage and stage in the differentiation process. In some cases, protein involved in antigen processing, antigen presentation, antigen recognition, and/or antigen response is a receptor that has binding affinity for a ligand.

A "tumor antigen" is expressed on the surface of a cancer cell, either entirely or as a fragment (e.g., an MHC peptide), and which is useful for the preferential targeting of an immune cell to the cancer cell. In some embodiments, a tumor antigen is a marker expressed by both normal cells and cancer cells, e.g., CD19 on B cells. In some embodiments, a tumor antigen is a cell surface molecule that is overexpressed in a cancer cell in comparison to a normal cell.

The term "antibody," as used herein, encompasses various antibody structures, including but not limited to monoclonal antibodies, polyclonal antibodies, multispecific antibodies (e.g., bispecific antibodies), nanobodies, single domain antibodies such as VHH antibodies, and antibody fragments so long as they exhibit the desired antigen-binding activity or immunological activity. Antibodies represent a large family of molecules that include several types of molecules, such as IgD, IgG, IgA, IgM and IgE.

A "humanized" antibody refers to a antibody comprising amino acid residues from non-human complementarity-determining regions (CDRs) and amino acid residues from human framework regions (FRs). Typically, a humanized antibody will comprise substantially all of the variable domains in which all or substantially all of the CDRs correspond to those of a non-human antibody (which may include amino acid substitutions), and all or substantially all of the FRs correspond to those of a human antibody.

The term "monoclonal antibody" as used herein refers to an antibody obtained from a population of substantially homogeneous antibodies wherein the population are identical and/or bind the same epitope. Thus, the modifier "monoclonal" indicates the character of the antibody as being obtained from a substantially homogeneous population of antibodies, and is not to be construed as requiring production of the antibody by any particular method.

An "antigen binding domain" as used herein refers to immunologically active portions of a molecule that contains an antigen-binding site which specifically binds ("immunoreacts with") an antigen. An antigen binding domain "specifically binds to" or is "specific for" an antigen if it binds with greater affinity or avidity than it binds to other reference antigens including polypeptides or other substances. Examples of proteins that comprise antigen binding domains include but are not limited to Fv, Fab, Fab', Fab'-SH, F(ab')2, diabodies, linear antibodies (see, U.S. Pat. No. 5,641,870), a single domain antibody, a single domain camelid antibody, single-chain fragment variable (scFv) antibody molecules, or any polypeptide chain-containing molecular structure that has a specific shape which fits to and recognizes and binds to an epitope.

"scFv" or "single chain fragment variable" are used interchangeably herein to refer to an antibody fragment format comprising variable regions of heavy ("VH") and light ("VL") chains or two copies of a VH or VL chain of an antibody, which are joined together by a short flexible peptide linker which enables the scFv to form the desired structure for antigen binding. The scFv is a fusion protein of the variable regions of the heavy (VH) and light chains (VL) of immunoglobulins each comprising complementarity-determining regions (CDRs), which can be in either order; VH-VL or VL-VH and are usually joined by linkers.

The term "4-1BB" refers to a member of the TNF-R superfamily having an amino acid sequence provided as GenBank Acc. No. AAA62478.2, or the equivalent residues from a non-human species; and a "4-1BB costimulatory domain" is defined as amino acid residues 214-255 of GenBank Acc. No. AAA62478.2, or the equivalent residues from a non-human species.

"Immune effector cell" refers to a cell that is involved in an immune response, e.g., in the promotion of an immune effector response. Examples of immune effector cells include T cells, such as helper T cells and cytotoxic T cells, gamma-delta T cells, tumor infiltrating lymphocytes, NK cells, B cells, monocytes, macrophages, or dendritic cells.

"Immune effector function" or "immune effector response," refers to function or response, e.g., of an immune effector cell, that enhances or promotes an immune attack of a target cell. In the context of the present disclosure, an immune effector function or response refers a property of a T or NK cell that promotes killing or the inhibition of growth or proliferation of a target cell.

As used herein, "treatment" or "treating," are used interchangeably herein and refer to an approach for obtaining beneficial or desired results, including but not limited to a therapeutic benefit and/or a prophylactic benefit. By therapeutic benefit is meant eradication or amelioration of the underlying disorder or disease being treated. A therapeutic benefit can also be achieved with the eradication or amelioration of one or more of the symptoms or an improvement in one or more clinical parameters associated with the underlying disease such that an improvement is observed in the subject, notwithstanding that the subject may still be afflicted with the underlying disorder.

The terms "therapeutically effective amount" and "therapeutically effective dose", as used herein, refer to an amount of a drug or a biologic, alone or as a part of a composition, that is capable of having any detectable, beneficial effect on any symptom, aspect, measured parameter or characteristics of a disease state or condition when administered in one or repeated doses to a subject such as a human or an experimental animal. Such effect need not be absolute to be beneficial.

As used herein, "administering" is meant a method of giving a dosage of a compound (e.g., a composition of the disclosure) or a composition (e.g., a pharmaceutical composition) to a subject.

A "subject" is a mammal. Mammals include, but are not limited to, domesticated animals, non-human primates, humans, rabbits, mice, rats and other rodents.

I. General Methods

The practice of the present disclosure employs, unless otherwise indicated, conventional techniques of immunology, biochemistry, chemistry, molecular biology, microbiology, cell biology, genomics and recombinant DNA, which can be found in such standard textbooks as Molecular Cloning: A Laboratory Manual, 3rd Ed. (Sambrook et al., HaRBor Laboratory Press 2001); Short Protocols in Molecular Biology, 4th Ed. (Ausubel et al. eds., John Wiley & Sons 1999); Protein Methods (Bollag et al., John Wiley & Sons 1996); Nonviral Vectors for Gene Therapy (Wagner et al. eds., Academic Press 1999); Viral Vectors (Kaplift & Loewy eds., Academic Press 1995); Immunology Methods Manual (I. Lefkovits ed., Academic Press 1997); and Cell and Tissue Culture: Laboratory Procedures in Biotechnology (Doyle & Griffiths, John Wiley & Sons 1998), the disclosures of which are incorporated herein by reference.

Where a range of values is provided, it is understood that endpoints are included, and that each intervening value, to the tenth of the unit of the lower limit unless the context clearly dictates otherwise, between the upper and lower limit of that range and any other stated or intervening value in that stated range, is encompassed. The upper and lower limits of these smaller ranges may independently be included in the smaller ranges, and are also encompassed, subject to any specifically excluded limit in the stated range. Where the stated range includes one or both of the limits, ranges excluding either or both of those included limits are also included.

Unless defined otherwise, all technical and scientific terms used herein have the same meaning as commonly understood by one of ordinary skill in the art to which this invention belongs. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise.

It will be appreciated that certain features of the invention, which are, for clarity, described in the context of separate embodiments, may also be provided in combination in a single embodiment. In other cases, various features of the invention, which are, for brevity, described in the context of a single embodiment, may also be provided separately or in any suitable sub-combination. It is intended that all combinations of the embodiments pertaining to the invention are specifically embraced by the present invention and are disclosed herein just as if each and every combination was individually and explicitly disclosed. In addition, all sub-combinations of the various embodiments and elements thereof are also specifically embraced by the present invention and are disclosed herein just as if each and every such sub-combination was individually and explicitly disclosed herein.

II. Systems for Genetic Editing of Proteins involved in Antigen Processing, Presentation, Recognition, and/or Response In a first aspect, the present disclosure provides systems comprising a CRISPR nuclease and one or more guide nucleic acids (gNA) that have utility in genome editing of eukaryotic cells. In some embodiments, the CRISPR nuclease is selected from the group consisting of Cas9, Cas12a, Cas12b, Cas12c, Cas12d (CasY), CasX, Cas13a, Cas13b, Cas13c, Cas13d, CasX, CasY, Cas14, Cpfl, C2cl, Csn2, and Cas Phi. In some embodiments, the CRISPR nuclease is a is a Type V CRISPR nuclease. In some embodiments, the present disclosure provides CasX:gNA systems comprising a CasX protein and one or more guide nucleic acids (gNA) that are specifically designed to modify a target nucleic acid sequence of one or more cell genes encoding proteins involved in antigen processing, antigen presentation, antigen recognition, and/or antigen response. A gNA and a CasX protein of the disclosure can form a complex and bind via non-covalent interactions, referred to herein as a ribonucleoprotein (RNP) complex. The use of a pre-complexed CasX:gNA confers advantages in the delivery of the system components to a cell or target nucleic acid sequence for editing of the target nucleic acid sequence. In the RNP, the gNA can provide target specificity to the complex by including a targeting sequence (or "spacer") having a nucleotide sequence that is complementary to a sequence of the target nucleic acid sequence while the CasX protein of the pre-complexed CasX:gNA provides the site-specific activity that is guided to a target site (e.g., stabilized at a target site)

within a target nucleic acid sequence (e.g., a B2M or TRAC gene to be modified) by virtue of its association with the guide NA. The CasX protein of the complex provides the site-specific activities of the complex such as cleavage or nicking of the target sequence by the CasX protein and/or an activity provided by the fusion partner in the case of a chimeric CasX protein. Additionally, the present disclosure provides methods useful for modifying the target nucleic acid sequence of a populations of cells to introduce or regulate the expression of the one or more proteins involved in antigen processing, presentation, recognition and/or response using the CasX:gNA systems. Such modified populations of cells in which a protein involved in antigen processing, antigen presentation, antigen recognition, and/or antigen response have been down-regulated or eliminated are useful for immunotherapies. The CasX:gNA systems of the disclosure comprise one or more of a CasX protein, one or more guide nucleic acids (gNA) and, optionally, one or more donor template nucleic acids comprising a nucleic acid encoding a modification of a protein involved in antigen processing, antigen presentation, antigen recognition, and/or antigen response wherein the nucleic acid comprises a deletion, insertion, or mutation of one or more nucleotides in comparison to a genomic nucleic acid sequence encoding the protein or its regulatory element to knock-down/knock-out gene function. In some embodiments, the donor polynucleotide comprises at least about 10, at least about 50, at least about 100, or at least about 200, or at least about 300, or at least about 400, or at least about 500, or at least about 600, or at least about 700, or at least about 800, or at least about 900, or at least about 1000, or at least about 10,000, or at least about 15,000 nucleotides of all or a portion of a target nucleic acid sequence of a cell gene to be modified. In other embodiments, the donor polynucleotide comprises at least about 10 to about 10,000 nucleotides, or at least about 100 to about 8000 nucleotides, or at least about 400 to about 6000 nucleotides, or at least about 600 to about 4000 nucleotides, or at least about 1000 to about 2000 nucleotides of a cell gene to be modified. In some embodiments, the donor template is a single stranded DNA template or a single stranded RNA template. In other embodiments, the donor template is a double stranded DNA template.

In other embodiments, the present disclosure provides polynucleic acids encoding a chimeric antigen receptor (CAR) with binding specificity for a disease antigen, optionally a tumor cell antigen, which can be introduced into the cells to be modified, such that the modified cell is able to express the CAR in the modified cell. In other embodiments, the present disclosure provides polynucleic acids encoding an engineered T cell receptor (TCR) with binding specificity for a disease antigen, optionally a tumor cell antigen, which can be introduced into the cells to be modified, such that the modified cell is able to express the TCR in the modified cell.

The CasX:gNA systems have utility in the treatment of a subject having certain diseases or conditions, including, cancer, autoimmune diseases, and transplant rejection. Each of the components of the CasX:gNA systems and their use in the editing of the target nucleic acids in cells to modify one or more proteins involved in antigen processing, antigen presentation, antigen recognition, and/or antigen response, as well as the use of polynucleic acids encoding CAR and engineered TCR subunit or subunits, is described herein. The CasX:gNA systems and polynucleic acids described herein have utility in the creation of modified populations of cells that efficiently kill target cells associated with diseases such cancer, autoimmune diseases, and transplant rejection. Further, the modified populations of cells can be used to confer immunity in a subject having such diseases.

III. Guide Nucleic Acids of the Systems for Genetic Editing

In another aspect, the disclosure relates to a guide nucleic acid (gNA) comprising a targeting sequence complementary to a target nucleic acid sequence in the target strand of a gene encoding a protein involved in antigen processing, antigen presentation, antigen recognition, and/or antigen response, wherein the gNA is capable of forming a complex with a CRISPR protein that is specific to a protospacer adjacent motif (PAM) sequence comprising a TC motif in the complementary non-target strand, and wherein the PAM sequence is located 1 nucleotide 5' of the sequence in the non-target strand that is complementary to the target nucleic acid sequence in the target strand.

In some embodiments, present disclosure relates to guide nucleic acids (gNA) utilized in the CasX:gNA systems that have utility in genome editing of eukaryotic cells. The present disclosure provides specifically-designed guide nucleic acids ("gNAs") wherein the targeting sequence (or spacer, described more fully, below) of the gNA is complementary to (and are therefore able to hybridize with) target nucleic acid sequences when used as a component of the gene editing CasX:gNA systems. It is envisioned that in some embodiments, multiple gNAs are delivered in the CasX:gNA system for the modification of a target nucleic acid sequence. For example, when a knock-down/knock-out of a protein-encoding gene is desired, a pair of gNAs can be used in order to bind and cleave at two different sites within the gene.

The present disclosure provides specifically-designed guide nucleic acids ("gNAs") with targeting sequences that are complementary to (and are therefore able to hybridize with) the target nucleic acid as a component of the gene editing CasX:gNA systems. As described more fully, below, representative, but non-limiting examples of targeting sequences to the target nucleic acid sequence of a cell gene encoding a protein involved in antigen processing, antigen presentation, antigen recognition, and/or antigen response are presented in Tables 3A, 3B, and 3C (Tables 3A, 3B, and 3C are provided as FIGS. 35-37). It is envisioned that in some embodiments, multiple gNAs are delivered in the CasX:gNA system for the modification of the target nucleic acid sequence(s). For example, when a knock-down/knock-out of a protein-encoding gene is desired, a pair of gNAs with targeting sequences to different or overlapping regions of the target nucleic acid sequence can be used in order to bind and the CasX to cleave at two different or overlapping sites within or proximal to the gene, which is then edited by non-homologous end joining (NHEJ), homology-directed repair (HDR, which can include, for example, insertion of a donor template to replace all or a portion of the intron), homology-independent targeted integration (HITI), micro-homology mediated end joining (MMEJ), single strand annealing (SSA) or base excision repair (BER).

a. Reference gNA and gNA Variants

In some embodiments, a gNA of the present disclosure comprises a sequence of a naturally-occurring gNA (a "reference gNA"). In other cases, a reference gNA of the disclosure may be subjected to one or more mutagenesis methods, such as the mutagenesis methods described herein, which may include Deep Mutational Evolution (DME), deep mutational scanning (DMS), error prone PCR, cassette mutagenesis, random mutagenesis, staggered extension PCR, gene shuffling, or domain swapping, in order to generate one or more gNA variants with enhanced or varied properties relative to the reference gNA. gNA variants also include variants comprising one or more exogenous sequences, for example fused to either the 5' or 3' end, or inserted internally. The activity of reference gNAs may be used as a benchmark against which the activity of gNA variants are compared, thereby measuring improvements in function or other characteristics of the gNA variants. In other embodiments, a reference gNA may be subjected to one or more deliberate, targeted mutations in order to produce a gNA variant, for example a rationally designed variant. As used herein, the terms gNA, gRNA, and gDNA cover naturally-occurring molecules, as well as sequence variants. Thus, in some embodiments, the gNA is a deoxyribonucleic acid molecule ("gDNA"); in some embodiments, the gNA is a ribonucleic acid molecule ("gRNA"), and in other embodiments, the gNA is a chimera, and comprises both DNA and RNA.

The targeting sequence of a gNA is capable of binding to a target nucleic acid sequence, including a coding sequence, a complement of a coding sequence, a non-coding sequence, and to regulatory elements. The gNA scaffold (or "protein-binding sequence") interacts with (e.g., binds to) a CasX protein, forming an RNP (described more fully, below). In some embodiments, the targeting sequence and scaffold each include complementary stretches of nucleotides that hybridize to one another to form a double stranded duplex (dsRNA duplex for a dgRNA). Site-specific binding and/or cleavage of a target nucleic acid sequence (e.g., genomic DNA) by the CasX protein can occur at one or more locations (e.g., a sequence of a target nucleic acid) determined by base-pairing complementarity between the targeting sequence of the gNA and the target nucleic acid sequence. Thus, for example, the gNA of the disclosure have sequences complementarity to and therefore can hybridize to a protein involved in antigen processing, antigen presentation, antigen recognition, and/or antigen response gene and/or its regulatory sequence in a nucleic acid in a eukaryotic cell, e.g., a eukaryotic nucleic acid (e.g., a eukaryotic chromosome, chromosomal sequence, a eukaryotic RNA, etc.) that is adjacent to a sequence complementary to a TC PAM motif or a PAM sequence, such as ATC, CTC, GTC, or TTC.

In the context of nucleic acids, cleavage refers to the breakage of the covalent backbone of a nucleic acid molecule; either DNA or RNA. Cleavage can be initiated by a variety of methods including, but not limited to, enzymatic or chemical hydrolysis of a phosphodiester bond. Both single-stranded cleavage and double-stranded cleavage are possible, and double-stranded cleavage can occur as a result of two distinct single-stranded cleavage events. DNA cleavage can result in the production of either blunt ends or staggered ends.

In some embodiments, the disclosure provides gene editing pairs of a CasX and a gNA of any of the embodiments described herein that are capable of being bound together prior to their use for gene editing and, thus, are "pre-complexed" as a ribonuclear protein complex (RNP). The use of a pre-complexed RNP confers advantages in the delivery of the system components to a cell or target nucleic acid sequence for editing of the target nucleic acid sequence. The CasX protein of the RNP provides the site-specific activity that is guided to a target site (e.g., stabilized at a target site) within a target nucleic acid sequence by virtue of its association with the guide RNA comprising a targeting sequence capable of hybridizing to the target nucleic acid sequence.

In some embodiments, wherein the gNA is a gRNA, the term "targeter" or "targeter RNA" is used herein to refer to a crRNA-like molecule (crRNA: "CRISPR RNA") of a CasX dual guide RNA (and therefore of a CasX single guide RNA when the "activator" and the "targeter" are linked together, e.g., by intervening nucleotides). Thus, for example, a CasX guide RNA (dgRNA or sgRNA) comprises a guide sequence and a duplex-forming segment of a crRNA, which can also be referred to as a crRNA repeat. Because the sequence of a guide sequence hybridizes with a sequence of a target nucleic acid sequence, a targeter can be modified by a user to hybridize with a specific target nucleic acid sequence, so long as the location of the PAM sequence is considered. Thus, in some cases, the sequence of a targeter may be a non-naturally occurring sequence. In other cases, the sequence of a targeter may be a naturally-occurring sequence, derived from the gene to be edited. In the case of a dual guide RNA, the targeter and the activator each have a duplex-forming segment, where the duplex forming segment of the targeter and the duplex-forming segment of the activator have complementarity with one another and hybridize to one another to form a double stranded duplex (dsRNA duplex for a gRNA). In some embodiments, a targeter comprises both the guide sequence of the guide RNA and a stretch of nucleotides that forms one half of the dsRNA duplex of the protein-binding segment of the gRNA. A corresponding tracrRNA-like molecule (activator) also comprises a duplex-forming stretch of nucleotides that forms the other half of the dsRNA duplex of the protein-binding segment of the CasX guide RNA. Thus, a targeter and an activator, as a corresponding pair, hybridize to form a CasX dual guide NA, referred to herein as a "dual guide NA", a "dual-molecule gNA", a "dgNA", a "double-molecule guide NA", or a "two-molecule guide NA".

In some embodiments, the activator and targeter of the reference gNA are covalently linked to one another and comprise a single molecule, referred to herein as a "single-molecule gNA," "one-molecule guide NA," "single guide NA", "single guide RNA", a "single-molecule guide RNA," a "one-molecule guide RNA", a "single guide DNA", a "single-molecule DNA", or a "one-molecule guide DNA", ("sgNA", "sgRNA", or a "sgDNA"). In some embodiments, the sgNA includes an "activator" or a "targeter" and thus can be an "activator-RNA" and a "targeter-RNA," respectively.

Collectively, the gNAs of the disclosure comprise four distinct regions, or domains: the RNA triplex, the scaffold stem, the extended stem, and the targeting sequence that, in the embodiments of the disclosure are specific for a target nucleic acid. The RNA triplex, the scaffold stem, and the extended stem, together, are referred to as the "scaffold" of the gNA. In some embodiments, the targeting sequence is on the 3' end of the gNA.

b. RNA Triplex

In some embodiments of the guide NAs provided herein (including reference sgNAs), there is a RNA-triplex, and the RNA triplex comprises the sequence of a UUU--nX(~4-15)--UUU stem loop (SEQ ID NO: 19) that ends with an AAAG after 2 intervening stem loops (the scaffold stem loop and the extended stem loop), forming a pseudoknot that may also extend past the triplex into a duplex pseudoknot. The UU-UUU-AAA sequence of the triplex forms as a nexus between the spacer, scaffold stem, and extended stem. In exemplary reference CasX sgNAs, the UUU-loop-UUU region is coded for first, then the scaffold stem loop, and then the extended stem loop, which is linked by the tetraloop, and then an AAAG closes off the triplex before becoming the spacer.

c. Scaffold Stem Loop

In some embodiments of sgNAs of the disclosure, the triplex region is followed by the scaffold stem loop. The scaffold stem loop is a region of the gNA that is bound by CasX protein (such as a reference or CasX variant protein). In some embodiments, the scaffold stem loop is a fairly short and stable stem loop. In some cases, the scaffold stem loop does not tolerate many changes, and requires some form of an RNA bubble. In some embodiments, the scaffold stem is necessary for CasX sgNA function. While it is perhaps analogous to the nexus stem of Cas9 as being a critical stem loop, the scaffold stem of a CasX sgNA, in some embodiments, has a necessary bulge (RNA bubble) that is different from many other stem loops found in CRISPR/Cas systems. In some embodiments, the presence of this bulge is conserved across sgNA that interact with different CasX proteins. An exemplary sequence of a scaffold stem loop sequence of a gNA comprises the sequence CCAGCGAC-UAUGUCGUAUGG (SEQ ID NO: 20. In other embodiments, the disclosure provides gNA variants wherein the scaffold stem loop is replaced with an RNA stem loop sequence from a heterologous RNA source with proximal 5' and 3' ends, such as, but not limited to stem loop sequences selected from MS2, Q β, U1 hairpin II, Uvsx, or PP7 stem loops. In some cases, the heterologous RNA stem loop of the gNA is capable of binding a protein, an RNA structure, a DNA sequence, or a small molecule.

d. Extended Stem Loop

In some embodiments of the CasX sgNAs of the disclosure, the scaffold stem loop is followed by the extended stem loop. In some embodiments, the extended stem comprises a synthetic tracr and crRNA fusion that is largely unbound by the CasX protein. In some embodiments, the extended stem loop can be highly malleable. In some embodiments, a single guide gRNA is made with a GAAA tetraloop linker or a GAGAAA linker between the tracr and crRNA in the extended stem loop. In some cases, the targeter and activator of a CasX sgNA are linked to one another by intervening nucleotides and the linker can have a length of from 3 to 20 nucleotides. In some embodiments of the CasX sgNAs of the disclosure, the extended stem is a large 32-bp loop that sits outside of the CasX protein in the ribonucleoprotein complex. An exemplary sequence of an extended stem loop sequence of a sgNA comprises the sequence GCGC-UUAUUUAUCG-GAGAGAAAUCCGAUAAAUAAGAAGC (SEQ ID NO: 21). In some embodiments, the extended stem loop comprises a GAGAAA spacer sequence. In some embodiments, the disclosure provides gNA variants wherein the extended stem loop is replaced with an RNA stem loop sequence from a heterologous RNA source with proximal 5' and 3' ends, such as, but not limited to stem loop sequences selected from MS2, QP, U1 hairpin II, Uvsx, or PP7 stem loops. In such cases, the heterologous RNA stem loop increases the stability of the gNA. In other embodiments, the disclosure provides gNA variants having an extended stem loop region comprising at least 10, at least 100, at least 500, at least 1000, or at least 10,000 nucleotides.

e. Targeting Sequence

In some embodiments of the gNAs of the disclosure, the extended stem loop is followed by a region that forms part of the triplex, and then the targeting sequence (or "spacer"). The targeting sequence targets the CasX ribonucleoprotein holo complex to a specific region of the target nucleic acid sequence of the gene to be modified. Thus, for example, gNA targeting sequences of the disclosure have sequences complementarity to, and therefore can hybridize to, a portion of the B2M gene in a nucleic acid in a eukaryotic cell (e.g., a eukaryotic chromosome, chromosomal sequence, a eukaryotic RNA, etc.) as a component of the RNP when any one of the PAM sequences TTC, ATC, GTC, or CTC is located 1 nucleotide 5' to the non-target strand sequence complementary to the target sequence. The targeting sequence of a gNA can be modified so that the gNA can target a desired sequence of any desired target nucleic acid sequence, so long as the PAM sequence location is taken into consideration. In some embodiments, the gNA scaffold is 5' of the targeting sequence, with the targeting sequence on the 3' end of the gNA. In some embodiments, the PAM sequence recognized by the RNP is TC. In other embodiments, the PAM sequence recognized by the RNP is NTC.

In some embodiments, the targeting sequence of the gNA is specific for, and is capable of hybridizing with, a portion of a gene encoding a protein involved in antigen processing, antigen presentation, antigen recognition, and/or antigen response, including, but not limited to beta-2-microglobulin (B2M), T cell receptor alpha chain constant region (TRAC), class II major histocompatibility complex transactivator (CIITA), T cell receptor beta constant 1 (TRBC1), T cell receptor beta constant 2 (TRBC2), human leukocyte antigen A (HLA-A), human leukocyte antigen B (HLA-B), TGFβ Receptor 2 (TGFβRII), programmed cell death 1 (PD-1), cytokine inducible SH2 (CISH), lymphocyte activating 3 (LAG-3), T cell immunoreceptor with Ig and ITIM domains (TIGIT), adenosine A2a receptor (ADORA2A), killer cell lectin like receptor C1 (NKG2A), cytotoxic T-lymphocyte-associated protein 4 (CTLA-4), T-cell immunoglobulin and mucin domain 3 (TIM-3), and 2B4 (CD244). In one particular embodiment, the gene is B2M. The B2M gene encodes a serum protein found in association with the major histocompatibility complex (MHC) class I heavy chain on the surface of nearly all nucleated cells. In another particular embodiment, the gene is TRAC. The TRAC gene encodes the C-terminal constant region, linked to one of 70 variable regions of the T cell alpha receptor. Following similar synthesis of the beta chain, the alpha and beta chains pair to yield the alpha-beta T-cell receptor heterodimer. In another particular embodiment, the gene is CITTA. The CIITA gene provides instructions for making a protein that primarily helps control the activity (transcription) of genes of the major histocompatibility complex (MHC) class II. In the foregoing, the genomic targets are those in which the encoding gene of the target is intended to be knocked out or knocked down such that the protein (e.g., a cell marker or intracellular protein) is not expressed or is expressed at a lower level in a cell. In some embodiments, the targeting sequence of a gNA is specific for an exon of the gene. In other embodiments, the targeting sequence of a gNA is specific for an intron of the gene. In other embodiments, the targeting sequence of a gNA is specific for a regulatory element of the gene. In other embodiments, the targeting sequence of a gNA is specific for a junction of the exon, intron, and/or regulatory element of the gene. In other embodiments, the targeting sequence of a gNA is specific for an intergenic region. In those cases where the targeting sequence is specific for a regulatory element, such regulatory elements include, but are not limited to promoter regions, enhancer regions, intergenic regions, 5' untranslated regions (5' UTR), 3' untranslated regions (3' UTR), conserved elements, and regions comprising cis-regulatory elements. The promoter region is intended to encompass nucleotides within 5 kb of the initiation point of the encoding sequence or, in the case of gene enhancer elements or conserved elements, can be thousands of bp, hundreds of thousands of bp, or even millions of bp away from the encoding sequence of the gene of the target nucleic acid. In the foregoing, the targets are those in which the encoding gene of the target is intended to be knocked out or knocked down such that the targeted protein is not expressed or is expressed at a lower level in a cell.

In some embodiments, the targeting sequence of the gNA has between 14 and 35 consecutive nucleotides. In some embodiments, the targeting sequence has 14, 15, 16, 18, 18, 19, 20, 21, 22, 23 24, 25, 26, 27, 28, 29, 30, 31, 32, 33, 34 or 35 consecutive nucleotides. In some embodiments, the targeting sequence consists of 20 consecutive nucleotides. In some embodiments, the targeting sequence consists of 19 consecutive nucleotides. In some embodiments, the targeting sequence consists of 18 consecutive nucleotides. In some embodiments, the targeting sequence consists of 17 consecutive nucleotides. In some embodiments, the targeting sequence consists of 16 consecutive nucleotides. In some embodiments, the targeting sequence consists of 15 consecutive nucleotides. In some embodiments, the targeting sequence has 14, 15, 16, 17, 18, 19, 20, 21, 22, 23, 24, 25, 26, 27, 28, 29, 30, 31, 32, 33, 34 or 35 consecutive nucleotides and the targeting sequence can comprise 0 to 5, 0 to 4, 0 to 3, or 0 to 2 mismatches relative to the target nucleic acid sequence and retain sufficient binding specificity such that the RNP comprising the gNA comprising the targeting sequence can form a complementary bond with respect to the target nucleic acid.

Representative, but non-limiting examples of targeting sequences for inclusion in the gNA of the disclosure are presented in Tables 3A, 3B, and 3C (included as FIGS. 35-37), representing targeting sequences for B2M, TRAC, and CIITA, respectively.

Exemplary targeting sequences (spacer sequences) of the gNA embodiments utilized with the CasX:gNA system for editing of the B2M gene are provided in Table 3A (SEQ ID NOs: 725-2100 and 2281-7085). In one embodiment, the targeting sequence of the B2M gNA comprises a sequence having at least about 65%, at least about 75%, at least about 85%, or at least about 95% identity to a sequence selected from the group consisting of sequences set forth in Table 3A. In another embodiment, the targeting sequence of the gNA consists of a sequence selected from the group consisting of sequences set forth in Table 3A. In the foregoing embodiments, thymine (T) nucleotides can be substituted for one or more or all of the uracil (U) nucleotides in any of the targeting sequences such that the gNA can be a gDNA or a gRNA, or a chimera of RNA and DNA. In some embodiments, a targeting sequence of Table 3A has at least 1, 2, 3, 4, 5, or 6 or more thymine nucleotides substituted for thymine nucleotides. In other embodiments, a gNA, gRNA, or gDNA of the disclosure comprises 1, 2, 3 or more targeting sequences of Table 3A, or targeting sequences that are at least 50% identical, at least 55% identical, at least 60% identical, at least 65% identical, at least 70% identical, at least 75% identical, at least 80% identical, at least 85% identical, at least 90% identical, at least 95% identical to one or more sequences of Table 3A.

Exemplary targeting sequences (spacer sequences) of the gNA embodiments utilized with the CasX:gNA system for editing of the TRAC gene are provided in Table 3B. In one embodiment, the targeting sequence of the TRAC gNA comprises a sequence having at least about 65%, at least about 75%, at least about 85%, or at least about 95% identity to a sequence selected from the group consisting of sequences set forth in Table 3B. In another embodiment, the targeting sequence of the gNA consists of a sequence selected from the group consisting of sequences set forth in Table 3B. In the foregoing embodiments, thymine (T) nucleotides can be substituted for one or more or all of the uracil (U) nucleotides in any of the targeting sequences such that the gNA can be a gDNA or a gRNA, or a chimera of RNA and DNA. In some embodiments, a targeting sequence of Table 3B has at least 1, 2, 3, 4, 5, or 6 or more thymine nucleotides substituted for uracil nucleotides. In other embodiments, a gNA, gRNA, or gDNA of the disclosure comprises 1, 2, 3 or more targeting sequences of Table 3B, or targeting sequences that are at least 50% identical, at least 55% identical, at least 60% identical, at least 65% identical, at least 70% identical, at least 75% identical, at least 80% identical, at least 85% identical, at least 90% identical, at least 95% identical to one or more sequences of Table 3B.

Exemplary targeting sequences (spacer sequences) of the gNA embodiments utilized with the CasX:gNA system for editing of the CIITA gene are provided in Table 3C. In one embodiment, the targeting sequence of the TRAC gNA comprises a sequence having at least about 65%, at least about 75%, at least about 85%, or at least about 95% identity to a sequence selected from the group consisting of sequences set forth in Table 3C. In another embodiment, the targeting sequence of the gNA consists of a sequence selected from the group consisting of sequences set forth in Table 3C. In the foregoing embodiments, thymine (T) nucleotides can be substituted for one or more or all of the uracil (U) nucleotides in any of the targeting sequences such that the gNA can be a gDNA or a gRNA, or a chimera of RNA and DNA. In some embodiments, a targeting sequence of Table 3C has at least 1, 2, 3, 4, 5, or 6 or more thymine nucleotides substituted for uracil nucleotides. In other embodiments, a gNA, gRNA, or gDNA of the disclosure comprises 1, 2, 3 or more targeting sequences of Table 3C, or targeting sequences that are at least 50% identical, at least 55% identical, at least 60% identical, at least 65% identical, at least 70% identical, at least 75% identical, at least 80% identical, at least 85% identical, at least 90% identical, at least 95% identical to one or more sequences of Table 3C.

In some embodiments, the CasX:gNA system comprises a first gNA and further comprises a second (and optionally a third, fourth, fifth, or more) gNA, wherein the second gNA or additional gNA has a targeting sequence complementary to a different or overlapping portion of the target nucleic acid sequence compared to the targeting sequence of the first gNA such that multiple points in the target nucleic acid are targeted, and, for example, multiple breaks are introduced in the target nucleic acid by the CasX. It will be understood that in such cases, the second or additional gNA is complexed with an additional copy of the CasX protein. By selection of the targeting sequences of the gNA, defined regions of the target nucleic acid sequence bracketing a particular location within the target nucleic acid can be modified or edited using the CasX:gNA systems described herein, including facilitating the insertion of a donor template.

f. gNA Scaffolds

In some embodiments, a CasX reference gRNA comprises a sequence isolated or derived from Deltaproteobacter. In some embodiments, the sequence is a CasX tracrRNA sequence. Exemplary CasX reference tracrRNA sequences isolated or derived from Deltaproteobacter may include: ACAUCUGGCGCGUUUAUUCCAUUACUUUG-GAGCCAGUCCCAGCGACUAUGUCG UAUGGACGAAGCGCUUAUUUAUCGGAGA (SEQ ID NO: 22) and ACAUCUGGCGCGUUUAUUCCAUUAC-UUUGGAGCCAGUCCCAGCGACUAUGUCG UAUGGACGAAGCGCUUAUUUAUCGG (SEQ ID NO:

23). Exemplary crRNA sequences isolated or derived from Deltaproteobacter may comprise a sequence of CCGAUA-AGUAAAACGCAUCAAAG (SEQ ID NO: 24). In some embodiments, a CasX reference gNA comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence isolated or derived from Deltaproteobacter.

In some embodiments, a CasX reference guide RNA comprises a sequence isolated or derived from Planctomycetes. In some embodiments, the sequence is a CasX tracrRNA sequence. Exemplary CasX reference tracrRNA sequences isolated or derived from Planctomycetes may include: UACUGGCGCUUUUAUCUCAUUAC-UUUGAGAGCCAUCACCAGCGACUAUGUCGU AUGGGUAAAGCGCUUAUUUAUCGGAGA (SEQ ID NO: 25) and UACUGGCGCUUUUAUCUCAUUAC-UUUGAGAGCCAUCACCAGCGACUA UGU-CGUAUGGGUAAAGCGCUUAUUUAUCGG (SEQ ID NO: 26). Exemplary crRNA sequences isolated or derived from Planctomycetes may comprise a sequence of UCUCCGAUAAAUAAGAAGCAUCAAAG (SEQ ID NO: 27). In some embodiments, a CasX reference gNA comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence isolated or derived from Planctomycetes.

In some embodiments, a CasX reference gNA comprises a sequence isolated or derived from Candidatus Sungbacteria. In some embodiments, the sequence is a CasX tracrRNA sequence. Exemplary CasX reference tracrRNA sequences isolated or derived from Candidatus Sungbacteria may comprise sequences of: GUUUACACACUCCCUCU-CAUAGGGU (SEQ ID NO: 28), GUUUACACACUCC-CUCUCAUGAGGU (SEQ ID NO: 29), UUUUACAUACCCCCUCUCAUGGGAU (SEQ ID NO: 30) and GUUUACACACUCCCUCUCAUGGGGG (SEQ ID NO: 31). In some embodiments, a CasX reference guide RNA comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence isolated or derived from Candidatus Sungbacteria.

Table 1 provides the sequences of reference gRNAs tracr and scaffold sequences. In some embodiments, the disclosure provides gNA sequences wherein the gNA has a scaffold comprising a sequence having at least one nucleotide modification relative to a reference gNA sequence having a sequence of any one of SEQ ID NOS:4-16 of Table 1. It will be understood that in those embodiments wherein a vector comprises a DNA encoding sequence for a gNA, or where a gNA is a gDNA or a chimera of RNA and DNA, that thymine (T) bases can be substituted for the uracil (U) bases of any of the gNA sequence embodiments described herein.

TABLE 1

Reference gRNA sequences

| SEQ ID NO. | Nucleotide Sequence |
|---|---|
| 4 | ACAUCUGGCGCGUUUAUUCCAUUACUUUGGAGCCAGUCCCAGCG ACUAUGUCGUAUGGACGAAGCGCUUAUUUAUCGGAGAGAAACCG AUAAGUAAAACGCAUCAAAG |
| 5 | UACUGGCGCUUUUAUCUCAUUACUUUGAGAGCCAUCACCAGCGA CUAUGUCGUAUGGGUAAAGCGCUUAUUUAUCGGAGAGAAAUCCG AUAAAUAAGAAGCAUCAAAG |
| 6 | ACAUCUGGCGCGUUUAUUCCAUUACUUUGGAGCCAGUCCCAGCG ACUAUGUCGUAUGGACGAAGCGCUUAUUUAUCGGAGA |
| 7 | ACAUCUGGCGCGUUUAUUCCAUUACUUUGGAGCCAGUCCCAGCG ACUAUGUCGUAUGGACGAAGCGCUUAUUUAUCGG |
| 8 | UACUGGCGCUUUUAUCUCAUUACUUUGAGAGCCAUCACCAGCGA CUAUGUCGUAUGGGUAAAGCGCUUAUUUAUCGGAGA |
| 9 | UACUGGCGCUUUUAUCUCAUUACUUUGAGAGCCAUCACCAGCGA CUAUGUCGUAUGGGUAAAGCGCUUAUUUAUCGG |
| 10 | GUUUACACACUCCCUCUCAUAGGGU |
| 11 | GUUUACACACUCCCUCUCAUGAGGU |
| 12 | UUUUACAUACCCCCUCUCAUGGGAU |
| 13 | GUUUACACACUCCCUCUCAUGGGGG |
| 14 | CCAGCGACUAUGUCGUAUGG |
| 15 | GCGCUUAUUUAUCGGAGAGAAAUCCGAUAAAUAAGAAGC |
| 16 | GGCGCUUUUAUCUCAUUACUUUGAGAGCCAUCACCAGCGACUAU GUCGUAUGGGUAAAGCGCUUAUUUAUCGGA |

g. gNA Variants

In another aspect, the disclosure relates to guide nucleic acid variants (referred to herein alternatively as "gNA variant" or "gRNA variant"), which comprise one or more modifications relative to a reference gRNA scaffold. As used herein, "scaffold" refers to all parts to the gNA necessary for gNA function with the exception of the spacer sequence.

In some embodiments, a gNA variant comprises one or more nucleotide substitutions, insertions, deletions, or swapped or replaced regions relative to a reference gRNA sequence of the disclosure. In some embodiments, a mutation can occur in any region of a reference gRNA to produce a gNA variant. In some embodiments, the scaffold of the gNA variant sequence has at least 20%, at least 30%, at least 40%, at least 50%, at least 60%, or at least 70%, at least 80%, at least 85%, at least about 90%, at least about 95%, at least about 96%, at least about 97%, at least about 98%, or at least about 99% identity to the sequence of SEQ ID NO:4 or SEQ ID NO:5.

In some embodiments, a gNA variant comprises one or more nucleotide changes within one or more regions of the reference gRNA that improve a characteristic of the reference gRNA. Exemplary regions include the RNA triplex, the pseudoknot, the scaffold stem loop, and the extended stem loop. In some cases, the variant scaffold stem further comprises a bubble. In other cases, the variant scaffold further comprises a triplex loop region. In still other cases, the variant scaffold further comprises a 5' unstructured region. In one embodiment, the gNA variant scaffold comprises a scaffold stem loop having at least 60% sequence identity to SEQ ID NO:14. In another embodiment, the gNA variant comprises a scaffold stem loop having the sequence of CCAGCGACUAUGUCGUAGUGG (SEQ ID NO: 32). In another embodiment, the disclosure provides a gNA scaffold comprising, relative to SEQ ID NO:5, a C18G substitution, a G55 insertion, a U1 deletion, and a modified extended stem loop in which the original 6 nt loop and 13 most-loop-proximal base pairs (32 nucleotides total) are replaced by a Uvsx hairpin (4 nt loop and 5 loop-proximal base pairs; 14 nucleotides total) and the loop-distal base of the extended stem was converted to a fully base-paired stem contiguous with the new Uvsx hairpin by deletion of the A99 and substitution of G64U. In the foregoing embodiment, the gNA scaffold comprises the sequence (SEQ ID NO: 33)
ACUGGCGCUUUUAUCUGAUUACUUUGAGAGCCAUCACCAGCGACUAUGUC

GUAGUGGGUAAAGCUCCCUCUUCGGAGGGAGCAUCAAAG.

All gNA variants that have one or more improved functions or characteristics, or add one or more new functions when the variant gNA is compared to a reference gRNA described herein, are envisaged as within the scope of the disclosure. A representative example of such a gNA variant is guide 174 (SEQ ID NO:2238), the design of which is described in the Examples. In some embodiments, the gNA variant adds a new function to the RNP comprising the gNA variant. In some embodiments, the gNA variant has an improved characteristic selected from: improved stability; improved solubility; improved transcription of the gNA; improved resistance to nuclease activity; increased folding rate of the gNA; decreased side product formation during folding; increased productive folding; improved binding affinity to a CasX protein; improved binding affinity to a target DNA when complexed with a CasX protein; improved gene editing when complexed with a CasX protein; improved specificity of editing when complexed with a CasX protein; and improved ability to utilize a greater spectrum of one or more PAM sequences, including ATC, CTC, GTC, or TTC, in the editing of target DNA when complexed with a CasX protein, or any combination thereof. In some cases, the one or more of the improved characteristics of the gNA variant is at least about 1.1 to about 100,000-fold improved relative to the reference gNA of SEQ ID NO:4 or SEQ ID NO:5. In other cases, the one or more improved characteristics of the gNA variant is at least about 1.1, at least about 10, at least about 100, at least about 1000, at least about 10,000, at least about 100,000-fold or more improved relative to the reference gNA of SEQ ID NO:4 or SEQ ID NO:5. In other cases, the one or more of the improved characteristics of the gNA variant is about 1.1 to 100,00-fold, about 1.1 to 10,00-fold, about 1.1 to 1,000-fold, about 1.1 to 500-fold, about 1.1 to 100-fold, about 1.1 to 50-fold, about 1.1 to 20-fold, about 10 to 100,00-fold, about 10 to 10,00-fold, about 10 to 1,000-fold, about 10 to 500-fold, about 10 to 100-fold, about 10 to 50-fold, about 10 to 20-fold, about 2 to 70-fold, about 2 to 50-fold, about 2 to 30-fold, about 2 to 20-fold, about 2 to 10-fold, about 5 to 50-fold, about 5 to 30-fold, about 5 to 10-fold, about 100 to 100,00-fold, about 100 to 10,00-fold, about 100 to 1,000-fold, about 100 to 500-fold, about 500 to 100,00-fold, about 500 to 10,00-fold, about 500 to 1,000-fold, about 500 to 750-fold, about 1,000 to 100,00-fold, about 10,000 to 100,00-fold, about 20 to 500-fold, about 20 to 250-fold, about 20 to 200-fold, about 20 to 100-fold, about 20 to 50-fold, about 50 to 10,000-fold, about 50 to 1,000-fold, about 50 to 500-fold, about 50 to 200-fold, or about 50 to 100-fold, improved relative to the reference gNA of SEQ ID NO:4 or SEQ ID NO:5. In other cases, the one or more improved characteristics of the gNA variant is about 1.1-fold, 1.2-fold, 1.3-fold, 1.4-fold, 1.5-fold, 1.6-fold, 1.7-fold, 1.8-fold, 1.9-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 45-fold, 50-fold, 55-fold, 60-fold, 70-fold, 80-fold, 90-fold, 100-fold, 110-fold, 120-fold, 130-fold, 140-fold, 150-fold, 160-fold, 170-fold, 180-fold, 190-fold, 200-fold, 210-fold, 220-fold, 230-fold, 240-fold, 250-fold, 260-fold, 270-fold, 280-fold, 290-fold, 300-fold, 310-fold, 320-fold, 330-fold, 340-fold, 350-fold, 360-fold, 370-fold, 380-fold, 390-fold, 400-fold, 425-fold, 450-fold, 475-fold, or 500-fold improved relative to the reference gNA of SEQ ID NO:4 or SEQ ID NO:5.

In some embodiments, a gNA variant can be created by subjecting a reference gRNA to a one or more mutagenesis methods, such as the mutagenesis methods described herein, below, which may include Deep Mutational Evolution (DME), deep mutational scanning (DMS), error prone PCR, cassette mutagenesis, random mutagenesis, staggered extension PCR, gene shuffling, or domain swapping, in order to generate the gNA variants of the disclosure. The activity of reference gRNAs may be used as a benchmark against which the activity of gNA variants are compared, thereby measuring improvements in function of gNA variants. In other embodiments, a reference gRNA may be subjected to one or more deliberate, targeted mutations, substitutions, or domain swaps in order to produce a gNA variant, for example a rationally designed variant. Exemplary gRNA variants produced by such methods are described in the Examples and representative sequences of gNA scaffolds are presented in Table 2.

In some embodiments, the gNA variant comprises one or more modifications compared to a reference guide nucleic acid scaffold sequence, wherein the one or more modification is selected from: at least one nucleotide substitution in a region of the gNA variant; at least one nucleotide deletion in a region of the gNA variant; at least one nucleotide insertion in a region of the gNA variant; a substitution of all or a portion of a region of the gNA variant; a deletion of all or a portion of a region of the gNA variant; or any combination of the foregoing. In some cases, the modification is a substitution of 1 to 15 consecutive or non-consecutive nucleotides in the gNA variant in one or more regions. In other cases, the modification is a deletion of 1 to 10 consecutive or non-consecutive nucleotides in the gNA variant in one or more regions. In other cases, the modification is an insertion of 1 to 10 consecutive or non-consecutive nucleotides in the gNA variant in one or more regions. In other cases, the modification is a substitution of the scaffold stem loop or the extended stem loop with an RNA stem loop sequence from a heterologous RNA source with proximal 5' and 3' ends. In some cases, a gNA variant of the disclosure comprises two or more modifications in one region. In other cases, a gNA variant of the disclosure comprises modifications in two or more regions. In other cases, a gNA variant comprises any combination of the foregoing modifications described in this paragraph.

In some embodiments, a 5' G is added to a gNA variant sequence for expression in vivo, as transcription from a U6 promoter is more efficient and more consistent with regard to the start site when the +1 nucleotide is a G. In other embodiments, two 5' Gs are added to a gNA variant sequence for in vitro transcription to increase production efficiency, as T7 polymerase strongly prefers a G in the +1 position and a purine in the +2 position. In some cases, the 5' G bases are added to the reference scaffolds of Table 1. In other cases, the 5' G bases are added to the variant scaffolds of Table 2.

Table 2 provides exemplary gNA variant scaffold sequences. In Table 2, (−) indicates a deletion at the specified position(s) relative to the reference sequence of SEQ ID NO:5, (+) indicates an insertion of the specified base(s) at the position indicated relative to SEQ ID NO:5, (:) indicates the range of bases at the specified start:stop coordinates of a deletion or substitution relative to SEQ ID NO:5, and multiple insertions, deletions or substitutions are separated by commas; e.g., A14C, U17G. In some embodiments, the gNA variant scaffold comprises any one of the sequences listed in Table 2, SEQ ID NOS:2101-2280, or a sequence having at least about 50%, at least about 60%, at least about 70%, at least about 80%, at least about 90%, at least about 95%, at least about 95%, at least about 96%, at least about 97%, at least about 98%, at least about 99% sequence identity thereto. It will be understood that in those embodiments wherein a vector comprises a DNA encoding sequence for a gNA, or where a gNA is a gDNA or a chimera of RNA and DNA, that thymine (T) bases can be substituted for the uracil (U) bases of any of the gNA sequence embodiments described herein.

TABLE 2

Exemplary gNA Scaffold Sequences

| SEQ ID NO: | NAME or Modification | NUCLEOTIDE SEQUENCE |
|---|---|---|
| 2101 | phage replication stable | UACUGGCGCUUUUAUCUCAUUACUUUGAGAGCCAUCACCAGCGACUAUGUCGUAUGGGUAAAGCGCAGGUGGGACGACCUCUCGGUCGUCCUAUCUGAAGCAUCAAAG |
| 2102 | Kissing loop_b1 | UACUGGCGCUUUUAUCUCAUUACUUUGAGAGCCAUCACCAGCGACUAUGUCGUAUGGGUAAAGCGCUGCUCGACGCGUCCUCGAGCAGAAGCAUCAAAG |
| 2103 | Kissing loop_a | UACUGGCGCUUUUAUCUCAUUACUUUGAGAGCCAUCACCAGCGACUAUGUCGUAUGGGUAAAGCGCUGCUCGCUCCGUUCGAGCAGAAGCAUCAAAG |
| 2104 | 32: uvsX hairpin | GUACUGGCGCUUUUAUCUCAUUACUUUGAGAGCCAUCACCAGCGACUAUGUCGUAUGGGUAAAGCGCCCUCUUCGGAGGGAAGCAUCAAAG |
| 2105 | PP7 | UACUGGCGCUUUUAUCUCAUUACUUUGAGAGCCAUCACCAGCGACUAUGUCGUAUGGGUAAAGCGCAGGAGUUUCUAUGGAAACCCUGAAGCAUCAAAG |
| 2106 | 64: trip mut, extended stem truncation | GUACUGGCGCCUUUAUCUCAUUACUUUGAGAGCCAUCACCAGCGACUAUGUCGUAUGGGUAAAGCGCUUACGGACUUCGGUCCGUAAGAAGCAUCAAAG |
| 2107 | hyperstable tetraloop | UACUGGCGCUUUUAUCUCAUUACUUUGAGAGCCAUCACCAGCGACUAUGUCGUAUGGGUAAAGCGCUGCGCUUGCGCAGAAGCAUCAAAG |
| 2108 | C18G | UACUGGCGCUUUUAUCUGAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2109 | U17G | UACUGGCGCUUUUAUCGCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2110 | CUUCGG loop | UACUGGCGCUUUUAUCUCAUUACUUUGAGAGCCAUCACCAGCGACUAUGUCGUAUGGGUAAAGCGCUUAUUUAUCGGAGACUUCGGUCCGAUAAAUAAGAAGCAUCAAAG |
| 2111 | MS2 | UACUGGCGCUUUUAUCUCAUUACUUUGAGAGCCAUCACCAGCGACUAUGUCGUAUGGGUAAAGCGCACAUGAGGAUUACCCAUGUGAAGCAUCAAAG |
| 2112 | −1, A2G, −78, G77U | GCUGGCGCUUUUAUCUCAUUACUUUGAGAGCCAUCACCAGCGACUAUGUCGUAUGGGUAAAGCGCUUAUUUAUCGUGAGAAAUCCGAUAAAUAAGAAGCAUCAAAG |

TABLE 2-continued

| Exemplary qNA Scaffold Sequences | | |
|---|---|---|
| SEQ ID NO: | NAME or Modification | NUCLEOTIDE SEQUENCE |
| 2113 | QB | UACUGGCGCUUUUAUCUCAUUACUUUGAGAGCCAUCACCAGCGACUAUGUCGUAUGGGUAAAGCGCUGCAUGUCUAAGACAGCAGAAGCAUCAAAG |
| 2114 | 45, 44 hairpin | UACUGGCGCUUUUAUCUCAUUACUUUGAGAGCCAUCACCAGCGACUAUGUCGUAUGGGUAAAGCGCAGGGCUUCGGCCGAAGCAUCAAAG |
| 2115 | U1A | UACUGGCGCUUUUAUCUCAUUACUUUGAGAGCCAUCACCAGCGACUAUGUCGUAUGGGUAAAGCGCAAUCCAUUGCACUCCGGAUUGAAGCAUCAAAG |
| 2116 | A14C, U17G | UACUGGCGCUUUUCUCGCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2117 | CUUCGG loop modified | UACUGGCGCUUUUAUCUCAUUACUUUGAGAGCCAUCACCAGCGACUAUGUCGUAUGGGUAAAGCGCUUAUUUAUCGGACUUCGGUCCGAUAAAUAAGAAGCAUCAAAG |
| 2118 | Kissing loop_b2 | UACUGGCGCUUUUAUCUCAUUACUUUGAGAGCCAUCACCAGCGACUAUGUCGUAUGGGUAAAGCGCUGCUCGUUUGCGGCUACGAGCAGAAGCAUCAAAG |
| 2119 | -76:78, -83:87 | UACUGGCGCUUUUAUCUCAUUACUUUGAGAGCCAUCACCAGCGACUAUGUCGUAUGGGUAAAGCGCUUAUUUAUCGAGAGAUAAAUAAGAAGCAUCAAAG |
| 2120 | -4 | UACGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2121 | extended stem truncation | UACUGGCGCCUUUUAUCUCAUUACUUUGAGAGCCAUCACCAGCGACUAUGUCGUAUGGGUAAAGCGCUUACGGACUUCGGUCCGUAAGAAGCAUCAAAG |
| 2122 | C55 | UACUGGCGCUUUUAUCUCAUUACUUUGAGAGCCAUCACCAGCGACUAUGUCGUAUCGGUAAAGCGCUUAUUUAUCGGAGAGAAAUCCGAUAAAUAAGAAGCAUCAAAG |
| 2123 | trip mut | UACUGGCGCCUUUAUCUCAUUACUUUGAGAGCCAUCACCAGCGACUAUGUCGUAUGGGUAAAGCGCUUAUUUAUCGGACUUCGGUCCGAUAAAUAAGAAGCAUCAAAG |
| 2124 | -76:78 | UACUGGCGCUUUUAUCUCAUUACUUUGAGAGCCAUCACCAGCGACUAUGUCGUAUGGGUAAAGCGCUUAUUUAUCGAGAAAUCCGAUAAAUAAGAAGCAUCAAAG |
| 2125 | -1:5 | GCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2126 | -83:87 | UACUGGCGCUUUUAUCUCAUUACUUUGAGAGCCAUCACCAGCGACUAUGUCGUAUGGGUAAAGCGCUUAUUUAUCGGAGAGAGAUAAAUAAGAAGCAUCAAAG |
| 2127 | =+G28, A82U, -84, | UACUGGCGCUUUUAUCUCAUUACUUUGGAGAGCCAUCACCAGCGACUAUGUCGUAUGGGUAAAGCGCUUAUUUAUCGGAGAGUAUCCGAUAAAUAAGAAGCAUCAAAG |
| 2128 | =+51U | UACUGGCGCUUUUAUCUCAUUACUUUGAGAGCCAUCACCAGCGACUAUGUUCGUAUGGGUAAAGCGCUUAUUUAUCGGAGAGAAAUCCGAUAAAUAAGAAGCAUCAAAG |
| 2129 | -1:4, +G5A, +G86, | AGCGCUUUUAUCUCAUUACUUUGAGAGCCAUCACCAGCGACUAUGUCGUAUGGGUAAAGCGCUUAUUUAUCGGAGAGAAAUGCCGAUAAAUAAGAAGCAUCAAAG |
| 2130 | =+A94 | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAAUAAGAAGCAUCAAAG |

TABLE 2-continued

Exemplary gNA Scaffold Sequences

| SEQ ID NO: | NAME or Modification | NUCLEOTIDE SEQUENCE |
|---|---|---|
| 2131 | =+G72 | UACUGGCGCUUUUAUCUCAUUACUUUGAGAGCCAUCACCAGCGACUAUGUCGUAUGGGUAAAGCGCUUAUUGUAUCGGAGAGAAAUCCGAUAAAUAAGAAGCAUCAAAG |
| 2132 | shorten front, CUUCGG loop modified, extend extended | GCGCUUUUAUCUCAUUACUUUGAGAGCCAUCACCAGCGACUAUGUCGUAUGGGUAAAGCGCUUAUUUAUCGGACUUCGGUCCGAUAAAUAAGCGCAUCAAAG |
| 2133 | A14C | UACUGGCGCUUUUCUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2134 | -1:3, +G3 | GUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2135 | =+C45, +U46 | UACUGGCGCUUUUAUCUCAUUACUUUGAGAGCCAUCACCAGCGACCUUAUGUCGUAUGGGUAAAGCGCUUAUUUAUCGGAGAGAAAUCCGAUAAAUAAGAAGCAUCAAAG |
| 2136 | CUUCGG loop modified, fun start | GAUGGCGCUUUUAUCUCAUUACUUUGAGAGCCAUCACCAGCGACUAUGUCGUAUGGGUAAAGCGCUUAUUUAUCGGACUUCGGUCCGAUAAAUAAGAAGCAUCAAAG |
| 2137 | -93:94 | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAAGAAGCAUCAAAG |
| 2138 | =+U45 | UACUGGCGCUUUUAUCUCAUUACUUUGAGAGCCAUCACCAGCGAUCUAUGUCGUAUGGGUAAAGCGCUUAUUUAUCGGAGAGAAAUCCGAUAAAUAAGAAGCAUCAAAG |
| 2139 | -69, -94 | UACUGGCGCUUUUAUCUCAUUACUUUGAGAGCCAUCACCAGCGACUAUGUCGUAUGGGUAAAGGCUUAUUUAUCGGAGAGAAAUCCGAUAAAAAGAAGCAUCAAAG |
| 2140 | -94 | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAAAGAAGCAUCAAAG |
| 2141 | modified CUUCGG, minus U in 1st triplex | UACUGGCGCUUUAUCUCAUUACUUUGAGAGCCAUCACCAGCGACUAUGUCGUAUGGGUAAAGCGCUUAUUUAUCGGACUUCGGUCCGAUAAAUAAGAAGCAUCAAAG |
| 2142 | -1:4, +C4, A14C, U17G, +G72, -76:78, -83:87 | CGGCGCUUUUCUCGCAUUACUUUGAGAGCCAUCACCAGCGACUAUGUCGUAUGGGUAAAGCGCUUAUUGUAUCGAGAGAUAAAUAAGAAGCAUCAAAG |
| 2143 | U1C, -73 | CACUGGCGCUUUUAUCUCAUUACUUUGAGAGCCAUCACCAGCGACUAUGUCGUAUGGGUAAAGCGCUUAUUUUCGGAGAGAAAUCCGAUAAAUAAGAAGCAUCAAAG |
| 2144 | Scaffold uuCG, stem uuCG. Stem swap, t shorten | UACUGGCGCUUUAUCUCAUUACUUUGAGAGCCAUCACCAGCGACUUCGGUCGUAUGGGUAAAGCGCUUAUGUAUCGGCUUCGGCCGAUACAUAAGAAGCAUCAAAG |
| 2145 | Scaffold uuCG, stem uuCG. Stem swap | UACUGGCGCUUUUAUCUCAUUACUUUGAGAGCCAUCACCAGCGACUUCGGUCGUAUGGGUAAAGCGCUUAUGUAUCGGCUUCGGCCGAUACAUAAGAAGCAUCAAAG |
| 2146 | =+G60 | UACUGGCGCUUUUAUCUCAUUACUUUGAGAGCCAUCACCAGCGACUAUGUCGUAUGGGUGAAAGCGCUUAUUUAUCGGAGAGAAAUCCGAUAAAUAAGAAGCAUCAAAG |

TABLE 2-continued

| Exemplary gNA Scaffold Sequences | | |
|---|---|---|
| SEQ ID NO: | NAME or Modification | NUCLEOTIDE SEQUENCE |
| 2147 | no stem Scaffold uuCG | UACUGGCGCUUUUAUCUCAUUACUUUGAGAGCCAUCACCAGCGACUU CGGUCGUAUGGGUAAAG |
| 2148 | no stem Scaffold uuCG, fun start | GAUGGGCUUUUAUCUCAUUACUUUGAGAGCCAUCACCAGCGACUUCG GUCGUAUGGGUAAAG |
| 2149 | Scaffold uuCG, stem uuCG, fun start | GAUGGGCUUUUAUCUCAUUACUUUGAGAGCCAUCACCAGCGACUUCG GUCGUAUGGGUAAAGCGCUUAUUUAUCGGCUUCGGCCGAUAAAUAAG AAGCAUCAAAG |
| 2150 | Pseudoknots | UACUGGCGCUUUUAUCUCAUUACUUUGAGAGCCAUCACCAGCGACUA UGUCGUAUGGGUAAAGCGCUACACUGGGAUCGCUGAAUUAGAGAUCG GCGUCCUUUCAUUCUAUAUACUUUGGAGUUUUAAAAUGUCUCUAAGU ACAGAAGCAUCAAAG |
| 2151 | Scaffold uuCG, stem uuCG | GGCGCUUUUAUCUCAUUACUUUGAGAGCCAUCACCAGCGACUUCGGU CGUAUGGGUAAAGCGCUUAUUUAUCGGCUUCGGCCGAUAAAUAAGAA GCAUCAAAG |
| 2152 | Scaffold uuCG, stem uuCG, no start | GCUGGCGCUUUUAUCUCAUUACUUUGAGAGCCAUCACCAGCGACUUC GGUCGUAUGGGUAAAGCGCUUAUUUAUCGGCUUCGGCCGAUAAAUAA GAAGCAUCAAAG |
| 2153 | Scaffold uuCG | UACUGGCGCUUUUAUCUCAUUACUUUGAGAGCCAUCACCAGCGACUU CGGUCGUAUGGGUAAAGCGCUUAUUUAUCGGAGAGAAAUCCGAUAAA UAAGAAGCAUCAAAG |
| 2154 | =+GCUC36 | UACUGGCGCUUUUAUCUCAUUACUUUGAGAGCCAUGCUCCACCAGCG ACUAUGUCGUAUGGGUAAAGCGCUUAUUUAUCGGAGAGAAAUCCGAU AAAUAAGAAGCAUCAAAG |
| 2155 | G quadriplex telomere basket + ends | UACUGGCGCUUUUAUCUCAUUACUUUGAGAGCCAUCACCAGCGACUA UGUCGUAUGGGUAAAGCGGGGUUAGGGUUAGGGUUAGGGAAGCAUCA AAG |
| 2156 | G quadriplex M3q | UACUGGCGCUUUUAUCUCAUUACUUUGAGAGCCAUCACCAGCGACUA UGUCGUAUGGGUAAAGCGGAGGGAGGGAGGGAGAGGGAAAGCAUCAA AG |
| 2157 | G quadriplex telomere basket no ends | UACUGGCGCUUUUAUCUCAUUACUUUGAGAGCCAUCACCAGCGACUA UGUCGUAUGGGUAAAGCGUUGGGUUAGGGUUAGGGUUAGGGAAAAGC AUCAAAG |
| 2158 | 45, 44 hairpin (old version) | UACUGGCGCUUUUAUCUCAUUACUUUGAGAGCCAUCACCAGCGACUA UGUCGUAUGGGUAAAGCGC--------AGGGCUUCGGCCG------- --GAAGCAUCAAAG |
| 2159 | Sarcin-ricin loop | UACUGGCGCUUUUAUCUCAUUACUUUGAGAGCCAUCACCAGCGACUA UGUCGUAUGGGUAAAGCGCCUGCUCAGUACGAGAGGAACCGCAGGAA GCAUCAAAG |
| 2160 | uvsX, C18G | UACUGGCGCUUUUAUCUGAUUACUUUGAGAGCCAUCACCAGCGACUA UGUCGUAUGGGUAAAGCGCCCUCUUCGGAGGGAAGCAUCAAAG |
| 2161 | truncated stem loop, C18G, trip mut (U10C) | UACUGGCGCCUUUAUCUGAUUACUUUGAGAGCCAUCACCAGCGACUA UGUCGUAUGGGUAAAGCGCUUACGGACUUCGGUCCGUAAGAAGCAUC AAAG |
| 2162 | short phage rep, C18G | UACUGGCGCUUUUAUCUGAUUACUUUGAGAGCCAUCACCAGCGACUA UGUCGUAUGGGUAAAGCGCGGACGACCUCUCGGUCGUCCGAAGCAUC AAAG |
| 2163 | phage rep loop, C18G | UACUGGCGCUUUUAUCUGAUUACUUUGAGAGCCAUCACCAGCGACUA UGUCGUAUGGGUAAAGCGCAGGUGGGACGACCUCUCGGUCGUCCUAU CUGAAGCAUCAAAG |

TABLE 2-continued

Exemplary gNA Scaffold Sequences

| SEQ ID NO: | NAME or Modification | NUCLEOTIDE SEQUENCE |
|---|---|---|
| 2164 | =+G18, stacked onto 64 | UACUGGCGCCUUUAUCUGCAUUACUUUGAGAGCCAUCACCAGCGACUAUGUCGUAUGGGUAAAGCGCUUACGGACUUCGGUCCGUAAGAAGCAUCAAAG |
| 2165 | truncated stem loop, C18G, -1 A2G | GCUGGCGCUUUUAUCUGAUUACUUUGAGAGCCAUCACCAGCGACUAUGUCGUAUGGGUAAAGCGCUUACGGACUUCGGUCCGUAAGAAGCAUCAAAG |
| 2166 | phage rep loop, C18G, trip mut (U10C) | UACUGGCGCCUUUAUCUGAUUACUUUGAGAGCCAUCACCAGCGACUAUGUCGUAUGGGUAAAGCGCAGGUGGGACGACCUCUCGGUCGUCCUAUCUGAAGCAUCAAAG |
| 2167 | short phage rep, C18G, trip mut (U10C) | UACUGGCGCCUUUAUCUGAUUACUUUGAGAGCCAUCACCAGCGACUAUGUCGUAUGGGUAAAGCGCGGACGACCUCUCGGUCGUCCGAAGCAUCAAAG |
| 2168 | uvsX, trip mut (U10C) | UACUGGCGCCUUUAUCUCAUUACUUUGAGAGCCAUCACCAGCGACUAUGUCGUAUGGGUAAAGCGCCCUCUUCGGAGGGAAGCAUCAAAG |
| 2169 | truncated stem loop | UACUGGCGCUUUUAUCUCAUUACUUUGAGAGCCAUCACCAGCGACUAUGUCGUAUGGGUAAAGCGCUUACGGACUUCGGUCCGUAAGAAGCAUCAAAG |
| 2170 | =+A17, stacked onto 64 | UACUGGCGCCUUUAUCAUCAUUACUUUGAGAGCCAUCACCAGCGACUAUGUCGUAUGGGUAAAGCGCUUACGGACUUCGGUCCGUAAGAAGCAUCAAAG |
| 2171 | 3' HDV genomic ribozyme | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAGGGCCGGCAUGGUCCCAGCCUCCUCGCUGGCGCCGGCUGGGCAACAUUCCGAGGGGACCGUCCCCUCGGUAAUGGCGAAUGGGACCC |
| 2172 | phage rep loop, trip mut (U10C) | UACUGGCGCCUUUAUCUCAUUACUUUGAGAGCCAUCACCAGCGACUAUGUCGUAUGGGUAAAGCGCAGGUGGGACGACCUCUCGGUCGUCCUAUCUGAAGCAUCAAAG |
| 2173 | -79:80 | UACUGGCGCUUUUAUCUCAUUACUUUGAGAGCCAUCACCAGCGACUAUGUCGUAUGGGUAAAGCGCUUAUUUAUCGGAGAAAUCCGAUAAAUAAGAAGCAUCAAAG |
| 2174 | short phage rep, trip mut (U10C) | UACUGGCGCCUUUAUCUCAUUACUUUGAGAGCCAUCACCAGCGACUAUGUCGUAUGGGUAAAGCGCGGACGACCUCUCGGUCGUCCGAAGCAUCAAAG |
| 2175 | extra truncated stem loop | UACUGGCGCUUUUAUCUCAUUACUUUGAGAGCCAUCACCAGCGACUAUGUCGUAUGGGUAAAGCGCCGGACUUCGGUCCGGAAGCAUCAAAG |
| 2176 | U17G, C18G | UACUGGCGCUUUUAUCGGAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2177 | short phage rep | UACUGGCGCUUUUAUCUCAUUACUUUGAGAGCCAUCACCAGCGACUAUGUCGUAUGGGUAAAGCGCGGACGACCUCUCGGUCGUCCGAAGCAUCAAAG |
| 2178 | uvsX, C18G, -1 A2G | GCUGGCGCUUUUAUCUGAUUACUUUGAGAGCCAUCACCAGCGACUAUGUCGUAUGGGUAAAGCGCCCUCUUCGGAGGGAAGCAUCAAAG |
| 2179 | uvsX, C18G, trip mut (U10C), -1 A2G, HDV -99 G65U | GCUGGCGCCUUUAUCUGAUUACUUUGAGAGCCAUCACCAGCGACUAUGUCGUAUGGGUAAAGCUCCCUCUUCGGAGGGAGCAUCAAAG |
| 2180 | 3' HDV antigenomic ribozyme | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAGGGGUCGGCAUGGCAUCUCCACCUCCUCGCGGUCCGACCUGGGCAUCCGAAGGAGGACGCACGUCCACUCGGAUGGCUAAGGGAGAGCCA |

TABLE 2-continued

| SEQ ID NO: | NAME or Modification | NUCLEOTIDE SEQUENCE |
|---|---|---|
| Exemplary gNA Scaffold Sequences | | |
| 2181 | uvsX, C18G, trip mut (U10C), -1 A2G, HDV AA(98:99)C | GCUGGCGCCUUUAUCUGAUUACUUUGAGAGCCAUCACCAGCGACUAUGUCGUAUGGGUAAAGCGCCCUCUUCGGAGGGCGCAUCAAAG |
| 2182 | 3' HDV ribozyme (Lior Nissim, Timothy Lu) | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAGUUUUGGCCGGCAUGGUCCCAGCCUCCUCGCUGGCGCCGGCUGGGCAACAUGCUUCGGCAUGGCGAAUGGGACCCCGGG |
| 2183 | TAC(1:3)GA, stacked onto 64 | GAUGGCGCCUUUAUCUCAUUACUUUGAGAGCCAUCACCAGCGACUAUGUCGUAUGGGUAAAGCGCUUACGGACUUCGGUCCGUAAGAAGCAUCAAAG |
| 2184 | uvsX, -1 A2G | GCUGGCGCUUUUAUCUCAUUACUUUGAGAGCCAUCACCAGCGACUAUGUCGUAUGGGUAAAGCGCCCUCUUCGGAGGGAAGCAUCAAAG |
| 2185 | truncated stem loop, C18G, trip mut (U10C), -1 A2G, HDV -99 G65U | GCUGGCGCCUUUAUCUGAUUACUUUGAGAGCCAUCACCAGCGACUAUGUCGUAUGGGUAAAGCUCUUACGGACUUCGGUCCGUAAGAGCAUCAAAG |
| 2186 | short phage rep, C18G, trip mut (U10C), -1 A2G, HDV -99 G65U | GCUGGCGCCUUUAUCUGAUUACUUUGAGAGCCAUCACCAGCGACUAUGUCGUAUGGGUAAAGCUCGGACGACCUCUCGGUCGUCCGAGCAUCAAAG |
| 2187 | 3' sTRSV WT viral Hammerhead ribozyme | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAGCCUGUCACCGGAUGUGCUUUCCGGUCUGAUGAGUCCGUGAGGACGAAACAGG |
| 2188 | short phage rep, C18G, -1 A2G | GCUGGCGCUUUUAUCUGAUUACUUUGAGAGCCAUCACCAGCGACUAUGUCGUAUGGGUAAAGCGCGGACGACCUCUCGGUCGUCCGAAGCAUCAAAG |
| 2189 | short phage rep, C18G, trip mut (U10C), -1 A2G, 3' genomic HDV | GCUGGCGCCUUUAUCUGAUUACUUUGAGAGCCAUCACCAGCGACUAUGUCGUAUGGGUAAAGCGCGGACGACCUCUCGGUCGUCCGAAGCAUCAAAG |
| 2190 | phage rep loop, C18G, trip mut (U10C), -1 A2G, HDV -99 G65U | GCUGGCGCCUUUAUCUGAUUACUUUGAGAGCCAUCACCAGCGACUAUGUCGUAUGGGUAAAGCUCAGGUGGGACGACCUCUCGGUCGUCCUAUCUGAGCAUCAAAG |
| 2191 | 3' HDV ribozyme (Owen Ryan, Jamie Cate) | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAGGAUGGCCGGCAUGGUCCCAGCCUCCUCGCUGGCGCCGGCUGGGCAACACCUUCGGGUGGCGAAUGGGAC |
| 2192 | phage rep loop, C18G, -1 A2G | GCUGGCGCUUUUAUCUGAUUACUUUGAGAGCCAUCACCAGCGACUAUGUCGUAUGGGUAAAGCGCAGGUGGGACGACCUCUCGGUCGUCCUAUCUGAAGCAUCAAAG |
| 2193 | 0.14 | UACUGGCGCUUUUAUCUCAUUACUUUGAGAGCCAUCACCAGCGACUAUGUCGUACUGGGUAAAGCGCUUAUUUAUCGGAGAGAAAUCCGAUAAAUAAGAAGCAUCAAAG |
| 2194 | -78, G77U | UACUGGCGCUUUUAUCUCAUUACUUUGAGAGCCAUCACCAGCGACUAUGUCGUAUGGGUAAAGCGCUUAUUUAUCGUGAGAAAUCCGAUAAAUAAGAAGCAUCAAAG |

TABLE 2-continued

Exemplary gNA Scaffold Sequences

| SEQ ID NO: | NAME or Modification | NUCLEOTIDE SEQUENCE |
|---|---|---|
| 2195 | | GUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2196 | short phage rep, -1 A2G | GCUGGCGCUUUUAUCUCAUUACUUUGAGAGCCAUCACCAGCGACUAUGUCGUAUGGGUAAAGCGCGGACGACCUCUCGGUCGUCCGAAGCAUCAAAG |
| 2197 | truncated stem loop, C18G, trip mut (U10C), -1 A2G | GCUGGCGCCUUUAUCUGAUUACUUUGAGAGCCAUCACCAGCGACUAUGUCGUAUGGGUAAAGCGCUUACGGACUUCGGUCCGUAAGAAGCAUCAAAG |
| 2198 | -1, A2G | GCUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2199 | truncated stem loop, trip mut (U10C), -1 A2G | GCUGGCGCCUUUAUCUCAUUACUUUGAGAGCCAUCACCAGCGACUAUGUCGUAUGGGUAAAGCGCUUACGGACUUCGGUCCGUAAGAAGCAUCAAAG |
| 2200 | uvsX, C18G, trip mut (U10C), -1 A2G | GCUGGCGCCUUUAUCUGAUUACUUUGAGAGCCAUCACCAGCGACUAUGUCGUAUGGGUAAAGCGCCCUCUUCGGAGGGAAGCAUCAAAG |
| 2201 | phage rep loop, -1 A2G | GCUGGCGCUUUUAUCUCAUUACUUUGAGAGCCAUCACCAGCGACUAUGUCGUAUGGGUAAAGCGCAGGUGGGACGACCUCUCGGUCGUCCUAUCUGAAGCAUCAAAG |
| 2202 | phage rep loop, trip mut (U10C), -1 A2G | GCUGGCGCCUUUAUCUCAUUACUUUGAGAGCCAUCACCAGCGACUAUGUCGUAUGGGUAAAGCGCAGGUGGGACGACCUCUCGGUCGUCCUAUCUGAAGCAUCAAAG |
| 2203 | phage rep loop, C18G, trip mut (U10C), -1 A2G | GCUGGCGCCUUUAUCUGAUUACUUUGAGAGCCAUCACCAGCGACUAUGUCGUAUGGGUAAAGCGCAGGUGGGACGACCUCUCGGUCGUCCUAUCUGAAGCAUCAAAG |
| 2204 | truncated stem loop, C18G | UACUGGCGCUUUUAUCUGAUUACUUUGAGAGCCAUCACCAGCGACUAUGUCGUAUGGGUAAAGCGCUUACGGACUUCGGUCCGUAAGAAGCAUCAAAG |
| 2205 | uvsX, trip mut (U10C), -1 A2G | GCUGGCGCCUUUAUCUCAUUACUUUGAGAGCCAUCACCAGCGACUAUGUCGUAUGGGUAAAGCGCCCUCUUCGGAGGGAAGCAUCAAAG |
| 2206 | truncated stem loop, -1 A2G | GCUGGCGCUUUUAUCUCAUUACUUUGAGAGCCAUCACCAGCGACUAUGUCGUAUGGGUAAAGCGCUUACGGACUUCGGUCCGUAAGAAGCAUCAAAG |
| 2207 | short phage rep, trip mut (U10C), -1 A2G | GCUGGCGCCUUUAUCUCAUUACUUUGAGAGCCAUCACCAGCGACUAUGUCGUAUGGGUAAAGCGCGGACGACCUCUCGGUCGUCCGAAGCAUCAAAG |
| 2208 | 5' HDV ribozyme (Owen Ryan, Jamie Cate) | GAUGGCCGGCAUGGUCCCAGCCUCCUCGCUGGCGCCGGCUGGGCAACACCUUCGGGUGGCGAAUGGGACUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2209 | 5' HDV genomic ribozyme | GGCCGGCAUGGUCCCAGCCUCCUCGCUGGCGCCGGCUGGGCAACAUUCCGAGGGGACCGUCCCCUCGGUAAUGGCGAAUGGGACCCUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |

TABLE 2-continued

Exemplary gNA Scaffold Sequences

| SEQ ID NO: | NAME or Modification | NUCLEOTIDE SEQUENCE |
|---|---|---|
| 2210 | truncated stem loop, C18G, trip mut (U10C), -1 A2G, HDV AA(98:99)C | GCUGGCGCCUUUAUCUGAUUACUUUGAGAGCCAUCACCAGCGACUAUGUCGUAUGGGUAAAGCGCUUACGGACUUCGGUCCGUAAGCGCAUCAAAG |
| 2211 | 5' env25 pistol ribozyme (with an added CUUCGG loop) | CGUGGUUAGGGCCACGUUAAAUAGUUGCUUAAGCCCUAAGCGUUGAUCUUCGGAUCAGGUGCAAUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2212 | 5' HDV antigenomic ribozyme | GGGUCGGCAUGGCAUCUCCACCUCCUCGCGGUCCGACCUGGGCAUCCGAAGGAGGACGCACGUCCACUCGGAUGGCUAAGGGAGAGCCAUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2213 | 3' Hammerhead ribozyme (Lior Nissim, Timothy Lu) guide scaffold scar | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAGCCAGUACUGAUGAGUCCGUGAGGACGAAACGAGUAAGCUCGUCUACUGGCGCUUUUAUCUCAU |
| 2214 | =+A27, stacked onto 64 | UACUGGCGCCUUUAUCUCAUUACUUUAGAGAGCCAUCACCAGCGACUAUGUCGUAUGGGUAAAGCGCUUACGGACUUCGGUCCGUAAGAAGCAUCAAAG |
| 2215 | 5' Hammerhead ribozyme (Lior Nissim, Timothy Lu) smaller scar | CGACUACUGAUGAGUCCGUGAGGACGAAACGAGUAAGCUCGUCUAGUCGUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2216 | phage rep loop, C18G, trip mut (U10C), -1 A2G, HDV AA(98:99)C | GCUGGCGCCUUUAUCUGAUUACUUUGAGAGCCAUCACCAGCGACUAUGUCGUAUGGGUAAAGCGCAGGUGGGACGACCUCUCGGUCGUCCUAUCUGCGCAUCAAAG |
| 2217 | -27, stacked onto 64 | UACUGGCGCCUUUAUCUCAUUACUUUAGAGCCAUCACCAGCGACUAUGUCGUAUGGGUAAAGCGCUUACGGACUUCGGUCCGUAAGAAGCAUCAAAG |
| 2218 | 3' Hatchet | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAGCAUUCCUCAGAAAAUGACAAACCUGUGGGGCGUAAGUAGAUCUUCGGAUCUAUGAUCGUGCAGACGUUAAAAUCAGGU |
| 2219 | 3' Hammerhead ribozyme (Lior Nissim, Timothy Lu) | UACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAGCGACUACUGAUGAGUCCGUGAGGACGAAACGAGUAAGCUCGUCUAGUCGCGUGUAGCGAAGCA |
| 2220 | 5' Hatchet | CAUUCCUCAGAAAAUGACAAACCUGUGGGGCGUAAGUAGAUCUUCGGAUCUAUGAUCGUGCAGACGUUAAAAUCAGGUUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |
| 2221 | 5' HDV ribozyme (Lior Nissim, Timothy Lu) | UUUUGGCCGGCAUGGUCCCAGCCUCCUCGCUGGCGCCGGCUGGGCAACAUGCUUCGGCAUGGCGAAUGGGACCCCGGGUACUGGCGCUUUUAUCUCAUUACUUUGAGAGCCAUCACCAGCGACUAUGUCGUAUGGGUAAAGCGCUUAUUUAUCGGAGAGAAAUCCGAUAAAUAAGAAGCAUCAAAG |

TABLE 2-continued

| SEQ ID NO: | NAME or Modification | NUCLEOTIDE SEQUENCE |
|---|---|---|
| | Exemplary gNA Scaffold Sequences | |
| 2222 | 5' Hammerhead ribozyme (Lior Nissim, Timothy Lu) | CGACUACUGAUGAGUCCGUGAGGACGAAACGAGUAAGCUCGUCUAGU CGCGUGUAGCGAAGCAUACUGGCGCUUUUAUCUCAUUACUUUGAGAG CCAUCACCAGCGACUAUGUCGUAUGGGUAAAGCGCUUAUUUAUCGGA GAGAAAUCCGAUAAAUAAGAAGCAUCAAAG |
| 2223 | 3' HH15 Minimal Hammerhead ribozyme | UACUGGCGCUUUUAUCUCAUUACUUUGAGAGCCAUCACCAGCGACUA UGUCGUAUGGGUAAAGCGCUUAUUUAUCGGAGAGAAAUCCGAUAAAU AAGAAGCAUCAAAGGGGAGCCCCGCUGAUGAGGUCGGGGAGACCGAA AGGGACUUCGGUCCCUACGGGGCUCCC |
| 2224 | 5' RBMX recruiting motif | CCACCCCCACCACCACCCCCACCCCCACCACCACCCUACUGGCGCUU UUAUCUCAUUACUUUGAGAGCCAUCACCAGCGACUAUGUCGUAUGGG UAAAGCGCUUAUUUAUCGGAGAGAAAUCCGAUAAAUAAGAAGCAUCA AAG |
| 2225 | 3' Hammerhead ribozyme (Lior Nissim, Timothy Lu) smaller scar | UACUGGCGCUUUUAUCUCAUUACUUUGAGAGCCAUCACCAGCGACUA UGUCGUAUGGGUAAAGCGCUUAUUUAUCGGAGAGAAAUCCGAUAAAU AAGAAGCAUCAAAGCGACUACUGAUGAGUCCGUGAGGACGAAACGAG UAAGCUCGUCUAGUCG |
| 2226 | 3' env25 pistol ribozyme (with an added CUUCGG loop) | UACUGGCGCUUUUAUCUCAUUACUUUGAGAGCCAUCACCAGCGACUA UGUCGUAUGGGUAAAGCGCUUAUUUAUCGGAGAGAAAUCCGAUAAAU AAGAAGCAUCAAAGCGUGGUUAGGGCCACGUUAAAUAGUUGCUUAAG CCCUAAGCGUUGAUCUUCGGAUCAGGUGCAA |
| 2227 | 3' Env-9 Twister | UACUGGCGCUUUUAUCUCAUUACUUUGAGAGCCAUCACCAGCGACUA UGUCGUAUGGGUAAAGCGCUUAUUUAUCGGAGAGAAAUCCGAUAAAU AAGAAGCAUCAAAGGGCAAUAAAGCGGUUACAAGCCCGCAAAAAUAG CAGAGUAAUGUCGCGAUAGCGCGGCAUUAAUGCAGCUUUAUUG |
| 2228 | =+AUUAUC UCAUUACU 25 | UACUGGCGCUUUUAUCUCAUUACUAUUAUCUCAUUACUUUGAGAGCC AUCACCAGCGACUAUGUCGUAUGGGUAAAGCGCUUAUUUAUCGGAGA GAAAUCCGAUAAAUAAGAAGCAUCAAAG |
| 2229 | 5' Env-9 Twister | GGCAAUAAAGCGGUUACAAGCCCGCAAAAAUAGCAGAGUAAUGUCGC GAUAGCGCGGCAUUAAUGCAGCUUUAUUGUACUGGCGCUUUUAUCUC AUUACUUUGAGAGCCAUCACCAGCGACUAUGUCGUAUGGGUAAAGCG CUUAUUUAUCGGAGAGAAAUCCGAUAAAUAAGAAGCAUCAAAG |
| 2230 | 3' Twisted Sister 1 | UACUGGCGCUUUUAUCUCAUUACUUUGAGAGCCAUCACCAGCGACUA UGUCGUAUGGGUAAAGCGCUUAUUUAUCGGAGAGAAAUCCGAUAAAU AAGAAGCAUCAAAGACCCGCAAGGCCGACGGCAUCCGCCGCCGCUGG UGCAAGUCCAGCCGCCCCUUCGGGGGCGGGCGCUCAUGGGUAAC |
| 2231 | no stem | UACUGGCGCUUUUAUCUCAUUACUUUGAGAGCCAUCACCAGCGACUA UGUCGUAUGGGUAAAG |
| 2232 | 5' HH15 Minimal Hammerhead ribozyme | GGGAGCCCCGCUGAUGAGGUCGGGGAGACCGAAAGGGACUUCGGUCC CUACGGGGCUCCCUACUGGCGCUUUUAUCUCAUUACUUUGAGAGCCA UCACCAGCGACUAUGUCGUAUGGGUAAAGCGCUUAUUUAUCGGAGAG AAAUCCGAUAAAUAAGAAGCAUCAAAG |
| 2233 | 5' Hammerhead ribozyme (Lior Nissim, Timothy Lu) guide scaffold scar | CCAGUACUGAUGAGUCCGUGAGGACGAAACGAGUAAGCUCGUCUACU GGCGCUUUUAUCUCAUUACUGGCGCUUUUAUCUCAUUACUUUGAGAG CCAUCACCAGCGACUAUGUCGUAUGGGUAAAGCGCUUAUUUAUCGGA GAGAAAUCCGAUAAAUAAGAAGCAUCAAAG |
| 2234 | 5' Twisted Sister 1 | ACCCGCAAGGCCGACGGCAUCCGCCGCCGCUGGUGCAAGUCCAGCCG CCCCUUCGGGGGCGGGCGCUCAUGGGUAACUACUGGCGCUUUUAUCU CAUUACUUUGAGAGCCAUCACCAGCGACUAUGUCGUAUGGGUAAAGC GCUUAUUUAUCGGAGAGAAAUCCGAUAAAUAAGAAGCAUCAAAG |
| 2235 | 5' sTRSV WT viral Hammerhead ribozyme | CCUGUCACCGGAUGUGCUUUCCGGUCUGAUGAGUCCGUGAGGACGAA ACAGGUACUGGCGCUUUUAUCUCAUUACUUUGAGAGCCAUCACCAGC GACUAUGUCGUAUGGGUAAAGCGCUUAUUUAUCGGAGAGAAAUCCGA UAAAUAAGAAGCAUCAAAG |

TABLE 2-continued

Exemplary gNA Scaffold Sequences

| SEQ ID NO: | NAME or Modification | NUCLEOTIDE SEQUENCE |
|---|---|---|
| 2236 | 148: =+G55, stacked onto 64 | GUACUGGCGCCUUUAUCUCAUUACUUUGAGAGCCAUCACCAGCGACUAUGUCGUAGUGGGUAAAGCGCUUACGGACUUCGGUCCGUAAGAAGCAUCAAAG |
| 2237 | 158: 103 + 148(+G55) -99, G65U | GUACUGGCGCUUUUAUCUGAUUACUUUGAGAGCCAUCACCAGCGACUAUGUCGUAGUGGGUAAAGCUCCCUCUUCGGAGGGAGCAUCAAAG |
| 2238 | 174: Uvsx Extended stem with [A99] G65U), C18G, G55, [GU-1] | ACUGGCGCUUUUAUCUGAUUACUUUGAGAGCCAUCACCAGCGACUAUGUCGUAGUGGGUAAAGCUCCCUCUUCGGAGGGAGCAUCAAAG |
| 2239 | 175: extended stem truncation, U10C, [GU-1] | ACUGGCGCCUUUAUCUCAUUACUUUGAGAGCCAUCACCAGCGACUAUGUCGUAUGGGUAAAGCGCUUACGGACUUCGGUCCGUAAGAAGCAUCAAAG |
| 2240 | 176: 174 with A1G substitution for T7 transcription | GCUGGCGCUUUUAUCUGAUUACUUUGAGAGCCAUCACCAGCGACUAUGUCGUAGUGGGUAAAGCUCCCUCUUCGGAGGGAGCAUCAAAG |
| 2241 | 177: 174 with bubble (+G55) removed | ACUGGCGCUUUUAUCUGAUUACUUUGAGAGCCAUCACCAGCGACUAUGUCGUAUGGGUAAAGCUCCCUCUUCGGAGGGAGCAUCAAAG |
| 2242 | 181: stem 42 (truncated stem loop); U10C, C18G, [GU-1] (95 + [GU-1]) | ACUGGCGCCUUUAUCUGAUUACUUUGAGAGCCAUCACCAGCGACUAUGUCGUAUGGGUAAAGCGCUUACGGACUUCGGUCCGUAAGAAGCAUCAAAG |
| 2243 | 182: stem 42 (truncated stem loop); C18G, [GU-1] | ACUGGCGCUUUUAUCUGAUUACUUUGAGAGCCAUCACCAGCGACUAUGUCGUAUGGGUAAAGCGCUUACGGACUUCGGUCCGUAAGAAGCAUCAAAG |
| 2244 | 183: stem 42 (truncated stem loop); C18G, G55, [GU-1] | ACUGGCGCUUUUAUCUGAUUACUUUGAGAGCCAUCACCAGCGACUAUGUCGUAGUGGGUAAAGCGCUUACGGACUUCGGUCCGUAAGAAGCAUCAAAG |
| 2245 | 184: stem 48 (uvsx, -99 g65t); C18G, T55, [GU-1] | ACUGGCGCUUUUAUCUGAUUACUUUGAGAGCCAUCACCAGCGACUAUGUCGUAUUGGGUAAAGCUCCCUCUUCGGAGGGAGCAUCAAAG |
| 2246 | 185: stem 42 (truncated stem loop); C18G, U55, [GU-1] | ACUGGCGCUUUUAUCUGAUUACUUUGAGAGCCAUCACCAGCGACUAUGUCGUAUUGGGUAAAGCGCUUACGGACUUCGGUCCGUAAGAAGCAUCAAAG |
| 2247 | 186: stem 42 (truncated stem loop); U10C, A17, [GU-1] | ACUGGCGCCUUUAUCAUCAUUACUUUGAGAGCCAUCACCAGCGACUAUGUCGUAUGGGUAAAGCGCUUACGGACUUCGGUCCGUAAGAAGCAUCAAAG |
| 2248 | 187: stem 46 (uvsx); C18G, G55, [GU-1] | ACUGGCGCUUUUAUCUGAUUACUUUGAGAGCCAUCACCAGCGACUAUGUCGUAGUGGGUAAAGCGCCCUCUUCGGAGGGAAGCAUCAAAG |

TABLE 2-continued

| Exemplary gNA Scaffold Sequences | | |
|---|---|---|
| SEQ ID NO: | NAME or Modification | NUCLEOTIDE SEQUENCE |
| 2249 | 188: stem 50 (ms2 U15C, -99, g65t); C18G, G55, [GU-1] | ACUGGCGCUUUUAUCUGAUUACUUUGAGAGCCAUCACCAGCGACUAUGUCGUAGUGGGUAAAGCUCACAUGAGGAUCACCCAUGUGAGCAUCAAAG |
| 2250 | 189: 174 + G8A; U15C; U35A | ACUGGCACUUUUACCUGAUUACUUUGAGAGCCAACACCAGCGACUAUGUCGUAGUGGGUAAAGCUCCCUCUUCGGAGGGAGCAUCAAAG |
| 2251 | 190: 174 + G8A | ACUGGCACUUUUAUCUGAUUACUUUGAGAGCCAUCACCAGCGACUAUGUCGUAGUGGGUAAAGCUCCCUCUUCGGAGGGAGCAUCAAAG |
| 2252 | 191: 174 + G8C | ACUGGCCCUUUUAUCUGAUUACUUUGAGAGCCAUCACCAGCGACUAUGUCGUAGUGGGUAAAGCUCCCUCUUCGGAGGGAGCAUCAAAG |
| 2253 | 192: 174 + U15C | ACUGGCGCUUUUACCUGAUUACUUUGAGAGCCAUCACCAGCGACUAUGUCGUAGUGGGUAAAGCUCCCUCUUCGGAGGGAGCAUCAAAG |
| 2254 | 193, 174 + U35A | ACUGGCGCUUUUAUCUGAUUACUUUGAGAGCCAACACCAGCGACUAUGUCGUAGUGGGUAAAGCUCCCUCUUCGGAGGGAGCAUCAAAG |
| 2255 | 195:175 + C18G + G8A; U15C; U35A | ACUGGCACCUUUACCUGAUUACUUUGAGAGCCAACACCAGGGACUAUGUCGUAUGGGUAAAGCGCUUACGGACUUCGGUCCGUAAGAAGCAUCAAAG |
| 2256 | 196: 175 + C18G + G8A | ACUGGCACCUUUAUCUGAUUACUUUGAGAGCCAUCACCAGCGACUAUGUCGUAUGGGUAAAGCGCUUACGGACUUCGGUCCGUAAGAAGCAUCAAAG |
| 2257 | 197: 175 + C18G + G8C | ACUGGCCCCUUUAUCUGAUUACUUUGAGAGCCAUCACCAGCGACUAUGUCGUAUGGGUAAAGCGCUUACGGACUUCGGUCCGUAAGAAGCAUCAAAG |
| 2258 | 198: 175 + C18G + U35A | ACUGGCGCCUUUAUCUGAUUACUUUGAGAGCCAACACCAGCGACUAUGUCGUAUGGGUAAAGCGCUUACGGACUUCGGUCCGUAAGAAGCAUCAAAG |
| 2259 | 199: 174 + A2G (test G transcription at start; ccGCT . . .) | GCUGGCGCUUUUAUCUGAUUACUUUGAGAGCCAUCACCAGCGACUAUGUCGUAGUGGGUAAAGCUCCCUCUUCGGAGGGAGCAUCAAAG |
| 2260 | 200: 174 + G1 (ccGACU . . .) | GACUGGCGCUUUUAUCUGAUUACUUUGAGAGCCAUCACCAGCGACUAUGUCGUAGUGGGUAAAGCUCCCUCUUCGGAGGGAGCAUCAAAG |
| 2261 | 201: 174 + U10C; G28 | ACUGGCGCCUUUAUCUGAUUACUUUGGAGAGCCAUCACCAGCGACUAUGUCGUAGUGGGUAAAGCUCCCUCUUCGGAGGGAGCAUCAAAG |
| 2262 | 202: 174 + U10A; A28U | ACUGGCGCAUUUAUCUGAUUACUUUGUGAGCCAUCACCAGCGACUAUGUCGUAGUGGGUAAAGCUCCCUCUUCGGAGGGAGCAUCAAAG |
| 2263 | 203: 174 + U10C | ACUGGCGCCUUUAUCUGAUUACUUUGAGAGCCAUCACCAGCGACUAUGUCGUAGUGGGUAAAGCUCCCUCUUCGGAGGGAGCAUCAAAG |
| 2264 | 204: 174 + G28 | ACUGGCGCUUUUAUCUGAUUACUUUGGAGAGCCAUCACCAGCGACUAUGUCGUAGUGGGUAAAGCUCCCUCUUCGGAGGGAGCAUCAAAG |
| 2265 | 205: 174 + U10A | ACUGGCGCAUUUAUCUGAUUACUUUGAGAGCCAUCACCAGCGACUAUGUCGUAGUGGGUAAAGCUCCCUCUUCGGAGGGAGCAUCAAAG |
| 2266 | 206, 174 + A28U | ACUGGCGCUUUUAUCUGAUUACUUUGUGAGCCAUCACCAGCGACUAUGUCGUAGUGGGUAAAGCUCCCUCUUCGGAGGGAGCAUCAAAG |
| 2267 | 207: 174 + U15 | ACUGGCGCUUUUAUUCUGAUUACUUUGAGAGCCAUCACCAGCGACUAUGUCGUAGUGGGUAAAGCUCCCUCUUCGGAGGGAGCAUCAAAG |
| 2268 | 208: 174 + [U4] | ACGGCGCUUUUAUCUGAUUACUUUGAGAGCCAUCACCAGCGACUAUGUCGUAGUGGGUAAAGCUCCCUCUUCGGAGGGAGCAUCAAAG |

TABLE 2-continued

Exemplary gNA Scaffold Sequences

| SEQ ID NO: | NAME or Modification | NUCLEOTIDE SEQUENCE |
|---|---|---|
| 2269 | 209: 174 + C16A | ACUGGCGCUUUUAUAUGAUUACUUUGAGAGCCAUCACCAGCGACUAU GUCGUAGUGGGUAAAGCUCCCUCUUCGGAGGGAGCAUCAAAG |
| 2270 | 210: 174 + U17 | ACUGGCGCUUUUAUCUUGAUUACUUUGAGAGCCAUCACCAGCGACUA UGUCGUAGUGGGUAAAGCUCCCUCUUCGGAGGGAGCAUCAAAG |
| 2271 | 211: 174 + U35G (compare with 174 + U35A above) | ACUGGCGCUUUUAUCUGAUUACUUUGAGAGCCAGCACCAGCGACUAU GUCGUAGUGGGUAAAGCUCCCUCUUCGGAGGGAGCAUCAAAG |
| 2272 | 212: 174 + U11G, A105G (A86G), U26C | ACUGGCGCUGUUAUCUGAUUACUUCGAGAGCCAUCACCAGCGACUAU GUCGUAGUGGGUAAAGCUCCCUCUUCGGAGGGAGCAUCGAAG |
| 2273 | 213: 174 + U11C, A105G (A86G), U26C | ACUGGCGCUCUUAUCUGAUUACUUCGAGAGCCAUCACCAGCGACUAU GUCGUAGUGGGUAAAGCUCCCUCUUCGGAGGGAGCAUCGAAG |
| 2274 | 214: 174 + U12G; A106G (A87G), U25C | ACUGGCGCUUGUAUCUGAUUACUCUGAGAGCCAUCACCAGCGACUAU GUCGUAGUGGGUAAAGCUCCCUCUUCGGAGGGAGCAUCAGAG |
| 2275 | 215: 174 + U12C; A106G (A87G), U25C | ACUGGCGCUUCUAUCUGAUUACUCUGAGAGCCAUCACCAGCGACUAU GUCGUAGUGGGUAAAGCUCCCUCUUCGGAGGGAGCAUCAGAG |
| 2276 | 216: 174_tx_11.G, 87.G, 22.C | ACUGGCGCUUUGAUCUGAUUACCUUGAGAGCCAUCACCAGCGACUAU GUCGUAGUGGGUAAAGCUCCCUCUUCGGAGGGAGCAUCAAGG |
| 2277 | 217: 174_tx_11.C, 87.G, 22.C | ACUGGCGCUUUCAUCUGAUUACCUUGAGAGCCAUCACCAGCGACUAU GUCGUAGUGGGUAAAGCUCCCUCUUCGGAGGGAGCAUCAAGG |
| 2278 | 218: 174 + U11G | ACUGGCGCUGUUAUCUGAUUACUUUGAGAGCCAUCACCAGCGACUAU GUCGUAGUGGGUAAAGCUCCCUCUUCGGAGGGAGCAUCAAAG |
| 2279 | 219: 174+ A105G (A86G) | ACUGGCGCUUUUAUCUGAUUACUUUGAGAGCCAUCACCAGCGACUAU GUCGUAGUGGGUAAAGCUCCCUCUUCGGAGGGAGCAUCGAAG |
| 2280 | 220: 174 + U26C | ACUGGCGCUUUUAUCUGAUUACUUCGAGAGCCAUCACCAGCGACUAU GUCGUAGUGGGUAAAGCUCCCUCUUCGGAGGGAGCAUCAAAG |

In some embodiments, the gNA variant comprises a tracrRNA stem loop comprising the sequence -UUU-N4-25-UUU- (SEQ ID NO: 34). For example, the gNA variant comprises a scaffold stem loop or a replacement thereof, flanked by two triplet U motifs that contribute to the triplex region. In some embodiments, the scaffold stem loop or replacement thereof comprises at least 4 nucleotides, at least 5 nucleotides, at least 6 nucleotides, at least 7 nucleotides, at least 7 nucleotides, at least 8 nucleotides, at least 9 nucleotides, at least 10 nucleotides, at least 11 nucleotides, at least 12 nucleotides, at least 13 nucleotides, at least 14 nucleotides, at least 15 nucleotides, at least 16 nucleotides, at least 17 nucleotides, at least 18 nucleotides, at least 19 nucleotides, at least 20 nucleotides, at least 21 nucleotides, at least 22 nucleotides, at least 23 nucleotides, at least 24 nucleotides, or at least 25 nucleotides.

In some embodiments, the gNA variant comprises a crRNA sequence with -AAAG- in a location 5' to the spacer region. In some embodiments, the -AAAG- sequence is immediately 5' to the spacer region.

In some embodiments, the at least one nucleotide modification to a reference gNA to produce a gNA variant comprises at least one nucleotide deletion in the CasX variant gNA relative to the reference gRNA. In some embodiments, a gNA variant comprises a deletion of 1, 2, 3, 4, 5, 6, 7, 8, 9, 10, 11, 12, 13, 14, 15, 16, 17, 18, 19 or 20 consecutive or non-consecutive nucleotides relative to a reference gNA. In some embodiments, the at least one deletion comprises a deletion of 1, 2, 3, 4, 5, 6, 7, 8, 9, 10, 11, 12, 13, 14, 15, 16, 17, 18, 19 or 20 or more consecutive nucleotides relative to a reference gNA. In some embodiments, the gNA variant comprises 2, 3, 4, 5, 6, 7, 8, 9, 10, 11, 12, 13, 14, 15, 16, 17, 18, 19 or 20 or more nucleotide deletions relative to the reference gNA, and the deletions are not in consecutive nucleotides. In those embodiments where there are two or more non-consecutive deletions in the gNA variant relative to the reference gRNA, any length of deletions, and any combination of lengths of deletions, as described herein, are contemplated as within the scope of the disclosure. For example, in some embodiments, a gNA variant may comprise a first deletion of one nucleotide, and a second deletion of two nucleotides and the two deletions are not consecutive. In some embodiments, a gNA variant comprises at least two deletions in different regions of the reference gRNA. In some embodiments, a gNA variant comprises at least two deletions in the same region of the reference gRNA. For example, the regions may be the extended stem loop, scaffold stem loop, scaffold stem bubble, triplex loop, pseudoknot, triplex, or a 5' end of the gNA variant. The deletion of any nucleotide in a reference gRNA is contemplated as within the scope of the disclosure.

In some embodiments, the at least one nucleotide modification of a reference gRNA to generate a gNA variant comprises at least one nucleotide insertion. In some embodiments, a gNA variant comprises an insertion of 1, 2, 3, 4, 5, 6, 7, 8, 9 or 10 consecutive or non-consecutive nucleotides relative to a reference gRNA. In some embodiments, the at least one nucleotide insertion comprises an insertion of 1, 2, 3, 4, 5, 6, 7, 8, 9, 10, 11, 12, 13, 14, 15, 16, 17, 18, 19 or 20 or more consecutive nucleotides relative to a reference gRNA. In some embodiments, the gNA variant comprises 2 or more insertions relative to the reference gRNA, and the insertions are not consecutive. In those embodiments where there are two or more non-consecutive insertions in the gNA variant relative to the reference gRNA, any length of insertions, and any combination of lengths of insertions, as described herein, are contemplated as within the scope of the disclosure. For example, in some embodiments, a gNA variant may comprise a first insertion of one nucleotide, and a second insertion of two nucleotides and the two insertions are not consecutive. In some embodiments, a gNA variant comprises at least two insertions in different regions of the reference gRNA. In some embodiments, a gNA variant comprises at least two insertions in the same region of the reference gRNA. For example, the regions may be the extended stem loop, scaffold stem loop, scaffold stem bubble, triplex loop, pseudoknot, triplex, or a 5' end of the gNA variant. Any insertion of A, G, C, U (or T, in the corresponding DNA) or combinations thereof at any location in the reference gRNA is contemplated as within the scope of the disclosure.

In some embodiments, the at least one nucleotide modification of a reference gRNA to generate a gNA variant comprises at least one nucleic acid substitution. In some embodiments, a gNA variant comprises 1, 2, 3, 4, 5, 6, 7, 8, 9, 10, 11, 12, 13, 14, 15, 16, 17, 18, 19 or 20 or more consecutive or non-consecutive substituted nucleotides relative to a reference gRNA. In some embodiments, a gNA variant comprises 1-4 nucleotide substitutions relative to a reference gRNA. In some embodiments, the at least one substitution comprises a substitution of 1, 2, 3, 4, 5, 6, 7, 8, 9, 10, 11, 12, 13, 14, 15, 16, 17, 18, 19 or 20 or more consecutive nucleotides relative to a reference gRNA. In some embodiments, the gNA variant comprises 2 or more substitutions relative to the reference gRNA, and the substitutions are not consecutive. In those embodiments where there are two or more non-consecutive substitutions in the gNA variant relative to the reference gRNA, any length of substituted nucleotides, and any combination of lengths of substituted nucleotides, as described herein, are contemplated as within the scope of the disclosure. For example, in some embodiments, a gNA variant may comprise a first substitution of one nucleotide, and a second substitution of two nucleotides and the two substitutions are not consecutive. In some embodiments, a gNA variant comprises at least two substitutions in different regions of the reference gRNA. In some embodiments, a gNA variant comprises at least two substitutions in the same region of the reference gRNA. For example, the regions may be the triplex, the extended stem loop, scaffold stem loop, scaffold stem bubble, triplex loop, pseudoknot, triplex, or a 5' end of the gNA variant. Any substitution of A, G, C, U (or T, in the corresponding DNA) or combinations thereof at any location in the reference gRNA is contemplated as within the scope of the disclosure.

Any of the substitutions, insertions and deletions described herein can be combined to generate a gNA variant of the disclosure. For example, a gNA variant can comprise at least one substitution and at least one deletion relative to a reference gRNA, at least one substitution and at least one insertion relative to a reference gRNA, at least one insertion and at least one deletion relative to a reference gRNA, or at least one substitution, one insertion and one deletion relative to a reference gRNA.

In some embodiments, the gNA variant comprises a scaffold region at least 20% identical, at least 30% identical, at least 40% identical, at least 50% identical, at least 60% identical, at least 65% identical, at least 70% identical, at least 75% identical, at least 80% identical, at least 85% identical, at least 90% identical, at least 91% identical, at least 92% identical, at least 93% identical, at least 94% identical, at least 95% identical, at least 96% identical, at least 97% identical, at least 98% identical, or at least 99% identical to any one of SEQ ID NOS:4-16. In some embodiments, the gNA variant comprises a scaffold region at least 60% homologous (or identical) to any one of SEQ ID NOS:4-16.

In some embodiments, the gNA variant comprises a tracr stem loop at least 60% identical, at least 65% identical, at least 70% identical, at least 75% identical, at least 80% identical, at least 85% identical, at least 90% identical, at least 91% identical, at least 92% identical, at least 93% identical, at least 94% identical, at least 95% identical, at least 96% identical, at least 97% identical, at least 98% identical, or at least 99% identical to SEQ ID NO:14. In some embodiments, the gNA variant comprises a tracr stem loop at least 60% homologous (or identical) to SEQ ID NO:14.

In some embodiments, the gNA variant comprises an extended stem loop at least 60% identical, at least 65% identical, at least 70% identical, at least 75% identical, at least 80% identical, at least 85% identical, at least 90% identical, at least 91% identical, at least 92% identical, at least 93% identical, at least 94% identical, at least 95% identical, at least 96% identical, at least 97% identical, at least 98% identical, or at least 99% identical to SEQ ID NO:15. In some embodiments, the gNA variant comprises an extended stem loop at least 60% homologous (or identical) to SEQ ID NO:15.

In some embodiments, the gNA variant comprises an exogenous extended stem loop, with such differences from a reference gNA described as follows. In some embodiments, an exogenous extended stem loop has little or no identity to the reference stem loop regions disclosed herein (e.g., SEQ ID NO:15). In some embodiments, an exogenous stem loop is at least 10 bp, at least 20 bp, at least 30 bp, at least 40 bp, at least 50 bp, at least 60 bp, at least 70 bp, at least 80 bp, at least 90 bp, at least 100 bp, at least 200 bp, at least 300 bp, at least 400 bp, at least 500 bp, at least 600 bp, at least 700 bp, at least 800 bp, at least 900 bp, at least 1,000 bp, at least 2,000 bp, at least 3,000 bp, at least 4,000 bp, at least 5,000 bp, at least 6,000 bp, at least 7,000 bp, at least 8,000 bp, at least 9,000 bp, at least 10,000 bp, at least 12,000 bp, at least 15,000 bp or at least 20,000 bp. In some embodiments, the gNA variant comprises an extended stem loop region comprising at least 10, at least 100, at least 500, at least 1000, or at least 10,000 nucleotides. In some embodiments, the heterologous stem loop increases the stability of the gNA. In some embodiments, the heterologous RNA stem loop is capable of binding a protein, an RNA structure, a DNA sequence, or a small molecule. In some embodiments, an exogenous stem loop region comprises an RNA stem loop or hairpin, for example a thermostable RNA such as MS2 (ACAUGAGGAUUACCCAUGU (SEQ ID NO: 35)), QP (UGCAUGUCUAAGACAGCA (SEQ ID NO: 36)), U1 hairpin II (AAUCCAUUGCACUCCGGAUU (SEQ ID NO: 37)), Uvsx (CCUCUUCGGAGG (SEQ ID NO: 38)), PP7 (AGGAGUUUCUAUGGAAACCCU (SEQ ID NO: 39)), Phage replication loop (AGGUGGGACGAC-CUCUCGGUCGUCCUAUCU (SEQ ID NO: 40)), Kissing loop_a (UGCUCGCUCCGUUCGAGCA (SEQ ID NO: 41)), Kissing loop_b1 (UGCUCGACGCGUCCUCGAGCA (SEQ ID NO: 42)), Kissing loop_b2 (UG-CUCGUUUGCGGCUACGAGCA (SEQ ID NO: 43)), G quadriplex M3q (AGGGAGGGAGGGAGAGG (SEQ ID NO: 44)), G quadriplex telomere basket (GGUUAGG-GUUAGGGUUAGG (SEQ ID NO: 45)), Sarcin-ricin loop (CUGCUCAGUACGAGAGGAACCGCAG (SEQ ID NO: 46)) or Pseudoknots (UACACUGGGAUCGCUGAAUUA-GAGAUCGGCGUCCUUUCAUUCUAUAUACUUU GGAGUUUUAAAAUGUCUCUAAGUACA (SEQ ID NO: 47)). In some embodiments, an exogenous stem loop comprises an RNA scaffold. As used herein, an "RNA scaffold" refers to a multi-dimensional RNA structure capable of interacting with and organizing or localizing one or more proteins. In some embodiments, the RNA scaffold is synthetic or non-naturally occurring. In some embodiments, an exogenous stem loop comprises a long non-coding RNA (lncRNA). As used herein, a lncRNA refers to a non-coding RNA that is longer than approximately 200 bp in length. In some embodiments, the 5' and 3' ends of the exogenous stem loop are base paired, i.e., interact to form a region of duplex RNA. In some embodiments, the 5' and 3' ends of the exogenous stem loop are base paired, and one or more regions between the 5' and 3' ends of the exogenous stem loop are not base paired. In some embodiments, the at least one nucleotide modification comprises: (a) substitution of 1 to 15 consecutive or non-consecutive nucleotides in the gNA variant in one or more regions; (b) a deletion of 1 to 10 consecutive or non-consecutive nucleotides in the gNA variant in one or more regions; (c) an insertion of 1 to 10 consecutive or non-consecutive nucleotides in the gNA variant in one or more regions; (d) a substitution of the scaffold stem loop or the extended stem loop with an RNA stem loop sequence from a heterologous RNA source with proximal 5' and 3' ends; or any combination of (a)-(d).

In some embodiments, the gNA variant comprises a scaffold stem loop having at least 60% identity to SEQ ID NO:14. In some embodiments, the gNA variant comprises a scaffold stem loop having at least 60% identity, at least 70% identity, at least 80% identity, at least 90% identity, at least 95% identity, at least 98% identity or at least 99% identity to SEQ ID NO:14. In some embodiments, the gNA variant comprises a scaffold stem loop comprising SEQ ID NO:14.

In some embodiments, the gNA variant comprises a scaffold stem loop sequence of CCAGCGACUAUGU-CGUAGUGG (SEQ ID NO: 32). In some embodiments, the gNA variant comprises a scaffold stem loop sequence of CCAGCGACUAUGUCGUAGUGG (SEQ ID NO: 32) with at least 1, 2, 3, 4, or 5 mismatches thereto.

In some embodiments, the gNA variant comprises an extended stem loop region comprising less than 32 nucleotides, less than 31 nucleotides, less than 30 nucleotides, less than 29 nucleotides, less than 28 nucleotides, less than 27 nucleotides, less than 26 nucleotides, less than 25 nucleotides, less than 24 nucleotides, less than 23 nucleotides, less than 22 nucleotides, less than 21 nucleotides, or less than 20 nucleotides. In some embodiments, the gNA variant comprises an extended stem loop region comprising less than 32 nucleotides. In some embodiments, the gNA variant further comprises a thermostable stem loop.

In some embodiments, a sgRNA variant comprises a sequence of SEQ ID NO:2104, SEQ ID NO:2106, SEQ ID NO:2163, SEQ ID NO:2107, SEQ ID NO:2164, SEQ ID NO:2165, SEQ ID NO:2166, SEQ ID NO:2103, SEQ ID NO:2167, SEQ ID NO:2105, SEQ ID NO:2108, SEQ ID NO:2112, SEQ ID NO:2160, SEQ ID NO:2170, SEQ ID NO:2114, SEQ ID NO:2171, SEQ ID NO:2112, SEQ ID NO:2173, SEQ ID NO:2102, SEQ ID NO:2174, SEQ ID NO:2175, SEQ ID NO:2109, SEQ ID NO:2176, SEQ ID NO:2238, SEQ ID NO:2239, SEQ ID NO:2240, SEQ ID NO:2241, SEQ ID NO:2274, or SEQ ID NO:2275.

In some embodiments, the gNA variant comprises the sequence of any one of SEQ ID NOS:2236, 2237, 2238, 2241, 2244, 2248, 2249, or 2259-2280, or having at least about 80%, at least about 90%, at least about 95%, at least about 96%, at least about 97%, at least about 98%, at least about 99% identity thereto. In some embodiments, the gNA variant comprises one or more additional changes to a sequence of any one of SEQ ID NOs: 2201-2280. In some embodiments, the gNA variant comprises the sequence of any one of SEQ ID NOS:2236, 2237, 2238, 2241, 2244, 2248, 2249, or 2259-2280.

In some embodiments, a sgRNA variant comprises one or more additional changes to a sequence of SEQ ID NO:2104, SEQ ID NO:2163, SEQ ID NO:2107, SEQ ID NO:2164, SEQ ID NO:2165, SEQ ID NO:2166, SEQ ID NO:2103, SEQ ID NO:2167, SEQ ID NO:2105, SEQ ID NO:2108, SEQ ID NO:2112, SEQ ID NO:2160, SEQ ID NO:2170, SEQ ID NO:2114, SEQ ID NO:2171, SEQ ID NO:2112, SEQ ID NO:2173, SEQ ID NO:2102, SEQ ID NO:2174, SEQ ID NO:2175, SEQ ID NO:2109, SEQ ID NO:2176, SEQ ID NO:2238, SEQ ID NO:2239, SEQ ID NO:2240, SEQ ID NO:2241, SEQ ID NO:2274, or SEQ ID NO:2275.

In some embodiments of the gNA variants of the disclosure, the gNA variant comprises at least one modification, wherein the at least one modification compared to the reference guide scaffold of SEQ ID NO:5 is selected from one or more of: (a) a C18G substitution in the triplex loop; (b) a G55 insertion in the stem bubble; (c) a U1 deletion; (d) a modification of the extended stem loop wherein (i) a 6 nt loop and 13 loop-proximal base pairs are replaced by a Uvsx hairpin; and (ii) a deletion of A99 and a substitution of G65U that results in a loop-distal base that is fully base-paired. In such embodiments, the gNA variant comprises the sequence of any one of SEQ ID NOS:2236, 2237, 2238, 2241, 2244, 2248, 2249, or 2259-2280.

In some embodiments, the scaffold of the gNA variant comprises the sequence of any one of SEQ ID NOS:2201-

2280 of Table 2. In some embodiments, the scaffold of the gNA consists or consists essentially of the sequence of any one of SEQ ID NOS:2201-2280. In some embodiments, the scaffold of the gNA variant sequence is at least about 60% identical, at least about 65% identical, at least about 70% identical, at least about 75% identical, at least about 80% identical, at least about 85% identical, at least about 90% identical, at least about 91% identical, at least about 92% identical, at least about 93% identical, at least about 94% identical, at least about 95% identical, at least about 96% identical, at least about 97% identical, at least about 98% identical or at least about 99% identical to any one of SEQ ID NOS:2201 to 2280.

In the embodiments of the gNA variants, the gNA further comprises a spacer (or targeting sequence) region, described more fully, supra, which comprises at least 14 to about 35 nucleotides wherein the spacer is designed with a sequence that is complementary to a target DNA. In some embodiments, the gNA variant comprises a targeting sequence of at least 10 to 30 nucleotides complementary to a target DNA. In some embodiments, the targeting sequence has 14, 15, 16, 17, 18, 19, 20, 21, 22, 23, 24, 25, 26, 27, 28, 29, 30, 31, 32, 33, 34 or 35 nucleotides. In some embodiments, the gNA variant comprises a targeting sequence having 20 nucleotides. In some embodiments, the targeting sequence has 25 nucleotides. In some embodiments, the targeting sequence has 24 nucleotides. In some embodiments, the targeting sequence has 23 nucleotides. In some embodiments, the targeting sequence has 22 nucleotides. In some embodiments, the targeting sequence has 21 nucleotides. In some embodiments, the targeting sequence has 20 nucleotides. In some embodiments, the targeting sequence has 19 nucleotides. In some embodiments, the targeting sequence has 18 nucleotides. In some embodiments, the targeting sequence has 17 nucleotides. In some embodiments, the targeting sequence has 16 nucleotides. In some embodiments, the targeting sequence has 15 nucleotides. In some embodiments, the targeting sequence has 14 nucleotides. In some embodiments, the disclosure provides targeting sequences for inclusion in the gNA variants of the disclosure comprising a sequence that is at least 50% identical, at least 55% identical, at least 60% identical, at least 65% identical, at least 70% identical, at least 75% identical, at least 80% identical, at least 85% identical, at least 90% identical, at least 95% identical, or 100% identical to a sequence in Tables 3A, 3B, or 3C. In some embodiments, the targeting sequence of the gNA variant comprises a sequence a sequence of Tables 3A, 3B, or 3C with a single nucleotide removed from the 3' end of the sequence. In other embodiments, the targeting sequence of the gNA variant comprises a sequence a sequence of Tables 3A, 3B, or 3C with two nucleotides removed from the 3' end of the sequence. In other embodiments, the targeting sequence of the gNA variant comprises a sequence a sequence of Tables 3A, 3B, or 3C with three nucleotides removed from the 3' end of the sequence. In other embodiments, the targeting sequence of the gNA variant comprises a sequence a sequence of Tables 3A, 3B, or 3C with four nucleotides removed from the 3' end of the sequence. In other embodiments, the targeting sequence of the gNA variant comprises a sequence a sequence of Table 3 with five nucleotides removed from the 3' end of the sequence.

Table 3A. gNA Targeting Sequences for B2M

Table 3A is provided in FIG. 35, and is referred to as Table 3A throughout.

Table 3B. gNA Targeting Sequences for TRAC

Table 3B is provided in FIG. 36, and is referred to as Table 3B throughout.

Table 3C: gNA Targeting Sequences for CIITA

Table 3C is provided in FIG. 37, and is referred to as Table 3C throughout.

In Tables 3A, 3B and 3C the left column indicates the PAM sequence, the right column indicates the SEQ ID NO of the corresponding spacer sequence (sometimes referred to herein as a targeting sequence).

In some embodiments, the scaffold of the gNA variant is part of an RNP with a reference CasX protein comprising SEQ ID NO:1, SEQ ID NO:2, or SEQ ID NO:3. In other embodiments, the scaffold of the gNA variant is part of an RNP with a CasX variant protein comprising any one of the sequences of Tables 4, 7, 8, 9, or 11 or a sequence having at least about 50%, at least about 60%, at least about 70%, at least about 80%, at least about 85%, at least about 90%, at least about 91%, at least about 92%, at least about 93%, at least about 94%, at least about 95%, at least about 96%, at least about 97%, at least about 98%, or at least about 99% identity thereto. In the foregoing embodiments, the gNA further comprises a spacer sequence.

In some embodiments, the scaffold of the gNA variant is a variant comprising one or more additional changes to a sequence of a reference gRNA that comprises SEQ ID NO:4 or SEQ ID NO:5. In those embodiments where the scaffold of the reference gRNA is derived from SEQ ID NO:4 or SEQ ID NO:5, the one or more improved or added characteristics of the gNA variant are improved compared to the same characteristic in SEQ ID NO:4 or SEQ ID NO:5.

h. Complex Formation with CasX Protein

In some embodiments, a gNA variant has an improved ability to form a complex with a CasX protein (such as a reference CasX or a CasX variant protein) when compared to a reference gRNA. In some embodiments, a gNA variant has an improved affinity for a CasX protein (such as a reference or variant protein) when compared to a reference gRNA, thereby improving its ability to form a ribonucleoprotein (RNP) complex with the CasX protein, as described in the Examples. Improving ribonucleoprotein complex formation may, in some embodiments, improve the efficiency with which functional RNPs are assembled. In some embodiments, greater than 90%, greater than 93%, greater than 95%, greater than 96%, greater than 97%, greater than 98% or greater than 99% of RNPs comprising a gNA variant and its spacer are competent for gene editing of a target nucleic acid.

Exemplary nucleotide changes that can improve the ability of gNA variants to form a complex with CasX protein may, in some embodiments, include replacing the scaffold stem with a thermostable stem loop. Without wishing to be bound by any theory, replacing the scaffold stem with a thermostable stem loop could increase the overall binding stability of the gNA variant with the CasX protein. Alternatively, or in addition, removing a large section of the stem loop could change the gNA variant folding kinetics and make a functional folded gNA easier and quicker to structurally-assemble, for example by lessening the degree to which the gNA variant can get "tangled" in itself. In some embodiments, choice of scaffold stem loop sequence could change with different spacers that are utilized for the gNA. In some embodiments, scaffold sequence can be tailored to the spacer and therefore the target sequence. Biochemical assays can be used to evaluate the binding affinity of CasX protein for the gNA variant to form the RNP, including the assays of the Examples. For example, a person of ordinary skill can measure changes in the amount of a fluorescently tagged gNA that is bound to an immobilized CasX protein, as a response to increasing concentrations of an additional unlabeled "cold competitor" gNA. Alternatively, or in addition, fluorescence signal can be monitored to or seeing how it changes as different amounts of fluorescently labeled gNA are flowed over immobilized CasX protein. Alternatively, the ability to form an RNP can be assessed using in vitro cleavage assays against a defined target nucleic acid sequence.

i. gNA Stability

In some embodiments, a gNA variant has improved stability when compared to a reference gRNA. Increased stability and efficient folding may, in some embodiments, increase the extent to which a gNA variant persists inside a target cell, which may thereby increase the chance of forming a functional RNP capable of carrying out CasX functions such as gene editing. Increased stability of gNA variants may also, in some embodiments, allow for a similar outcome with a lower amount of gNA delivered to a cell, which may in turn reduce the chance of off-target effects during gene editing.

In another aspect, the disclosure provides gNA in which the scaffold stem loop and/or the extended stem loop is replaced with a hairpin loop or a thermostable RNA stem loop in which the resulting gNA has increased stability and, depending on the choice of loop, can interact with certain cellular proteins or RNA. In some embodiments, the replacement RNA loop is selected from MS2, QP, U1 hairpin II, Uvsx, PP7, Phage replication loop, Kissing loop_a, Kissing loop_b1, Kissing loop_b2, G quadriplex M3q, G quadriplex telomere basket, Sarcin-ricin loop and Pseudoknots. Sequences of gNA variants including such components are provided in Table 2B.

Guide RNA stability can be assessed in a variety of ways, including for example in vitro by assembling the guide, incubating for varying periods of time in a solution that mimics the intracellular environment, and then measuring functional activity via the in vitro cleavage assays described herein. Alternatively, or in addition, gNAs can be harvested from cells at varying time points after initial transfection/transduction of the gNA to determine how long gNA variants persist relative to reference gRNAs.

j. Solubility

In some embodiments, a gNA variant has improved solubility when compared to a reference gRNA. In some embodiments, a gNA variant has improved solubility of the CasX protein:gNA RNP when compared to a reference gRNA. In some embodiments, solubility of the CasX protein:gNA RNP is improved by the addition of a ribozyme sequence to a 5' or 3' end of the gNA variant, for example the 5' or 3' of a reference sgRNA. Some ribozymes, such as the M1 ribozyme, can increase solubility of proteins through RNA mediated protein folding.

Increased solubility of CasX RNPs comprising a gNA variant as described herein can be evaluated through a variety of means known to one of skill in the art, such as by taking densitometry readings on a gel of the soluble fraction of lysed *E. coli* in which the CasX and gNA variants are expressed.

k. Resistance to Nuclease Activity

In some embodiments, a gNA variant has improved resistance to nuclease activity compared to a reference gRNA. Without wishing to be bound by any theory, increased resistance to nucleases, such as nucleases found in cells, may for example increase the persistence of a variant gNA in an intracellular environment, thereby improving gene editing.

Many nucleases are processive, and degrade RNA in a 3' to 5' fashion. Therefore, in some embodiments the addition of a nuclease resistant secondary structure to one or both termini of the gNA, or nucleotide changes that change the secondary structure of a sgNA, can produce gNA variants with increased resistance to nuclease activity. Resistance to nuclease activity may be evaluated through a variety of methods known to one of skill in the art. For example, in vitro methods of measuring resistance to nuclease activity may include for example contacting reference gNA and variants with one or more exemplary RNA nucleases and measuring degradation. Alternatively, or in addition, measuring persistence of a gNA variant in a cellular environment using the methods described herein can indicate the degree to which the gNA variant is nuclease resistant.

l. Binding Affinity to a Target DNA

In some embodiments, a gNA variant has improved affinity for the target DNA relative to a reference gRNA. In certain embodiments, a ribonucleoprotein complex comprising a gNA variant has improved affinity for the target DNA, relative to the affinity of an RNP comprising a reference gRNA. In some embodiments, the improved affinity of the RNP for the target DNA comprises improved affinity for the target sequence, improved affinity for the PAM sequence, improved ability of the RNP to search DNA for the target sequence, or any combinations thereof. In some embodiments, the improved affinity for the target DNA is the result of increased overall DNA binding affinity.

Without wishing to be bound by theory, it is possible that nucleotide changes in the gNA variant that affect the function of the OBD in the CasX protein may increase the affinity of CasX variant protein binding to the protospacer adjacent motif (PAM), as well as the ability to bind or utilize an increased spectrum of PAM sequences other than the canonical TTC PAM recognized by the reference CasX protein of SEQ ID NO:2, including PAM sequences selected from the group consisting of TTC, ATC, GTC, and CTC, thereby increasing the affinity and diversity of the CasX variant protein for target DNA sequences resulting in a substantial increase in the target nucleic acid sequences that can be edited and/or bound, compared to a reference CasX. As described more fully, below, increasing the sequences of the target nucleic acid that can be edited, compared to a reference CasX, refers to both the PAM and the protospacer sequence and their directionality according to the orientation of the non-target strand. This does not imply that the PAM sequence of the non-target strand, rather than the target strand, is determinative of cleavage or mechanistically involved in target recognition. For example, when reference is to a TTC PAM, it may in fact be the complementary GAA sequence that is required for target cleavage, or it may be some combination of nucleotides from both strands. In the case of the CasX proteins disclosed herein, the PAM is located 5' of the protospacer with at least a single nucleotide separating the PAM from the first nucleotide of the protospacer. Alternatively, or in addition, changes in the gNA that affect function of the helical I and/or helical II domains that increase the affinity of the CasX variant protein for the target DNA strand can increase the affinity of the CasX RNP comprising the variant gNA for target DNA.

m. Adding or Changing gNA Function

In some embodiments, gNA variants can comprise larger structural changes that change the topology of the gNA variant with respect to the reference gRNA, thereby allowing for different gNA functionality. For example, in some embodiments a gNA variant has swapped an endogenous stem loop of the reference gRNA scaffold with a previously identified stable RNA structure or a stem loop that can interact with a protein or RNA binding partner to recruit additional moieties to the CasX or to recruit CasX to a specific location, such as the inside of a viral capsid, that has the binding partner to the said RNA structure. In other scenarios the RNAs may be recruited to each other, as in Kissing loops, such that two CasX proteins can be co-localized for more effective gene editing at the target DNA sequence. Such RNA structures may include MS2, QP, U1 hairpin II, Uvsx, PP7, Phage replication loop, Kissing loop_a, Kissing loop_b1, Kissing loop_b2, G quadriplex M3q, G quadriplex telomere basket, Sarcin-ricin loop, or a Pseudoknot.

In some embodiments, a gNA variant comprises a terminal fusion partner. Exemplary terminal fusions may include fusion of the gRNA to a self-cleaving ribozyme or protein binding motif. As used herein, a "ribozyme" refers to an RNA or segment thereof with one or more catalytic activities similar to a protein enzyme. Exemplary ribozyme catalytic activities may include, for example, cleavage and/or ligation of RNA, cleavage and/or ligation of DNA, or peptide bond formation. In some embodiments, such fusions could either improve scaffold folding or recruit DNA repair machinery. For example, a gRNA may in some embodiments be fused to a hepatitis delta virus (HDV) antigenomic ribozyme, HDV genomic ribozyme, hatchet ribozyme (from metagenomic data), env25 pistol ribozyme (representative from Aliistipes putredinis), HH15 Minimal Hammerhead ribozyme, tobacco ringspot virus (TRSV) ribozyme, WT viral Hammerhead ribozyme (and rational variants), or Twisted Sister 1 or RBMX recruiting motif. Hammerhead ribozymes are RNA motifs that catalyze reversible cleavage and ligation reactions at a specific site within an RNA molecule. Hammerhead ribozymes include type I, type II and type III hammerhead ribozymes. The HDV, pistol, and hatchet ribozymes have self-cleaving activities. gNA variants comprising one or more ribozymes may allow for expanded gNA function as compared to a gRNA reference. For example, gNAs comprising self-cleaving ribozymes can, in some embodiments, be transcribed and processed into mature gNAs as part of polycistronic transcripts. Such fusions may occur at either the 5' or the 3' end of the gNA. In some embodiments, a gNA variant comprises a fusion at both the 5' and the 3' end, wherein each fusion is independently as described herein. In some embodiments, a gNA variant comprises a phage replication loop or a tetraloop. In some embodiments, a gNA comprises a hairpin loop that is capable of binding a protein. For example, in some embodiments the hairpin loop is an MS2, Qβ, U1 hairpin II, Uvsx, or PP7 hairpin loop.

In some embodiments, a gNA variant comprises one or more RNA aptamers. As used herein, an "RNA aptamer" refers to an RNA molecule that binds a target with high affinity and high specificity.

In some embodiments, a gNA variant comprises one or more riboswitches. As used herein, a "riboswitch" refers to an RNA molecule that changes state upon binding a small molecule.

In some embodiments, the gNA variant further comprises one or more protein binding motifs. Adding protein binding motifs to a reference gRNA or gNA variant of the disclosure may, in some embodiments, allow a CasX RNP to associate with additional proteins, which can, for example, add the functionality of those proteins to the CasX RNP.

n. Chemically Modified gNA

In some embodiments, the disclosure relates to chemically-modified gNA. In some embodiments, the present disclosure provides a chemically-modified gNA that has guide RNA functionality and has reduced susceptibility to cleavage by a nuclease. A gNA that comprises any nucleotide other than the four canonical ribonucleotides A, C, G, and U, or a deoxynucleotide, is a chemically modified gNA. In some cases, a chemically-modified gNA comprises any backbone or internucleotide linkage other than a natural phosphodiester internucleotide linkage. In certain embodiments, the retained functionality includes the ability of the modified gNA to bind to a CasX of any of the embodiments described herein. In certain embodiments, the retained functionality includes the ability of the modified gNA to bind to a target nucleic acid sequence. In certain embodiments, the retained functionality includes targeting a CasX protein or the ability of a pre-complexed CasX protein-gNA to bind to a target nucleic acid sequence. In certain embodiments, the retained functionality includes the ability to nick a target polynucleotide by a CasX-gNA. In certain embodiments, the retained functionality includes the ability to cleave a target nucleic acid sequence by a CasX-gNA. In certain embodiments, the retained functionality is any other known function of a gNA in a CasX system with a CasX protein of the embodiments of the disclosure.

In some embodiments, the disclosure provides a chemically-modified gNA in which a nucleotide sugar modification is incorporated into the gNA selected from the group consisting of 2'-O—$C_{14}$alkyl such as 2'-O-methyl (2'-OMe), 2'-deoxy (2'-H), 2'-O $C_{1-3}$ alkyl-O—$C_{1-3}$alkyl such as 2'-methoxyethyl ("2'-MOE"), 2'-fluoro ("2'-F"), 2'-amino ("2'-$NH_2$"), 2'-arabinosyl ("2'-arabino") nucleotide, 2'-F-arabinosyl ("2'-F-arabino") nucleotide, 2'-locked nucleic acid ("LNA") nucleotide, 2'-unlocked nucleic acid ("ULNA") nucleotide, a sugar in L form ("L-sugar"), and 4'-thioribosyl nucleotide. In other embodiments, an internucleotide linkage modification incorporated into the guide RNA is selected from the group consisting of: phosphorothioate "P(S)" (P(S)), phosphonocarboxylate ($P(CH_2)$ nCOOR) such as phosphonoacetate "PACE" ($P(CH_2COO—)$), thiophosphonocarboxylate ($(S)P(CH_2)_n$ COOR) such as thiophosphonoacetate "thioPACE" ($(S)P(CH_2)_nCOO^-)$), alkylphosphonate ($P(C_{1-3}$alkyl) such as methylphosphonate $P(CH_3)$, boranophosphonate ($P(BH_3)$), and phosphorodithioate ($P(S)_2$).

In certain embodiments, the disclosure provides a chemically-modified gNA in which a nucleobase ("base") modification is incorporated into the gNA selected from the group consisting of: 2-thiouracil ("2-thioU"), 2-thiocytosine ("2-thioC"), 4-thiouracil ("4-thioU"), 6-thioguanine ("6-thioG"), 2-aminoadenine ("2-aminoA"), 2-aminopurine, pseudouracil, hypoxanthine, 7-deazaguanine, 7-deaza-8-azaguanine, 7-deazaadenine, 7-deaza-8-azaadenine, 5-methylcytosine ("5-methylC"), 5-methyluracil ("5-methylU"), 5-hydroxymethylcytosine, 5-hydroxymethyluracil, 5,6-dehydrouracil, 5-propynylcytosine, 5-propynyluracil, 5-ethynylcytosine, 5-ethynyluracil, 5-allyluracil ("5-allylU"), 5-allylcytosine ("5-allylC"), 5-aminoallyluracil ("5-aminoallylU"), 5-aminoallyl-cytosine ("5-aminoallylC"), an abasic nucleotide, Z base, P base, Unstructured Nucleic Acid ("UNA"), isoguanine ("isoG"), isocytosine ("isoC"), 5-methyl-2-pyrimidine, x(A,G,C,T) and y(A,G,C,T).

In other embodiments, the disclosure provides a chemically-modified gNA in which one or more isotopic modifications are introduced on the nucleotide sugar, the nucleobase, the phosphodiester linkage and/or the nucleotide phosphates, including nucleotides comprising one or more $^{15}N$, $^{13}C$, $^{14}C$, deuterium, $^{3}H$, $^{32}P$, $^{125}I$, $^{131}I$ atoms or other atoms or elements used as tracers.

In some embodiments, an "end" modification incorporated into the gNA is selected from the group consisting of: PEG (polyethyleneglycol), hydrocarbon linkers (including: heteroatom (O,S,N)-substituted hydrocarbon spacers; halo-substituted hydrocarbon spacers; keto-, carboxyl-, amido-, thionyl-, carbamoyl-, thionocarbamaoyl-containing hydrocarbon spacers), spermine linkers, dyes including fluorescent dyes (for example fluoresceins, rhodamines, cyanines) attached to linkers such as for example 6-fluorescein-hexyl, quenchers (for example dabcyl, BHQ) and other labels (for example biotin, digoxigenin, acridine, streptavidin, avidin, peptides and/or proteins). In some embodiments, an "end" modification comprises a conjugation (or ligation) of the gNA to another molecule comprising an oligonucleotide of deoxynucleotides and/or ribonucleotides, a peptide, a protein, a sugar, an oligosaccharide, a steroid, a lipid, a folic acid, a vitamin and/or other molecule. In certain embodiments, the disclosure provides a chemically-modified gNA in which an "end" modification (described above) is located internally in the gNA sequence via a linker such as, for example, a 2-(4-butylamidofluorescein)propane-1,3-diol bis (phosphodiester) linker, which is incorporated as a phosphodiester linkage and can be incorporated anywhere between two nucleotides in the gNA.

In some embodiments, the disclosure provides a chemically-modified gNA having an end modification comprising a terminal functional group such as an amine, a thiol (or sulfhydryl), a hydroxyl, a carboxyl, carbonyl, thionyl, thiocarbonyl, a carbamoyl, a thiocarbamoyl, a phoshoryl, an alkene, an alkyne, an halogen or a functional group-terminated linker that can be subsequently conjugated to a desired moiety selected from the group consisting of a fluorescent dye, a non-fluorescent label, a tag (for $^{14}C$, example biotin, avidin, streptavidin, or moiety containing an isotopic label such as $^{15}N$, $^{13}C$, deuterium, $^{3}H$, $^{32}P$, $^{125}I$ and the like), an oligonucleotide (comprising deoxynucleotides and/or ribonucleotides, including an aptamer), an amino acid, a peptide, a protein, a sugar, an oligosaccharide, a steroid, a lipid, a folic acid, and a vitamin. The conjugation employs standard chemistry well-known in the art, including but not limited to coupling via N-hydroxysuccinimide, isothiocyanate, DCC (or DCI), and/or any other standard method as described in "Bioconjugate Techniques" by Greg T. Hermanson, Publisher Eslsevier Science, $3^{rd}$ ed. (2013), the contents of which are incorporated herein by reference in its entirety.

IV. Proteins for Modifying a Target Nucleic Acid

The present disclosure provides systems comprising a CRISPR nuclease that have utility in genome editing of eukaryotic cells. In some embodiments, the CRISPR nuclease is selected from the group consisting of Cas9, Cas12a, Cas12b, Cas12c, Cas12d (CasY), CasX, Cas13a, Cas13b, Cas13c, Cas13d, CasX, CasY, Cas14, Cpfl, C2cl, Csn2, and Cas Phi. In some embodiments, the CRISPR nuclease is a is a Type V CRISPR nuclease. In some embodiments, the present disclosure provides systems comprising a CasX protein and one or more guide nucleic acids (gNA) that are specifically designed to modify a target nucleic acid sequence in eukaryotic cells.

The term "CasX protein", as used herein, refers to a family of proteins, and encompasses all naturally occurring CasX proteins, proteins that share at least 50% identity to naturally occurring CasX proteins, as well as CasX variants possessing one or more improved characteristics relative to a naturally-occurring reference CasX protein. CasX proteins belong to CRISPR-Cas Type V proteins. Exemplary improved characteristics of the CasX variant embodiments include, but are not limited to improved folding of the variant, improved binding affinity to the gNA, improved binding affinity to the target nucleic acid, improved ability to utilize a greater spectrum of PAM sequences in the editing and/or binding of target DNA, improved unwinding of the target DNA, increased editing activity, improved editing efficiency, improved editing specificity, increased percentage of a eukaryotic genome that can be efficiently edited, increased activity of the nuclease, increased target strand loading for double strand cleavage, decreased target strand loading for single strand nicking, decreased off-target cleavage, improved binding of the non-target strand of DNA, improved protein stability, improved protein:gNA (RNP) complex stability, improved protein solubility, improved protein:gNA (RNP) complex solubility, improved protein yield, improved protein expression, and improved fusion characteristics, as described more fully, below. In the foregoing embodiments, the one or more of the improved characteristics of an RNP of the CasX variant and the gNA variant is at least about 1.1 to about 100,000-fold improved relative to an RNP of the reference CasX protein of SEQ ID NO:1, SEQ ID NO:2, or SEQ ID NO:3 and the gNA of Table 1, when assayed in a comparable fashion. In other cases, the one or more improved characteristics of an RNP of the CasX variant and the gNA variant is at least about 1.1, at least about 10, at least about 100, at least about 1000, at least about 10,000, at least about 100,000-fold or more improved relative to an RNP of the reference CasX protein of SEQ ID NO:1, SEQ ID NO:2, or SEQ ID NO:3 and the gNA of Table 1. In other cases, the one or more of the improved characteristics of an RNP of the CasX variant and the gNA variant is about 1.1 to 100,00-fold, about 1.1 to 10,00-fold, about 1.1 to 1,000-fold, about 1.1 to 500-fold, about 1.1 to 100-fold, about 1.1 to 50-fold, about 1.1 to 20-fold, about 10 to 100,00-fold, about 10 to 10,00-fold, about 10 to 1,000-fold, about 10 to 500-fold, about 10 to 100-fold, about 10 to 50-fold, about 10 to 20-fold, about 2 to 70-fold, about 2 to 50-fold, about 2 to 30-fold, about 2 to 20-fold, about 2 to 10-fold, about 5 to 50-fold, about 5 to 30-fold, about 5 to 10-fold, about 100 to 100,00-fold, about 100 to 10,00-fold, about 100 to 1,000-fold, about 100 to 500-fold, about 500 to 100,00-fold, about 500 to 10,00-fold, about 500 to 1,000-fold, about 500 to 750-fold, about 1,000 to 100,00-fold, about 10,000 to 100,00-fold, about 20 to 500-fold, about 20 to 250-fold, about 20 to 200-fold, about 20 to 100-fold, about 20 to 50-fold, about 50 to 10,000-fold, about 50 to 1,000-fold, about 50 to 500-fold, about 50 to 200-fold, or about 50 to 100-fold, improved relative to an RNP of the reference CasX protein of SEQ ID NO:1, SEQ ID NO:2, or SEQ ID NO:3 and the gNA of Table 1, when assayed in a comparable fashion. In other cases, the one or more improved characteristics of an RNP of the CasX variant and the gNA variant is about 1.1-fold, 1.2-fold, 1.3-fold, 1.4-fold, 1.5-fold, 1.6-fold, 1.7-fold, 1.8-fold, 1.9-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 45-fold, 50-fold, 55-fold, 60-fold, 70-fold, 80-fold, 90-fold, 100-fold, 110-fold, 120-fold, 130-fold, 140-fold, 150-fold, 160-fold, 170-fold, 180-fold, 190-fold, 200-fold, 210-fold, 220-fold, 230-fold, 240-fold, 250-fold, 260-fold, 270-fold, 280-fold, 290-fold, 300-fold, 310-fold, 320-fold, 330-fold, 340-fold, 350-fold, 360-fold, 370-fold, 380-fold, 390-fold, 400-fold, 425-fold, 450-fold, 475-fold, or 500-fold improved relative to an RNP of the reference CasX protein of SEQ ID NO:1, SEQ ID NO:2, or SEQ ID NO:3 and the gNA of Table 1, when assayed in a comparable fashion.

The term “CasX variant” is inclusive of variants that are fusion proteins; i.e., the CasX is “fused to” a heterologous sequence. This includes CasX variants comprising CasX variant sequences and N-terminal, C-terminal, or internal fusions of the CasX to a heterologous protein or domain thereof.

CasX proteins of the disclosure comprise at least one of the following domains: a non-target strand binding (NTSB) domain, a target strand loading (TSL) domain, a helical I domain, a helical II domain, an oligonucleotide binding domain (OBD), and a RuvC DNA cleavage domain (the last of which may be modified or deleted in a catalytically dead CasX variant), described more fully, below. Additionally, the CasX variant proteins of the disclosure have an enhanced ability to efficiently edit and/or bind target DNA, when complexed with a gNA as an RNP, utilizing PAM sequences selected from TTC, ATC, GTC, or CTC, compared to an RNP of a reference CasX protein and reference gNA. In some embodiments, the PAM sequence comprises a TC motif. In the foregoing, the PAM sequence is located at least 1 nucleotide 5' to the non-target strand of the protospacer having identity with the targeting sequence of the gNA in a assay system compared to the editing efficiency and/or binding of an RNP comprising a reference CasX protein and reference gNA in a comparable assay system. In one embodiment, an RNP of a CasX variant and gNA variant exhibits greater editing efficiency and/or binding of a target sequence in the target DNA compared to an RNP comprising a reference CasX protein and a reference gNA in a comparable assay system, wherein the PAM sequence of the target DNA is TTC. In another embodiment, an RNP of a CasX variant and gNA variant exhibits greater editing efficiency and/or binding of a target sequence in the target DNA compared to an RNP comprising a reference CasX protein and a reference gNA in a comparable assay system, wherein the PAM sequence of the target DNA is ATC. In another embodiment, an RNP of a CasX variant and gNA variant exhibits greater editing efficiency and/or binding of a target sequence in the target DNA compared to an RNP comprising a reference CasX protein and a reference gNA in a comparable assay system, wherein the PAM sequence of the target DNA is CTC. In another embodiment, an RNP of a CasX variant and gNA variant exhibits greater editing efficiency and/or binding of a target sequence in the target DNA compared to an RNP comprising a reference CasX protein and a reference gNA in a comparable assay system, wherein the PAM sequence of the target DNA is GTC. In the foregoing embodiments, the increased editing efficiency and/or binding affinity for the one or more PAM sequences is at least 1.5-fold greater compared to the editing efficiency and/or binding affinity of an RNP of any one of the CasX proteins of SEQ ID NOS:1-3 and the gNA of Table 1 for the PAM sequences.

In some cases, the CasX protein is a naturally-occurring protein (e.g., naturally occurs in and is isolated from prokaryotic cells). In other embodiments, the CasX protein is not a naturally-occurring protein (e.g., the CasX protein is a CasX variant protein, a chimeric protein, and the like). A naturally-occurring CasX protein (referred to herein as a “reference CasX protein”) functions as an endonuclease that catalyzes a double strand break at a specific sequence in a targeted double-stranded DNA (dsDNA). The sequence specificity is provided by the targeting sequence of the associated gNA to which it is complexed, which hybridizes to a target sequence within the target nucleic acid.

In some embodiments, a CasX protein can bind and/or modify (e.g., cleave, nick, methylate, demethylate, etc.) a target nucleic acid and/or a polypeptide associated with target nucleic acid (e.g., methylation or acetylation of a histone tail). In some embodiments, the CasX protein is catalytically dead (dCasX) but retains the ability to bind a target nucleic acid. An exemplary catalytically dead CasX protein comprises one or more mutations in the active site of the RuvC domain of the CasX protein. In some embodiments, a catalytically dead CasX protein comprises substitutions at residues 672, 769 and/or 935 of SEQ ID NO:1. In one embodiment, a catalytically dead CasX protein comprises substitutions of D672A, E769A and/or D935A in a reference CasX protein of SEQ ID NO:1. In other embodiments, a catalytically dead CasX protein comprises substitutions at amino acids 659, 756 and/or 922 in a reference CasX protein of SEQ ID NO:2. In some embodiments, a catalytically dead CasX protein comprises D659A, E756A and/or D922A substitutions in a reference CasX protein of SEQ ID NO:2. In further embodiments, a catalytically dead CasX protein comprises deletions of all or part of the RuvC domain of the CasX protein. It will be understood that the same foregoing substitutions can similarly be introduced into the CasX variants of the disclosure, resulting in a dCasX variant. In one embodiment, all or a portion of the RuvC domain is deleted from the CasX variant, resulting in a dCasX variant. Catalytically inactive dCasX variant proteins can, in some embodiments, be used for base editing or epigenetic modifications. With a higher affinity for DNA, in some embodiments, catalytically inactive dCasX variant proteins can, relative to catalytically active CasX, find their target nucleic acid faster, remain bound to target nucleic acid for longer periods of time, bind target nucleic acid in a more stable fashion, or a combination thereof, thereby improving these functions of the catalytically dead CasX variant protein compared to a CasX variant that retains its cleavage capability.

a. Non-Target Strand Binding Domain

The reference CasX proteins of the disclosure comprise a non-target strand binding domain (NTSBD). The NTSBD is a domain not previously found in any Cas proteins; for example this domain is not present in Cas proteins such as Cas9, Cas12a/Cpf1, Cas13, Cas14, CASCADE, CSM, or CSY. Without being bound to theory or mechanism, a NTSBD in a CasX allows for binding to the non-target DNA strand and may aid in unwinding of the non-target and target strands. The NTSBD is presumed to be responsible for the unwinding, or the capture, of a non-target DNA strand in the unwound state. The NTSBD is in direct contact with the non-target strand in CryoEM model structures derived to date and may contain a non-canonical zinc finger domain. The NTSBD may also play a role in stabilizing DNA during unwinding, guide RNA invasion and R-loop formation. In some embodiments, an exemplary NTSBD comprises amino acids 101-191 of SEQ ID NO:1 or amino acids 103-192 of SEQ ID NO:2. In some embodiments, the NTSBD of a reference CasX protein comprises a four-stranded beta sheet.

b. Target Strand Loading Domain

The reference CasX proteins of the disclosure comprise a Target Strand Loading (TSL) domain. The TSL domain is a domain not found in certain Cas proteins such as Cas9, CASCADE, CSM, or CSY. Without wishing to be bound by theory or mechanism, it is thought that the TSL domain is responsible for aiding the loading of the target DNA strand into the RuvC active site of a CasX protein. In some embodiments, the TSL acts to place or capture the target-strand in a folded state that places the scissile phosphate of the target strand DNA backbone in the RuvC active site. The TSL comprises a cys4 (CXXC, CXXC zinc finger/ribbon domain (SEQ ID NO: 48) that is separated by the bulk of the TSL. In some embodiments, an exemplary TSL comprises amino acids 825-934 of SEQ ID NO:1 or amino acids 813-921 of SEQ ID NO:2.

c. Helical I Domain

The reference CasX proteins of the disclosure comprise a helical I domain. Certain Cas proteins other than CasX have domains that may be named in a similar way. However, in some embodiments, the helical I domain of a CasX protein comprises one or more unique structural features, or comprises a unique sequence, or a combination thereof, compared to non-CasX proteins. For example, in some embodiments, the helical I domain of a CasX protein comprises one or more unique secondary structures compared to domains in other Cas proteins that may have a similar name. For example, in some embodiments the helical I domain in a CasX protein comprises one or more alpha helices of unique structure and sequence in arrangement, number and length compared to other CRISPR proteins. In certain embodiments, the helical I domain is responsible for interacting with the bound DNA and spacer of the guide RNA. Without wishing to be bound by theory, it is thought that in some cases the helical I domain may contribute to binding of the protospacer adjacent motif (PAM). In some embodiments, an exemplary helical I domain comprises amino acids 57-100 and 192-332 of SEQ ID NO:1, or amino acids 59-102 and 193-333 of SEQ ID NO:2. In some embodiments, the helical I domain of a reference CasX protein comprises one or more alpha helices.

d. Helical II Domain

The reference CasX proteins of the disclosure comprise a helical II domain. Certain Cas proteins other than CasX have domains that may be named in a similar way. However, in some embodiments, the helical II domain of a CasX protein comprises one or more unique structural features, or a unique sequence, or a combination thereof, compared to domains in other Cas proteins that may have a similar name. For example, in some embodiments, the helical II domain comprises one or more unique structural alpha helical bundles that align along the target DNA:guide RNA channel. In some embodiments, in a CasX comprising a helical II domain, the target strand and guide RNA interact with helical II (and the helical I domain, in some embodiments) to allow RuvC domain access to the target DNA. The helical II domain is responsible for binding to the guide RNA scaffold stem loop as well as the bound DNA. In some embodiments, an exemplary helical II domain comprises amino acids 333-509 of SEQ ID NO:1, or amino acids 334-501 of SEQ ID NO:2.

e. Oligonucleotide Binding Domain

The reference CasX proteins of the disclosure comprise an Oligonucleotide Binding Domain (OBD). Certain Cas proteins other than CasX have domains that may be named in a similar way. However, in some embodiments, the OBD comprises one or more unique functional features, or comprises a sequence unique to a CasX protein, or a combination thereof. For example, in some embodiments the bridged helix (BH), helical I domain, helical II domain, and Oligonucleotide Binding Domain (OBD) together are responsible for binding of a CasX protein to the guide RNA. Thus, for example, in some embodiments the OBD is unique to a CasX protein in that it interacts functionally with a helical I domain, or a helical II domain, or both, each of which may be unique to a CasX protein as described herein. Specifically, in CasX the OBD largely binds the RNA triplex of the guide RNA scaffold. The OBD may also be responsible for binding to the protospacer adjacent motif (PAM). An exemplary OBD domain comprises amino acids 1-56 and 510-660 of SEQ ID NO:1, or amino acids 1-58 and 502-647 of SEQ ID NO:2.

f. RuvC DNA Cleavage Domain

The reference CasX proteins of the disclosure comprise a RuvC domain, that includes 2 partial RuvC domains (RuvC-I and RuvC-II). The RuvC domain is the ancestral domain of all type 12 CRISPR proteins. The RuvC domain originates from a TNPB (transposase B) like transposase. Similar to other RuvC domains, the CasX RuvC domain has a DED catalytic triad that is responsible for coordinating a magnesium (Mg) ion and cleaving DNA. In some embodiments, the RuvC has a DED motif active site that is responsible for cleaving both strands of DNA (one by one, most likely the non-target strand first at 11-14 nucleotides (nt) into the targeted sequence and then the target strand next at 2-4 nucleotides after the target sequence). Specifically in CasX, the RuvC domain is unique in that it is also responsible for binding the guide RNA scaffold stem loop that is critical for CasX function. An exemplary RuvC domain comprises amino acids 661-824 and 935-986 of SEQ ID NO:1, or amino acids 648-812 and 922-978 of SEQ ID NO:2.

g. Reference CasX Proteins

The disclosure provides reference CasX proteins. In some embodiments, a reference CasX protein is a naturally-occurring protein. For example, reference CasX proteins can be isolated from naturally occurring prokaryotes, such as Deltaproteobacteria, Planctomycetes, or Candidatus Sungbacteria species. A reference CasX protein (sometimes referred to herein as a reference CasX protein) is a type II CRISPR/Cas endonuclease belonging to the CasX (sometimes referred to as Cas12e) family of proteins that is capable of interacting with a guide NA to form a ribonucleoprotein (RNP) complex. In some embodiments, the RNP complex comprising the reference CasX protein can be targeted to a particular site in a target nucleic acid via base pairing between the targeting sequence (or spacer) of the gNA and a target sequence in the target nucleic acid. In some embodiments, the RNP comprising the reference CasX protein is capable of cleaving target DNA. In some embodiments, the RNP comprising the reference CasX protein is capable of nicking target DNA. In some embodiments, the RNP comprising the reference CasX protein is capable of editing target DNA, for example in those embodiments where the reference CasX protein is capable of cleaving or nicking DNA, followed by non-homologous end joining (NHEJ), homology-directed repair (HDR), homology-independent targeted integration (HITI), micro-homology mediated end joining (MMEJ), single strand annealing (SSA) or base excision repair (BER). In some embodiments, the RNP comprising the CasX protein is a catalytically dead (is catalytically inactive or has substantially no cleavage activity) CasX protein (dCasX), but retains the ability to bind the target DNA, described more fully, supra.

In some cases, a reference CasX protein is isolated or derived from Deltaproteobacteria. In some embodiments, a CasX protein comprises a sequence at least 50% identical, at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence of:

(SEQ ID NO: 1)

1 MEKRINKIRK KLSADNATKP VSRSGPMKTL LVRVMTDDLK KRLEKRRKKP EVMPQVISNN

61 AANNLRMLLD DYTKMKEAIL QVYWQEFKDD HVGLMCKFAQ PASKKIDQNK LKPEMDEKGN

121 LTTAGFACSQ CGQPLFVYKL EQVSEKGKAY TNYFGRCNVA EHEKLILLAQ LKPEKDSDEA

181 VTYSLGKFGQ RALDFYSIHV TKESTHPVKP LAQIAGNRYA SGPVGKALSD ACMGTIASFL

241 SKYQDIIIEH QKVVKGNQKR LESLRELAGK ENLEYPSVTL PPQPHTKEGV DAYNEVIARV

301 RMWVNLNLWQ KLKLSRDDAK PLLRLKGFPS FPVVERRENE VDWWNTINEV KKLIDAKRDM

361 GRVFWSGVTA EKRNTILEGY NYLPNENDHK KREGSLENPK KPAKRQFGDL LLYLEKKYAG

421 DWGKVFDEAW ERIDKKIAGL TSHIEREEAR NAEDAQSKAV LTDWLRAKAS FVLERLKEMD

481 EKEFYACEIQ LQKWYGDLRG NPFAVEAENR VVDISGESIG SDGHSIQYRN LLAWKYLENG

541 KREFYLLMNY GKKGRIRFTD GTDIKKSGKW QGLLYGGGKA KVIDLTFDPD DEQLIILPLA

601 FGTRQGREFI WNDLLSLETG LIKLANGRVI EKTIYNKKIG RDEPALFVAL TFERREVVDP

661 SNIKPVNLIG VDRGENIPAV IALTDPEGCP LPEFKDSSGG PTDILRIGEG YKEKQRAIQA

721 AKEVEQRRAG GYSRKFASKS RNLADDMVRN SARDLFYHAV THDAVLVFEN LSRGFGRQGK

781 RTFMTERQYT KMEDWLTAKL AYEGLTSKTY LSKTLAQYTS KTCSNCGFTI TTADYDGMLV

841 RLKKTSDGWA TTLNNKELKA EGQITYYNRY KRQTVEKELS AELDRLSEES GNNDISKWTK

901 GRRDEALFLL KKRFSHRPVQ EQFVCLDCGH EVHADEQAAL NIARSWLFLN SNSTEFKSYK

961 SGKQPFVGAW QAFYKRRLKE VWKPNA.

In some cases, a reference CasX protein is isolated or derived from Planctomycetes. In some embodiments, a CasX protein comprises a sequence at least 50% identical, at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence of:

(SEQ ID NO: 2)

1 MQEIKRINKI RRRLVKDSNT KKAGKTGPMK TLLVRVMTPD LRERLENLRK KPENIPQPIS

61 NTSRANLNKL LTDYTEMKKA ILHVYWEEFQ KDPVGLMSRV AQPAPKNIDQ RKLIPVKDGN

121 ERLTSSGEAC SQCCQPLYVY KLEQVNDKGK PHTNYFGRCN VSEHERLILL SPHKPEANDE

181 LVTYSLGKFG QRALDFYSIH VTRESNHPVK PLEQIGGNSC ASGPVGKALS DACMGAVASF

241 LTKYQDIILE HQKVIKKNEK RLANLKDIAS ANGLAEPKIT LPPQPHTKEG IEAYNNVVAQ

301 IVIWVNLNLW QKLKIGRDEA KPLQRLKGFP SFPLVERQAN EVDWWDMVCN VKKLINEKKE

361 DGKVFWQNLA GYKRQEALLP YLSSEEDRKK GKKFARYQFG DLLLHLEKKH GEDWGKVYDE

421 AWERIDKKVE GLSKHIKLEE ERRSEDAQSK AALTDWLRAK ASFVIEGLKE ADKDEFCRCE

481 LKLQKWYGDL RGKPFAIEAE NSILDISGES KQYNCAFIWQ KDGVKKLNLY LIINYFKGGK

541 LRFKKIKPEA FEANRFYTVI NKKSGEIVPM EVNFNFDDPN LIILPLAFGK RQGREFIWND

601 LLSLETGSLK LANGRVIEKT LYNRRTRQDE PALEVALTEE RREVLDSSNI KPMNLIGIDR

661 GENIPAVIAL TDPEGCPLSR FKDSLGNPTH ILRIGESYKE KQRTIQAAKE VEQRRAGGYS

-continued

```
721 RKYASKAKNL ADDMVRNTAR DLLYYAVTQD AMLIFENLSR GFGRQGKRTF MAERQYTRME
781 DWLTAKLAYE GLPSKTYLSK TLAQYTSKTC SNCGFTITSA DYDRVLEKLK KTATGWMTTI
841 NGKELKVEGQ ITYYNRYKRQ NVVKDLSVEL DRLSEESVNN DISSWTKGRS GEALSLLKKR
901 FSHRPVQEKF VCLNCGFETH ADEQAALNIA RSWLFLRSQE YKKYQTNKTT GNTDKRAFVE
961 TWQSFYRKKL KEVWKPAV.
```

In some embodiments, the CasX protein comprises the sequence of SEQ ID NO:2, or at least 60% similarity thereto. In some embodiments, the CasX protein comprises the sequence of SEQ ID NO:2, or at least 80% similarity thereto. In some embodiments, the CasX protein comprises the sequence of SEQ ID NO:2, or at least 90% similarity thereto. In some embodiments, the CasX protein comprises the sequence of SEQ ID NO:2, or at least 95% similarity thereto. In some embodiments, the CasX protein consists of the sequence of SEQ ID NO:2. In some embodiments, the CasX protein comprises or consists of a sequence that has at least 1, at least 2, at least 3, at least 4, at least 5, at least 6, at least 7, at least 8, at least 9, at least 10, at least 20, at least 30, at least 40 or at least 50 mutations relative to the sequence of SEQ ID NO:2. These mutations can be insertions, deletions, amino acid substitutions, or any combinations thereof.

In some cases, a reference CasX protein is isolated or derived from Candidatus Sungbacteria. In some embodiments, a CasX protein comprises a sequence at least 50% identical, at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical or 100% identical to a sequence of

```
                                                          (SEQ ID NO: 3)
  1 MDNANKPSTK SLVNTTRISD HFGVTPGQVT RVFSFGIIPT KRQYAIIERW FAAVEAARER
 61 LYGMLYAHFQ ENPPAYLKEK FSYETFFKGR PVLNGLRDID PTIMTSAVFT ALRHKAEGAM
121 AAFHTNHRRL FEEARKKMRE YAECLKANEA LLRGAADIDW DKIVNALRTR LNTCLAPEYD
181 AVIADFGALC AFRALIAETN ALKGAYNHAL NQMLPALVKV DEPEEAEESP RLRFFNGRIN
241 DLPKFPVAER ETPPDTETII RQLEDMARVI PDTAEILGYI HRIRHKAARR KPGSAVPLPQ
301 RVALYCAIRM ERNPEEDPST VAGHFLGEID RVCEKRRQGL VRTPFDSQIR ARYMDIISER
361 ATLAHPDRWT EIQFLRSNAA SRRVRAETIS APFEGFSWTS NRTNPAPQYG MALAKDANAP
421 ADAPELCIGL SPSSAAFSVR EKGGDLIYMR PTGGRRGKDN PGKEITWVPG SFDEYPASGV
481 ALKLRLYFGR SQARRMLTNK TWGLLSDNPR VFAANAELVG KKRNPQDRWK LFFHMVISGP
541 PPVEYLDFSS DVRSRARTVI GINRGEVNPL AYAVVSVEDG QVLEEGLLGK KEYIDQLIET
601 RRRISEYQSR EQTPPRDLRQ RVRHLQDTVL GSARAKIHSL IAFWKGILAI ERLDDQFHGR
661 EQKIIPKKTY LANKTGFMNA LSFSGAVRVD KKGNPWGGMI EIYPGGISRT CTQCGTVWLA
721 RRPKNPGHRD AMVVIPDIVD DAAATGFDNV DCDAGTVDYG ELFTLSREWV RLTPRYSRVM
781 RGTLGDLERA IRQGDDRKSR QMLELALEPQ PQWGQFFCHR CGFNGQSDVL AATNLARRAI
841 SLIRRLPDTD TPPTP.
```

In some embodiments, the CasX protein comprises the sequence of SEQ ID NO:3, or at least 60% similarity thereto. In some embodiments, the CasX protein comprises the sequence of SEQ ID NO:3, or at least 80% similarity thereto. In some embodiments, the CasX protein comprises the sequence of SEQ ID NO:3, or at least 90% similarity thereto. In some embodiments, the CasX protein comprises the sequence of SEQ ID NO:3, or at least 95% similarity thereto. In some embodiments, the CasX protein consists of the sequence of SEQ ID NO:3. In some embodiments, the CasX protein comprises or consists of a sequence that has at least 1, at least 2, at least 3, at least 4, at least 5, at least 6, at least 7, at least 8, at least 9, at least 10, at least 20, at least 30, at least 40 or at least 50 mutations relative to the sequence of SEQ ID NO:3. These mutations can be insertions, deletions, amino acid substitutions, or any combinations thereof.

h. CasX Variant Proteins

The present disclosure provides variants of a reference CasX protein (interchangeably referred to herein as "CasX variant" or "CasX variant protein"), wherein the CasX variants comprise at least one modification in at least one domain of the reference CasX protein, including the sequences of SEQ ID NOS:1-3. In some embodiments, the CasX variant exhibits at least one improved characteristic compared to the reference CasX protein. All variants that improve one or more functions or characteristics of the CasX variant protein when compared to a reference CasX protein described herein are envisaged as being within the scope of the disclosure. In some embodiments, the modification is a mutation in one or more amino acids of the reference CasX. In other embodiments, the modification is a substitution of one or more domains of the reference CasX with one or more domains from a different CasX. In some embodiments, insertion includes the insertion of a part or all of a domain from a different CasX protein. Mutations can occur in any one or more domains of the reference CasX protein, and may include, for example, deletion of part or all of one or more domains, or one or more amino acid substitutions, deletions, or insertions in any domain of the reference CasX protein. The domains of CasX proteins include the non-target strand binding (NTSB) domain, the target strand loading (TSL) domain, the helical I domain, the helical II domain, the oligonucleotide binding domain (OBD), and the RuvC DNA cleavage domain. Any change in amino acid sequence of a reference CasX protein that leads to an improved characteristic of the CasX protein is considered a CasX variant protein of the disclosure. For example, CasX variants can comprise one or more amino acid substitutions, insertions, deletions, or swapped domains, or any combinations thereof, relative to a reference CasX protein sequence.

In some embodiments, the CasX variant protein comprises at least one modification in at least each of two domains of the reference CasX protein, including the sequences of SEQ ID NOS:1-3. In some embodiments, the CasX variant protein comprises at least one modification in at least 2 domains, in at least 3 domains, at least 4 domains or at least 5 domains of the reference CasX protein. In some embodiments, the CasX variant protein comprises two or more modifications in at least one domain of the reference CasX protein. In some embodiments, the CasX variant protein comprises at least two modifications in at least one domain of the reference CasX protein, at least three modifications in at least one domain of the reference CasX protein or at least four modifications in at least one domain of the reference CasX protein. In some embodiments, wherein the CasX variant comprises two or more modifications compared to a reference CasX protein, each modification is made in a domain independently selected from the group consisting of a NTSBD, TSLD, Helical I domain, Helical II domain, OBD, and RuvC DNA cleavage domain.

In some embodiments, the at least one modification of the CasX variant protein comprises a deletion of at least a portion of one domain of the reference CasX protein, including the sequences of SEQ ID NOS:1-3. In some embodiments, the deletion is in the NTSBD, TSLD, Helical I domain, Helical II domain, OBD, or RuvC DNA cleavage domain.

Suitable mutagenesis methods for generating CasX variant proteins of the disclosure may include, for example, Deep Mutational Evolution (DME), deep mutational scanning (DMS), error prone PCR, cassette mutagenesis, random mutagenesis, staggered extension PCR, gene shuffling, or domain swapping. In some embodiments, the CasX variants are designed, for example by selecting one or more desired mutations in a reference CasX. In certain embodiments, the activity of a reference CasX protein is used as a benchmark against which the activity of one or more CasX variants are compared, thereby measuring improvements in function of the CasX variants. Exemplary improvements of CasX variants include, but are not limited to, improved folding of the variant, improved binding affinity to the gNA, improved binding affinity to the target DNA, altered binding affinity to one or more PAM sequences, improved unwinding of the target DNA, increased activity, improved editing efficiency, improved editing specificity, increased activity of the nuclease, increased target strand loading for double strand cleavage, decreased target strand loading for single strand nicking, decreased off-target cleavage, improved binding of the non-target strand of DNA, improved protein stability, improved protein:gNA complex stability, improved protein solubility, improved protein:gNA complex solubility, improved protein yield, improved protein expression, and improved fusion characteristics, as described more fully, below.

In some embodiments of the CasX variants described herein, the at least one modification comprises: (a) a substitution of 1 to 100 consecutive or non-consecutive amino acids in the CasX variant compared to a reference CasX of SEQ ID NO:1, SEQ ID NO:2, or SEQ ID NO:3; (b) a deletion of 1 to 100 consecutive or non-consecutive amino acids in the CasX variant compared to a reference CasX; (c) an insertion of 1 to 100 consecutive or non-consecutive amino acids in the CasX compared to a reference CasX; or (d) any combination of (a)-(c). In some embodiments, the at least one modification comprises: (a) a substitution of 5-10 consecutive or non-consecutive amino acids in the CasX variant compared to a reference CasX of SEQ ID NO:1, SEQ ID NO:2, or SEQ ID NO:3; (b) a deletion of 1-5 consecutive or non-consecutive amino acids in the CasX variant compared to a reference CasX; (c) an insertion of 1-5 consecutive or non-consecutive amino acids in the CasX compared to a reference CasX; or (d) any combination of (a)-(c).

In some embodiments, the CasX variant protein comprises or consists of a sequence that has at least 1, at least 2, at least 3, at least 4, at least 5, at least 6, at least 7, at least 8, at least 9, at least 10, at least 20, at least 30, at least 40 or at least 50 mutations relative to the sequence of SEQ ID NO:1, SEQ ID NO:2, or SEQ ID NO:3. These mutations can be insertions, deletions, amino acid substitutions, or any combinations thereof.

In some embodiments, the CasX variant protein comprises at least one amino acid substitution in at least one domain of a reference CasX protein. In some embodiments, the CasX variant protein comprises at least about 1-4 amino acid substitutions, 1-10 amino acid substitutions, 1-20 amino acid substitutions, 1-30 amino acid substitutions, 1-40 amino acid substitutions, 1-50 amino acid substitutions, 1-60 amino acid substitutions, 1-70 amino acid substitutions, 1-80 amino acid substitutions, 1-90 amino acid substitutions, 1-100 amino acid substitutions, 2-10 amino acid substitutions, 2-20 amino acid substitutions, 2-30 amino acid substitutions, 3-10 amino acid substitutions, 3-20 amino acid substitutions, 3-30 amino acid substitutions, 4-10 amino acid substitutions, 4-20 amino acid substitutions, 3-300 amino acid substitutions, 5-10 amino acid substitutions, 5-20 amino acid substitutions, 5-30 amino acid substitutions, 10-50 amino acid substitutions, or 20-50 amino acid substitutions, relative to a reference CasX protein. In some embodiments, the CasX variant protein comprises at least about 100 amino acid substitutions relative to a reference CasX protein. In some embodiments, the CasX variant protein comprises 1, 2, 3, 4, 5, 6, 7, 8, 9 or 10 amino acid substitutions relative to a reference CasX protein. In some embodiments, the CasX variant protein comprises 1, 2, 3, 4, 5, 6, 7, 8, 9 or 10 amino acid substitutions in a single domain relative to the reference CasX protein. In some embodiments, the amino acid substitutions are conservative substitutions. In other embodiments, the substitutions are non-conservative; e.g., a polar amino acid is substituted for a non-polar amino acid, or vice versa.

In some embodiments, a CasX variant protein comprises 1 amino acid substitution, 2-3 consecutive amino acid substitutions, 2-4 consecutive amino acid substitutions, 2-5 consecutive amino acid substitutions, 2-6 consecutive amino acid substitutions, 2-7 consecutive amino acid substitutions, 2-8 consecutive amino acid substitutions, 2-9 consecutive amino acid substitutions, 2-10 consecutive amino acid substitutions, 2-20 consecutive amino acid substitutions, 2-30 consecutive amino acid substitutions, 2-40 consecutive amino acid substitutions, 2-50 consecutive amino acid substitutions, 2-60 consecutive amino acid substitutions, 2-70 consecutive amino acid substitutions, 2-80 consecutive amino acid substitutions, 2-90 consecutive amino acid substitutions, 2-100 consecutive amino acid substitutions, 3-10 consecutive amino acid substitutions, 3-20 consecutive amino acid substitutions, 3-30 consecutive amino acid substitutions, 4-10 consecutive amino acid substitutions, 4-20 consecutive amino acid substitutions, 3-300 consecutive amino acid substitutions, 5-10 consecutive amino acid substitutions, 5-20 consecutive amino acid substitutions, 5-30 consecutive amino acid substitutions, 10-50 consecutive amino acid substitutions or 20-50 consecutive amino acid substitutions relative to a reference CasX protein. In some embodiments, a CasX variant protein comprises 2, 3, 4, 5, 6, 7, 8, 9, 10, 11, 12, 13, 14, 15, 16, 17, 18, 19 or 20 consecutive amino acid substitutions. In some embodiments, a CasX variant protein comprises a substitution of at least about 100 consecutive amino acids. As used herein "consecutive amino acids" refer to amino acids that are contiguous in the primary sequence of a polypeptide.

In some embodiments, a CasX variant protein comprises two or more substitutions relative to a reference CasX protein, and the two or more substitutions are not in consecutive amino acids of the reference CasX sequence. For example, a first substitution may be in a first domain of the reference CasX protein, and a second substitution may be in a second domain of the reference CasX protein. In some embodiments, a CasX variant protein comprises 2, 3, 4, 5, 6, 7, 8, 9, 10, 11, 12, 13, 14, 15, 16, 17, 18, 19 or 20 non-consecutive substitutions relative to a reference CasX protein. In some embodiments, a CasX variant protein comprises at least 20 non-consecutive substitutions relative to a reference CasX protein. Each non-consecutive substitution may be of any length of amino acids described herein, e.g., 1-4 amino acids, 1-10 amino acids, and the like. In some embodiments, the two or more substitutions relative to the reference CasX protein are not the same length, for example one substitution is one amino acid and a second substitution is three amino acids. In some embodiments, the two or more substitutions relative to the reference CasX protein are the same length, for example both substitutions are two consecutive amino acids in length.

Any amino acid can be substituted for any other amino acid in the substitutions described herein. The substitution can be a conservative substitution (e.g., a basic amino acid is substituted for another basic amino acid). The substitution can be a non-conservative substitution (e.g., a basic amino acid is substituted for an acidic amino acid or vice versa). For example, a proline in a reference CasX protein can be substituted for any of arginine, histidine, lysine, aspartic acid, glutamic acid, serine, threonine, asparagine, glutamine, cysteine, glycine, alanine, isoleucine, leucine, methionine, phenylalanine, tryptophan, tyrosine or valine to generate a CasX variant protein of the disclosure.

In some embodiments, a CasX variant protein comprises at least one amino acid deletion relative to a reference CasX protein. In some embodiments, a CasX variant protein comprises a deletion of 1-4 amino acids, 1-10 amino acids, 1-20 amino acids, 1-30 amino acids, 1-40 amino acids, 1-50 amino acids, 1-60 amino acids, 1-70 amino acids, 1-80 amino acids, 1-90 amino acids, 1-100 amino acids, 2-10 amino acids, 2-20 amino acids, 2-30 amino acids, 3-10 amino acids, 3-20 amino acids, 3-30 amino acids, 4-10 amino acids, 4-20 amino acids, 3-300 amino acids, 5-10 amino acids, 5-20 amino acids, 5-30 amino acids, 10-50 amino acids or 20-50 amino acids relative to a reference CasX protein. In some embodiments, a CasX protein comprises a deletion of at least about 100 consecutive amino acids relative to a reference CasX protein. In some embodiments, a CasX variant protein comprises a deletion of at least 1, 2, 3, 4, 5, 6, 7, 8, 9, 10, 20, 30, 40, 50 or 100 consecutive amino acids relative to a reference CasX protein. In some embodiments, a CasX variant protein comprises a deletion of 1, 2, 3, 4, 5, 6, 7, 8, 9 or 10 consecutive amino acids.

In some embodiments, a CasX variant protein comprises two or more deletions relative to a reference CasX protein, and the two or more deletions are not consecutive amino acids. For example, a first deletion may be in a first domain of the reference CasX protein, and a second deletion may be in a second domain of the reference CasX protein. In some embodiments, a CasX variant protein comprises 2, 3, 4, 5, 6, 7, 8, 9, 10, 11, 12, 13, 14, 15, 16, 17, 18, 19 or 20 non-consecutive deletions relative to a reference CasX protein. In some embodiments, a CasX variant protein comprises at least 20 non-consecutive deletions relative to a reference CasX protein. Each non-consecutive deletion may be of any length of amino acids described herein, e.g., 1-4 amino acids, 1-10 amino acids, and the like.

In some embodiments, the CasX variant protein comprises at least one amino acid insertion relative to the sequence of SEQ ID NOS:1, 2, or 3. In some embodiments, a CasX variant protein comprises an insertion of 1 amino acid, an insertion of 2-3 consecutive amino acids, 2-4 consecutive amino acids, 2-5 consecutive amino acids, 2-6 consecutive amino acids, 2-7 consecutive amino acids, 2-8 consecutive amino acids, 2-9 consecutive amino acids, 2-10 consecutive amino acids, 2-20 consecutive amino acids, 2-30 consecutive amino acids, 2-40 consecutive amino acids, 2-50 consecutive amino acids, 2-60 consecutive amino acids, 2-70 consecutive amino acids, 2-80 consecutive amino acids, 2-90 consecutive amino acids, 2-100 consecutive amino acids, 3-10 consecutive amino acids, 3-20 consecutive amino acids, 3-30 consecutive amino acids, 4-10 consecutive amino acids, 4-20 consecutive amino acids, 3-300 consecutive amino acids, 5-10 consecutive amino acids, 5-20 consecutive amino acids, 5-30 consecutive amino acids, 10-50 consecutive amino acids or 20-50 consecutive amino acids relative to a reference CasX protein. In some embodiments, the CasX variant protein comprises an insertion of 2, 3, 4, 5, 6, 7, 8, 9, 10, 11, 12, 13, 14, 15, 16, 17, 18, 19 or 20 consecutive amino acids. In some embodiments, a CasX variant protein comprises an insertion of at least about 100 consecutive amino acids.

In some embodiments, a CasX variant protein comprises two or more insertions relative to a reference CasX protein, and the two or more insertions are not consecutive amino acids of the sequence. For example, a first insertion may be in a first domain of the reference CasX protein, and a second insertion may be in a second domain of the reference CasX protein. In some embodiments, a CasX variant protein comprises 2, 3, 4, 5, 6, 7, 8, 9, 10, 11, 12, 13, 14, 15, 16, 17, 18, 19 or 20 non-consecutive insertions relative to a reference CasX protein. In some embodiments, a CasX variant protein comprises at least 10 to about 20 or more non-consecutive insertions relative to a reference CasX protein. Each non-consecutive insertion may be of any length of amino acids described herein, e.g., 1-4 amino acids, 1-10 amino acids, and the like.

Any amino acid, or combination of amino acids, can be inserted in the insertions described herein. For example, a proline, arginine, histidine, lysine, aspartic acid, glutamic acid, serine, threonine, asparagine, glutamine, cysteine, glycine, alanine, isoleucine, leucine, methionine, phenylalanine, tryptophan, tyrosine or valine or any combination thereof can be inserted into a reference CasX protein of the disclosure to generate a CasX variant protein.

Any permutation of the substitution, insertion and deletion embodiments described herein can be combined to generate a CasX variant protein of the disclosure. For example, a CasX variant protein can comprise at least one substitution and at least one deletion relative to a reference CasX protein sequence, at least one substitution and at least one insertion relative to a reference CasX protein sequence, at least one insertion and at least one deletion relative to a reference CasX protein sequence, or at least one substitution, one insertion and one deletion relative to a reference CasX protein sequence.

In some embodiments, the CasX variant protein has at least about 60% sequence similarity, at least 70% similarity, at least 80% similarity, at least 85% similarity, at least 86% similarity, at least 87% similarity, at least 88% similarity, at least 89% similarity, at least 90% similarity, at least 91% similarity, at least 92% similarity, at least 93% similarity, at least 94% similarity, at least 95% similarity, at least 96% similarity, at least 97% similarity, at least 98% similarity, at least 99% similarity, at least 99.5% similarity, at least 99.6% similarity, at least 99.7% similarity, at least 99.8% similarity or at least 99.9% similarity to one of SEQ ID NO:1, SEQ ID NO:2, or SEQ ID NO:3.

In some embodiments, the CasX variant protein has at least about 60% sequence similarity to SEQ ID NO:2 or a portion thereof. In some embodiments, the CasX variant protein comprises a substitution of Y789T of SEQ ID NO:2, a deletion of P793 of SEQ ID NO:2, a substitution of Y789D of SEQ ID NO:2, a substitution of T72S of SEQ ID NO:2, a substitution of I546V of SEQ ID NO:2, a substitution of E552A of SEQ ID NO:2, a substitution of A636D of SEQ ID NO:2, a substitution of F536S of SEQ ID NO:2, a substitution of A708K of SEQ ID NO:2, a substitution of Y797L of SEQ ID NO:2, a substitution of L792G SEQ ID NO:2, a substitution of A739V of SEQ ID NO:2, a substitution of G791M of SEQ ID NO:2, an insertion of A at position 661 of SEQ ID NO:2, a substitution of A788W of SEQ ID NO:2, a substitution of K390R of SEQ ID NO:2, a substitution of A751S of SEQ ID NO:2, a substitution of E385A of SEQ ID NO:2, an insertion of P at position 696 of SEQ ID NO:2, an insertion of M at position 773 of SEQ ID NO:2, a substitution of G695H of SEQ ID NO:2, an insertion of AS at position 793 of SEQ ID NO:2, an insertion of AS at position 795 of SEQ ID NO:2, a substitution of C477R of SEQ ID NO:2, a substitution of C477K of SEQ ID NO:2, a substitution of C479A of SEQ ID NO:2, a substitution of C479L of SEQ ID NO:2, a substitution of I55F of SEQ ID NO:2, a substitution of K210R of SEQ ID NO:2, a substitution of C233S of SEQ ID NO:2, a substitution of D231N of SEQ ID NO:2, a substitution of Q338E of SEQ ID NO:2, a substitution of Q338R of SEQ ID NO:2, a substitution of L379R of SEQ ID NO:2, a substitution of K390R of SEQ ID NO:2, a substitution of L481Q of SEQ ID NO:2, a substitution of F495S of SEQ ID NO:2, a substitution of D600N of SEQ ID NO:2, a substitution of T886K of SEQ ID NO:2, a substitution of A739V of SEQ ID NO:2, a substitution of K460N of SEQ ID NO:2, a substitution of I199F of SEQ ID NO:2, a substitution of G492P of SEQ ID NO:2, a substitution of T153I of SEQ ID NO:2, a substitution of R591I of SEQ ID NO:2, an insertion of AS at position 795 of SEQ ID NO:2, an insertion of AS at position 796 of SEQ ID NO:2, an insertion of L at position 889 of SEQ ID NO:2, a substitution of E121D of SEQ ID NO:2, a substitution of S270W of SEQ ID NO:2, a substitution of E712Q of SEQ ID NO:2, a substitution of K942Q of SEQ ID NO:2, a substitution of E552K of SEQ ID NO:2, a substitution of K25Q of SEQ ID NO:2, a substitution of N47D of SEQ ID NO:2, an insertion of T at position 696 of SEQ ID NO:2, a substitution of L685I of SEQ ID NO:2, a substitution of N880D of SEQ ID NO:2, a substitution of Q102R of SEQ ID NO:2, a substitution of M734K of SEQ ID NO:2, a substitution of A724S of SEQ ID NO:2, a substitution of T704K of SEQ ID NO:2, a substitution of P224K of SEQ ID NO:2, a substitution of K25R of SEQ ID NO:2, a substitution of M29E of SEQ ID NO:2, a substitution of H152D of SEQ ID NO:2, a substitution of S219R of SEQ ID NO:2, a substitution of E475K of SEQ ID NO:2, a substitution of G226R of SEQ ID NO:2, a substitution of A377K of SEQ ID NO:2, a substitution of E480K of SEQ ID NO:2, a substitution of K416E of SEQ ID NO:2, a substitution of H164R of SEQ ID NO:2, a substitution of K767R of SEQ ID NO:2, a substitution of I7F of SEQ ID NO:2, a substitution of M29R of SEQ ID NO:2, a substitution of H435R of SEQ ID NO:2, a substitution of E385Q of SEQ ID NO:2, a substitution of E385K of SEQ ID NO:2, a substitution of I279F of SEQ ID NO:2, a substitution of D489S of SEQ ID NO:2, a substitution of D732N of SEQ ID NO:2, a substitution of A739T of SEQ ID NO:2, a substitution of W885R of SEQ ID NO:2, a substitution of E53K of SEQ ID NO:2, a substitution of A238T of SEQ ID NO:2, a substitution of P283Q of SEQ ID NO:2, a substitution of E292K of SEQ ID NO:2, a substitution of Q628E of SEQ ID NO:2, a substitution of R388Q of SEQ ID NO:2, a substitution of G791M of SEQ ID NO:2, a substitution of L792K of SEQ ID NO:2, a substitution of L792E of SEQ ID NO:2, a substitution of M779N of SEQ ID NO:2, a substitution of G27D of SEQ ID NO:2, a substitution of K955R of SEQ ID NO:2, a substitution of S867R of SEQ ID NO:2, a substitution of R693I of SEQ ID NO:2, a substitution of F189Y of SEQ ID NO:2, a substitution of V635M of SEQ ID NO:2, a substitution of F399L of SEQ ID NO:2, a substitution of E498K of SEQ ID NO:2, a substitution of E386R of SEQ ID NO:2, a substitution of V254G of SEQ ID NO:2, a substitution of P793S of SEQ ID NO:2, a substitution of K188E of SEQ ID NO:2, a substitution of QT945KI of SEQ ID NO:2, a substitution of T620P of SEQ ID NO:2, a substitution of T946P of SEQ ID NO:2, a substitution of TT949PP of SEQ ID NO:2, a substitution of N952T of SEQ ID NO:2, a substitution of K682E of SEQ ID NO:2, a substitution of K975R of SEQ ID NO:2, a substitution of L212P of SEQ ID NO:2, a substitution of E292R of SEQ ID NO:2, a substitution of I303K of SEQ ID NO:2, a substitution of C349E of SEQ ID NO:2, a substitution of E385P of SEQ ID NO:2, a substitution of E386N of SEQ ID NO:2, a substitution of D387K of SEQ ID NO:2, a substitution of L404K of SEQ ID NO:2, a substitution of E466H of SEQ ID NO:2, a substitution of C477Q of SEQ ID NO:2, a substitution of C477H of SEQ ID NO:2, a substitution of C479A of SEQ ID NO:2, a substitution of D659H of SEQ ID NO:2, a substitution of T806V of SEQ ID NO:2, a substitution of K808S of SEQ ID NO:2, an insertion of AS at position 797 of SEQ ID NO:2, a substitution of V959M of SEQ ID NO:2, a substitution of K975Q of SEQ ID NO:2, a substitution of W974G of SEQ ID NO:2, a substitution of A708Q of SEQ ID NO:2, a substitution of V711K of SEQ ID NO:2, a substitution of D733T of SEQ ID NO:2, a substitution of L742W of SEQ ID NO:2, a substitution of V747K of SEQ ID NO:2, a substitution of F755M of SEQ ID NO:2, a substitution of M771A of SEQ ID NO:2, a substitution of M771Q of SEQ ID NO:2, a substitution of W782Q of SEQ ID NO:2, a substitution of G791F, of SEQ ID NO:2 a substitution of L792D of SEQ ID NO:2, a substitution of L792K of SEQ ID NO:2, a substitution of P793Q of SEQ ID NO:2, a substitution of P793G of SEQ ID NO:2, a substitution of Q804A of SEQ ID NO:2, a substitution of Y966N of SEQ ID NO:2, a substitution of Y723N of SEQ ID NO:2, a substitution of Y857R of SEQ ID NO:2, a substitution of S890R of SEQ ID NO:2, a substitution of S932M of SEQ ID NO:2, a substitution of L897M of SEQ ID NO:2, a substitution of R624G of SEQ ID NO:2, a substitution of S603G of SEQ ID NO:2, a substitution of N737S of SEQ ID NO:2, a substitution of L307K of SEQ ID NO:2, a substitution of I658V of SEQ ID NO:2, an insertion of PT at position 688 of SEQ ID NO:2, an insertion of SA at position 794 of SEQ ID NO:2, a substitution of S877R of SEQ ID NO:2, a substitution of N580T of SEQ ID NO:2, a substitution of V335G of SEQ ID NO:2, a substitution of T620S of SEQ ID NO:2, a substitution of W345G of SEQ ID NO:2, a substitution of T280S of SEQ ID NO:2, a substitution of L406P of SEQ ID NO:2, a substitution of A612D of SEQ ID NO:2, a substitution of A751S of SEQ ID NO:2, a substitution of E386R of SEQ ID NO:2, a substitution of V351M of SEQ ID NO: 2, a substitution of K210N of SEQ ID NO:2, a substitution of D40A of SEQ ID NO:2, a substitution of E773G of SEQ ID NO:2, a substitution of H207L of SEQ ID NO:2, a substitution of T62A SEQ ID NO:2, a substitution of T287P of SEQ ID NO:2, a substitution of T832A of SEQ ID NO:2, a substitution of A893S of SEQ ID NO:2, an insertion of V at position 14 of SEQ ID NO:2, an insertion of AG at position 13 of SEQ ID NO:2, a substitution of R11V of SEQ ID NO:2, a substitution of R12N of SEQ ID NO: 2, a substitution of R13H of SEQ ID NO:2, an insertion of Y at position 13 of SEQ ID NO:2, a substitution of R12L of SEQ ID NO:2, an insertion of Q at position 13 of SEQ ID NO:2, an substitution of V15S of SEQ ID NO:2, an insertion of D at position 17 of SEQ ID NO:2 or a combination thereof.

In some embodiments, the CasX variant comprises at least one modification in the NTSB domain.

In some embodiments, the CasX variant comprises at least one modification in the TSL domain. In some embodiments, the at least one modification in the TSL domain comprises an amino acid substitution of one or more of amino acids Y857, S890, or S932 of SEQ ID NO:2.

In some embodiments, the CasX variant comprises at least one modification in the helical I domain. In some embodiments, the at least one modification in the helical I domain comprises an amino acid substitution of one or more of amino acids S219, L249, E259, Q252, E292, L307, or D318 of SEQ ID NO:2.

In some embodiments, the CasX variant comprises at least one modification in the helical II domain. In some embodiments, the at least one modification in the helical II domain comprises an amino acid substitution of one or more of amino acids D361, L379, E385, E386, D387, F399, L404, R458, C477, or D489 of SEQ ID NO:2.

In some embodiments, the CasX variant comprises at least one modification in the OBD domain. In some embodiments, the at least one modification in the OBD comprises an amino acid substitution of one or more of amino acids F536, E552, T620, or 1658 of SEQ ID NO:2.

In some embodiments, the CasX variant comprises at least one modification in the RuvC DNA cleavage domain. In some embodiments, the at least one modification in the RuvC DNA cleavage domain comprises an amino acid substitution of one or more of amino acids K682, G695, A708, V711, D732, A739, D733, L742, V747, F755, M771, M779, W782, A788, G791, L792, P793, Y797, M799, Q804, S819, or Y857 or a deletion of amino acid P793 of SEQ ID NO:2.

In some embodiments, the CasX variant comprises at least one modification compared to the reference CasX sequence of SEQ ID NO:2 is selected from one or more of: (a) an amino acid substitution of L379R; (b) an amino acid substitution of A708K; (c) an amino acid substitution of T620P; (d) an amino acid substitution of E385P; (e) an amino acid substitution of Y857R; (f) an amino acid substitution of I658V; (g) an amino acid substitution of F399L; (h) an amino acid substitution of Q252K; (i) an amino acid substitution of L404K; and (j) an amino acid deletion of P793.

In some embodiments, a CasX variant protein comprises at least two amino acid changes to a reference CasX protein amino acid sequence. The at least two amino acid changes can be substitutions, insertions, or deletions of a reference CasX protein amino acid sequence, or any combination thereof. The substitutions, insertions or deletions can be any substitution, insertion or deletion in the sequence of a reference CasX protein described herein. In some embodiments, the changes are contiguous, non-contiguous, or a combination of contiguous and non-contiguous amino acid changes to a reference CasX protein sequence. In some embodiments, the reference CasX protein is SEQ ID NO:2. In some embodiments, a CasX variant protein comprises at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 30, at least 40, at least 45, at least 50, at least 55, at least 60, at least 65, at least 70, at least 75, at least 80, at least 85, at least 90, at least 95 or at least 100 amino acid changes to a reference CasX protein sequence. In some embodiments, a CasX variant protein comprises 1-50, 3-40, 5-30, 5-20, 5-15, 5-10, 10-50, 10-40, 10-30, 10-20, 15-50, 15-40, 15-30, 2-25, 2-24, 2-22, 2-23, 2-22, 2-21, 2-20, 2-19, 2-18, 2-17, 2-16, 2-15, 2-14, 2-12, 2-11, 2-10, 2-9, 2-8, 2-7, 2-6, 2-5, 2-4, 2-3, 3-25, 3-24, 3-22, 3-23, 3-22, 3-21, 3-20, 3-19, 3-18, 3-17, 3-16, 3-15, 3-14, 3-12, 3-11, 3-10, 3-9, 3-8, 3-7, 3-6, 3-5, 3-4,4-25, 4-24, 4-22, 4-23, 4-22, 4-21, 4-20, 4-19, 4-18, 4-17, 4-16, 4-15, 4-14, 4-12, 4-11, 4-10, 4-9, 4-8, 4-7, 4-6, 4-5, 5-25, 5-24, 5-22, 5-23, 5-22, 5-21, 5-20, 5-19, 5-18, 5-17, 5-16, 5-15, 5-14, 5-12, 5-11, 5-10, 5-9, 5-8, 5-7 or 5-6 amino acid changes to a reference CasX protein sequence. In some embodiments, a CasX variant protein comprises 15-20 changes to a reference CasX protein sequence. In some embodiments, a CasX variant protein comprises 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 amino acid changes to a reference CasX protein sequence. In some embodiments, the at least two amino acid changes to the sequence of a reference CasX variant protein are selected from the group consisting of: a substitution of Y789T of SEQ ID NO:2, a deletion of P793 of SEQ ID NO:2, a substitution of Y789D of SEQ ID NO:2, a substitution of T72S of SEQ ID NO:2, a substitution of I546V of SEQ ID NO:2, a substitution of E552A of SEQ ID NO:2, a substitution of A636D of SEQ ID NO:2, a substitution of F536S of SEQ ID NO:2, a substitution of A708K of SEQ ID NO:2, a substitution of Y797L of SEQ ID NO:2, a substitution of L792G SEQ ID NO:2, a substitution of A739V of SEQ ID NO:2, a substitution of G791M of SEQ ID NO:2, an insertion of A at position 661 of SEQ ID NO:2, a substitution of A788W of SEQ ID NO:2, a substitution of K390R of SEQ ID NO:2, a substitution of A751S of SEQ ID NO:2, a substitution of E385A of SEQ ID NO:2, an insertion of P at position 696 of SEQ ID NO:2, an insertion of M at position 773 of SEQ ID NO:2, a substitution of G695H of SEQ ID NO:2, an insertion of AS at position 793 of SEQ ID NO:2, an insertion of AS at position 795 of SEQ ID NO:2, a substitution of C477R of SEQ ID NO:2, a substitution of C477K of SEQ ID NO:2, a substitution of C479A of SEQ ID NO:2, a substitution of C479L of SEQ ID NO:2, a substitution of I55F of SEQ ID NO:2, a substitution of K210R of SEQ ID NO:2, a substitution of C233S of SEQ ID NO:2, a substitution of D231N of SEQ ID NO:2, a substitution of Q338E of SEQ ID NO:2, a substitution of Q338R of SEQ ID NO:2, a substitution of L379R of SEQ ID NO:2, a substitution of K390R of SEQ ID NO:2, a substitution of L481Q of SEQ ID NO:2, a substitution of F495S of SEQ ID NO:2, a substitution of D600N of SEQ ID NO:2, a substitution of T886K of SEQ ID NO:2, a substitution of A739V of SEQ ID NO:2, a substitution of K460N of SEQ ID NO:2, a substitution of I199F of SEQ ID NO:2, a substitution of G492P of SEQ ID NO:2, a substitution of T153I of SEQ ID NO:2, a substitution of R591I of SEQ ID NO:2, an insertion of AS at position 795 of SEQ ID NO:2, an insertion of AS at position 796 of SEQ ID NO:2, an insertion of L at position 889 of SEQ ID NO:2, a substitution of E121D of SEQ ID NO:2, a substitution of S270W of SEQ ID NO:2, a substitution of E712Q of SEQ ID NO:2, a substitution of K942Q of SEQ ID NO:2, a substitution of E552K of SEQ ID NO:2, a substitution of K25Q of SEQ ID NO:2, a substitution of N47D of SEQ ID NO:2, an insertion of T at position 696 of SEQ ID NO:2, a substitution of L685I of SEQ ID NO:2, a substitution of N880D of SEQ ID NO:2, a substitution of Q102R of SEQ ID NO:2, a substitution of M734K of SEQ ID NO:2, a substitution of A724S of SEQ ID NO:2, a substitution of T704K of SEQ ID NO:2, a substitution of P224K of SEQ ID NO:2, a substitution of K25R of SEQ ID NO:2, a substitution of M29E of SEQ ID NO:2, a substitution of H152D of SEQ ID NO:2, a substitution of S219R of SEQ ID NO:2, a substitution of E475K of SEQ ID NO:2, a substitution of G226R of SEQ ID NO:2, a substitution of A377K of SEQ ID NO:2, a substitution of E480K of SEQ ID NO:2, a substitution of K416E of SEQ ID NO:2, a substitution of H164R of SEQ ID NO:2, a substitution of K767R of SEQ ID NO:2, a substitution of I7F of SEQ ID NO:2, a substitution of M29R of SEQ ID NO:2, a substitution of H435R of SEQ ID NO:2, a substitution of E385Q of SEQ ID NO:2, a substitution of E385K of SEQ ID NO:2, a substitution of I279F of SEQ ID NO:2, a substitution of D489S of SEQ ID NO:2, a substitution of D732N of SEQ ID NO:2, a substitution of A739T of SEQ ID NO:2, a substitution of W885R of SEQ ID NO:2, a substitution of E53K of SEQ ID NO:2, a substitution of A238T of SEQ ID NO:2, a substitution of P283Q of SEQ ID NO:2, a substitution of E292K of SEQ ID NO:2, a substitution of Q628E of SEQ ID NO:2, a substitution of R388Q of SEQ ID NO:2, a substitution of G791M of SEQ ID NO:2, a substitution of L792K of SEQ ID NO:2, a substitution of L792E of SEQ ID NO:2, a substitution of M779N of SEQ ID NO:2, a substitution of G27D of SEQ ID NO:2, a substitution of K955R of SEQ ID NO:2, a substitution of S867R of SEQ ID NO:2, a substitution of R693I of SEQ ID NO:2, a substitution of F189Y of SEQ ID NO:2, a substitution of V635M of SEQ ID NO:2, a substitution of F399L of SEQ ID NO:2, a substitution of E498K of SEQ ID NO:2, a substitution of E386R of SEQ ID NO:2, a substitution of V254G of SEQ ID NO:2, a substitution of P793S of SEQ ID NO:2, a substitution of K188E of SEQ ID NO:2, a substitution of QT945KI of SEQ ID NO:2, a substitution of T620P of SEQ ID NO:2, a substitution of T946P of SEQ ID NO:2, a substitution of TT949PP of SEQ ID NO:2, a substitution of N952T of SEQ ID NO:2, a substitution of K682E of SEQ ID NO:2, a substitution of K975R of SEQ ID NO:2, a substitution of L212P of SEQ ID NO:2, a substitution of E292R of SEQ ID NO:2, a substitution of I303K of SEQ ID NO:2, a substitution of C349E of SEQ ID NO:2, a substitution of E385P of SEQ ID NO:2, a substitution of E386N of SEQ ID NO:2, a substitution of D387K of SEQ ID NO:2, a substitution of L404K of SEQ ID NO:2, a substitution of E466H of SEQ ID NO:2, a substitution of C477Q of SEQ ID NO:2, a substitution of C477H of SEQ ID NO:2, a substitution of C479A of SEQ ID NO:2, a substitution of D659H of SEQ ID NO:2, a substitution of T806V of SEQ ID NO:2, a substitution of K808S of SEQ ID NO:2, an insertion of AS at position 797 of SEQ ID NO:2, a substitution of V959M of SEQ ID NO:2, a substitution of K975Q of SEQ ID NO:2, a substitution of W974G of SEQ ID NO:2, a substitution of A708Q of SEQ ID NO:2, a substitution of V711K of SEQ ID NO:2, a substitution of D733T of SEQ ID NO:2, a substitution of L742W of SEQ ID NO:2, a substitution of V747K of SEQ ID NO:2, a substitution of F755M of SEQ ID NO:2, a substitution of M771A of SEQ ID NO:2, a substitution of M771Q of SEQ ID NO:2, a substitution of W782Q of SEQ ID NO:2, a substitution of G791F, of SEQ ID NO:2 a substitution of L792D of SEQ ID NO:2, a substitution of L792K of SEQ ID NO:2, a substitution of P793Q of SEQ ID NO:2, a substitution of P793G of SEQ ID NO:2, a substitution of Q804A of SEQ ID NO:2, a substitution of Y966N of SEQ ID NO:2, a substitution of Y723N of SEQ ID NO:2, a substitution of Y857R of SEQ ID NO:2, a substitution of S890R of SEQ ID NO:2, a substitution of S932M of SEQ ID NO:2, a substitution of L897M of SEQ ID NO:2, a substitution of R624G of SEQ ID NO:2, a substitution of S603G of SEQ ID NO:2, a substitution of N737S of SEQ ID NO:2, a substitution of L307K of SEQ ID NO:2, a substitution of I658V of SEQ ID NO:2, an insertion of PT at position 688 of SEQ ID NO:2, an insertion of SA at position 794 of SEQ ID NO:2, a substitution of S877R of SEQ ID NO:2, a substitution of N580T of SEQ ID NO:2, a substitution of V335G of SEQ ID NO:2, a substitution of T620S of SEQ ID NO:2, a substitution of W345G of SEQ ID NO:2, a substitution of T280S of SEQ ID NO:2, a substitution of L406P of SEQ ID NO:2, a substitution of A612D of SEQ ID NO:2, a substitution of A751S of SEQ ID NO:2, a substitution of E386R of SEQ ID NO:2, a substitution of V351M of SEQ ID NO:2, a substitution of K210N of SEQ ID NO:2, a substitution of D40A of SEQ ID NO:2, a substitution of E773G of SEQ ID NO:2, a substitution of H207L of SEQ ID NO:2, a substitution of T62A SEQ ID NO:2, a substitution of T287P of SEQ ID NO:2, a substitution of T832A of SEQ ID NO:2, a substitution of A893S of SEQ ID NO:2, an insertion of V at position 14 of SEQ ID NO:2, an insertion of AG at position 13 of SEQ ID NO:2, a substitution of R11V of SEQ ID NO:2, a substitution of R12N of SEQ ID NO: 2, a substitution of R13H of SEQ ID NO:2, an insertion of Y at position 13 of SEQ ID NO:2, a substitution of R12L of SEQ ID NO:2, an insertion of Q at position 13 of SEQ ID NO:2, an substitution of V15S of SEQ ID NO:2 and an insertion of D at position 17 of SEQ ID NO:2. In some embodiments, the at least two amino acid changes to a reference CasX protein are selected from the amino acid changes disclosed in the sequences of Table 4. In some embodiments, a CasX variant comprises any combination of the foregoing embodiments of this paragraph.

In some embodiments, a CasX variant protein comprises more than one substitution, insertion and/or deletion of a reference CasX protein amino acid sequence. In some embodiments, the reference CasX protein comprises or consists essentially of SEQ ID NO:2. In some embodiments, a CasX variant protein comprises a substitution of S794R and a substitution of Y797L of SEQ ID NO:2. In some embodiments, a CasX variant protein comprises a substitution of K416E and a substitution of A708K of SEQ ID NO:2. In some embodiments, a CasX variant protein comprises a substitution of A708K and a deletion of P793 of SEQ ID NO:2. In some embodiments, a CasX variant protein comprises a deletion of P793 and an insertion of AS at position 795 SEQ ID NO:2. In some embodiments, a CasX variant protein comprises a substitution of Q367K and a substitution of 1425S of SEQ ID NO:2. In some embodiments, a CasX variant protein comprises a substitution of A708K, a deletion of P position 793 and a substitution A793V of SEQ ID NO:2. In some embodiments, a CasX variant protein comprises a substitution of Q338R and a substitution of A339E of SEQ ID NO:2. In some embodiments, a CasX variant protein comprises a substitution of Q338R and a substitution of A339K of SEQ ID NO:2. In some embodiments, a CasX variant protein comprises a substitution of S507G and a substitution of G508R of SEQ ID NO:2. In some embodiments, a CasX variant protein comprises a substitution of L379R, a substitution of A708K and a deletion of P at position 793 of SEQ ID NO:2. In some embodiments, a CasX variant protein comprises a substitution of C477K, a substitution of A708K and a deletion of P at position 793 of SEQ ID NO:2. In some embodiments, a CasX variant protein comprises a substitution of L379R, a substitution of C477K, a substitution of A708K and a deletion of P at position of 793 of SEQ ID NO:2. In some embodiments, a CasX variant protein comprises a substitution of L379R, a substitution of A708K, a deletion of P at position 793 and a substitution A739V of SEQ ID NO:2. In some embodiments, a CasX variant protein comprises a substitution of C477K, a substitution of A708K, a deletion of P at position 793 and a substitution of A739V of SEQ ID NO:2. In some embodiments, a CasX variant protein comprises a substitution of L379R, a substitution of C477K, a substitution of A708K, a deletion of P at position 793 and a substitution of A739V of SEQ ID NO:2. In some embodiments, a CasX variant protein comprises a substitution of L379R, a substitution of A708K, a deletion of P at position 793 and a substitution of M779N of SEQ ID NO:2. In some embodiments, a CasX variant protein comprises a substitution of L379R, a substitution of A708K, a deletion of P at position 793 and a substitution of M771N of SEQ ID NO:2. In some embodiments, a CasX variant protein comprises a substitution of L379R, a substitution of 708K, a deletion of P at position 793 and a substitution of D489S of SEQ ID NO:2. In some embodiments, a CasX variant protein comprises a substitution of L379R, a substitution of A708K, a deletion of P at position 793 and a substitution of A739T of SEQ ID NO:2. In some embodiments, a CasX variant protein comprises a substitution of L379R, a substitution of A708K, a deletion of P at position 793 and a substitution of D732N of SEQ ID NO:2. In some embodiments, a CasX variant protein comprises a substitution of L379R, a substitution of A708K, a deletion of P at position 793 and a substitution of G791M of SEQ ID NO:2. In some embodiments, a CasX variant protein comprises a substitution of L379R, a substitution of 708K, a deletion of P at position 793 and a substitution of Y797L of SEQ ID NO:2. In some embodiments, a CasX variant protein comprises a substitution of L379R, a substitution of C477K, a substitution of A708K, a deletion of P at position 793 and a substitution of M779N of SEQ ID NO:2. In some embodiments, a CasX variant protein comprises a substitution of L379R, a substitution of C477K, a substitution of A708K, a deletion of P at position 793 and a substitution of M771N of SEQ ID NO:2. In some embodiments, a CasX variant protein comprises a substitution of L379R, a substitution of C477K, a substitution of A708K, a deletion of P at position 793 and a substitution of D489S of SEQ ID NO:2. In some embodiments, a CasX variant protein comprises a substitution of L379R, a substitution of C477K, a substitution of A708K, a deletion of P at position 793 and a substitution of A739T of SEQ ID NO:2. In some embodiments, a CasX variant protein comprises a substitution of L379R, a substitution of C477K, a substitution of A708K, a deletion of P at position 793 and a substitution of D732N of SEQ ID NO:2. In some embodiments, a CasX variant protein comprises a substitution of L379R, a substitution of C477K, a substitution of A708K, a deletion of P at position 793 and a substitution of G791M of SEQ ID NO:2. In some embodiments, a CasX variant protein comprises a substitution of L379R, a substitution of C477K, a substitution of A708K, a deletion of P at position 793 and a substitution of Y797L of SEQ ID NO:2. In some embodiments, a CasX variant protein comprises a substitution of L379R, a substitution of C477K, a substitution of A708K, a deletion of P at position 793 and a substitution of T620P of SEQ ID NO:2. In some embodiments, a CasX variant protein comprises a substitution of A708K, a deletion of P at position 793 and a substitution of E386S of SEQ ID NO:2. In some embodiments, a CasX variant protein comprises a substitution of E386R, a substitution of F399L and a deletion of P at position 793 of SEQ ID NO:2. In some embodiments, a CasX variant protein comprises a substitution of R581I and A739V of SEQ ID NO:2. In some embodiments, a CasX variant comprises any combination of the foregoing embodiments of this paragraph.

In some embodiments, a CasX variant protein comprises more than one substitution, insertion and/or deletion of a reference CasX protein amino acid sequence. In some embodiments, a CasX variant protein comprises a substitution of A708K, a deletion of P at position 793 and a substitution of A739V of SEQ ID NO:2. In some embodiments, a CasX variant protein comprises a substitution of L379R, a substitution of A708K and a deletion of P at position 793 of SEQ ID NO:2. In some embodiments, a CasX variant protein comprises a substitution of C477K, a substitution of A708K and a deletion of P at position 793 of SEQ ID NO:2. In some embodiments, a CasX variant protein comprises a substitution of L379R, a substitution of C477K, a substitution of A708K and a deletion of P at position 793 of SEQ ID NO:2. In some embodiments, a CasX variant protein comprises a substitution of L379R, a substitution of A708K, a deletion of P at position 793 and a substitution of A739V of SEQ ID NO:2. In some embodiments, a CasX variant protein comprises a substitution of C477K, a substitution of A708K, a deletion of P at position 793 and a substitution of A739 of SEQ ID NO:2. In some embodiments, a CasX variant protein comprises a substitution of L379R, a substitution of C477K, a substitution of A708K, a deletion of P at position 793 and a substitution of A739V of SEQ ID NO:2. In some embodiments, a CasX variant protein comprises a substitution of L379R, a substitution of C477K, a substitution of A708K, a deletion of P at position 793 and a substitution of T620P of SEQ ID NO:2. In some embodiments, a CasX variant protein comprises a substitution of M771A of SEQ ID NO:2. In some embodiments, a CasX variant protein comprises a substitution of L379R, a substitution of A708K, a deletion of P at position 793 and a substitution of D732N of SEQ ID NO:2. In some embodiments, a CasX variant comprises any combination of the foregoing embodiments of this paragraph.

In some embodiments, a CasX variant protein comprises a substitution of W782Q of SEQ ID NO:2. In some embodiments, a CasX variant protein comprises a substitution of M771Q of SEQ ID NO:2. In some embodiments, a CasX variant protein comprises a substitution of R458I and a substitution of A739V of SEQ ID NO:2. In some embodiments, a CasX variant protein comprises a substitution of L379R, a substitution of A708K, a deletion of P at position 793 and a substitution of M77iN of SEQ ID NO:2. In some embodiments, a CasX variant protein comprises a substitution of L379R, a substitution of A708K, a deletion of P at position 793 and a substitution of A739T of SEQ ID NO:2. In some embodiments, a CasX variant protein comprises a substitution of L379R, a substitution of C477K, a substitution of A708K, a deletion of P at position 793 and a substitution of D489S of SEQ ID NO:2. In some embodiments, a CasX variant protein comprises a substitution of L379R, a substitution of C477K, a substitution of A708K, a deletion of P at position 793 and a substitution of D732N of SEQ ID NO:2. In some embodiments, a CasX variant protein comprises a substitution of V711K of SEQ ID NO:2. In some embodiments, a CasX variant protein comprises a substitution of L379R, a substitution of C477K, a substitution of A708K, a deletion of P at position 793 and a substitution of Y797L of SEQ ID NO:2. In some embodiments, a CasX variant protein comprises a substitution of L379R, a substitution of A708K and a deletion of P at position 793 of SEQ ID NO:2. In some embodiments, a CasX variant protein comprises a substitution of L379R, a substitution of C477K, a substitution of A708K, a deletion of P at position 793 and a substitution of M771N of SEQ ID NO:2. In some embodiments, a CasX variant protein comprises a substitution of A708K, a substitution of P at position 793 and a substitution of E386S of SEQ ID NO:2. In some embodiments, a CasX variant protein comprises a substitution of L379R, a substitution of C477K, a substitution of A708K and a deletion of P at position 793 of SEQ ID NO:2. In some embodiments, a CasX variant protein comprises a substitution of L792D of SEQ ID NO:2. In some embodiments, a CasX variant protein comprises a substitution of G791F of SEQ ID NO:2. In some embodiments, a CasX variant protein comprises a substitution of A708K, a deletion of P at position 793 and a substitution of A739V of SEQ ID NO:2. In some embodiments, a CasX variant protein comprises a substitution of L379R, a substitution of A708K, a deletion of P at position 793 and a substitution of A739V of SEQ ID NO:2. In some embodiments, a CasX variant protein comprises a substitution of C477K, a substitution of A708K and a substitution of P at position 793 of SEQ ID NO:2. In some embodiments, a CasX variant protein comprises a substitution of L249I and a substitution of M771N of SEQ ID NO:2. In some embodiments, a CasX variant protein comprises a substitution of V747K of SEQ ID NO:2. In some embodiments, a CasX variant protein comprises a substitution of L379R, a substitution of C477, a substitution of A708K, a deletion of P at position 793 and a substitution of M779N of SEQ ID NO:2. In some embodiments, a CasX variant protein comprises a substitution of F755M. In some embodiments, a CasX variant comprises any combination of the foregoing embodiments of this paragraph.

In some embodiments, a CasX variant protein comprises at least one modification compared to the reference CasX sequence of SEQ ID NO:2, wherein the at least one modification is selected from one or more of: an amino acid substitution of L379R; an amino acid substitution of A708K; an amino acid substitution of T620P; an amino acid substitution of E385P; an amino acid substitution of Y857R; an amino acid substitution of I658V; an amino acid substitution of F399L; an amino acid substitution of Q252K; and an amino acid deletion of [P793]. In some embodiments, a CasX variant protein comprises at least one modification compared to the reference CasX sequence of SEQ ID NO:2, wherein the at least one modification is selected from one or more of: an amino acid substitution of L379R; an amino acid substitution of A708K; an amino acid substitution of T620P; an amino acid substitution of E385P; an amino acid substitution of Y857R; an amino acid substitution of I658V; an amino acid substitution of F399L; an amino acid substitution of Q252K; an amino acid substitution of L404K; and an amino acid deletion of [P793]. In other embodiments, a CasX variant protein comprises any combination of the foregoing substitutions or deletions compared to the reference CasX sequence of SEQ ID NO:2. In other embodiments, the CasX variant protein can, in addition to the foregoing substitutions or deletions, further comprise a substitution of an NTSB and/or a helical 1b domain from the reference CasX of SEQ ID NO:1.

In some embodiments, the CasX variant protein comprises between 400 and 2000 amino acids, between 500 and 1500 amino acids, between 700 and 1200 amino acids, between 800 and 1100 amino acids, or between 900 and 1000 amino acids.

In some embodiments, the CasX variant protein comprises one or more modifications in a region of non-contiguous residues that form a channel in which gNA:target DNA complexing occurs. In some embodiments, the CasX variant protein comprises one or more modifications comprising a region of non-contiguous residues that form an interface which binds with the gNA. For example, in some embodiments of a reference CasX protein, the helical I, helical II and OBD domains all contact or are in proximity to the gNA:target DNA complex, and one or more modifications to non-contiguous residues within any of these domains may improve function of the CasX variant protein.

In some embodiments, the CasX variant protein comprises one or more modifications in a region of non-contiguous residues that form a channel which binds with the non-target strand DNA. For example, a CasX variant protein can comprise one or more modifications to non-contiguous residues of the NTSBD. In some embodiments, the CasX variant protein comprises one or more modifications in a region of non-contiguous residues that form an interface which binds with the PAM. For example, a CasX variant protein can comprise one or more modifications to non-contiguous residues of the helical I domain or OBD. In some embodiments, the CasX variant protein comprises one or more modifications comprising a region of non-contiguous surface-exposed residues. As used herein, "surface-exposed residues" refers to amino acids on the surface of the CasX protein, or amino acids in which at least a portion of the amino acid, such as the backbone or a part of the side chain is on the surface of the protein. Surface exposed residues of cellular proteins such as CasX, which are exposed to an aqueous intracellular environment, are frequently selected from positively charged hydrophilic amino acids, for example arginine, asparagine, aspartate, glutamine, glutamate, histidine, lysine, serine, and threonine. Thus, for example, in some embodiments of the variants provided herein, a region of surface exposed residues comprises one or more insertions, deletions, or substitutions compared to a reference CasX protein. In some embodiments, one or more positively charged residues are substituted for one or more other positively charged residues, or negatively charged residues, or uncharged residues, or any combinations thereof. In some embodiments, one or more amino acids residues for substitution are near bound nucleic acid, for example residues in the RuvC domain or helical I domain that contact target DNA, or residues in the OBD or helical II domain that bind the gNA, can be substituted for one or more positively charged or polar amino acids.

In some embodiments, the CasX variant protein comprises one or more modifications in a region of non-contiguous residues that form a core through hydrophobic packing in a domain of the reference CasX protein. Without wishing to be bound by any theory, regions that form cores through hydrophobic packing are rich in hydrophobic amino acids such as valine, isoleucine, leucine, methionine, phenylalanine, tryptophan, and cysteine. For example, in some reference CasX proteins, RuvC domains comprise a hydrophobic pocket adjacent to the active site. In some embodiments, between 2 to 15 residues of the region are charged, polar, or base-stacking. Charged amino acids (sometimes referred to herein as residues) may include, for example, arginine, lysine, aspartic acid, and glutamic acid, and the side chains of these amino acids may form salt bridges provided a bridge partner is also present. Polar amino acids may include, for example, glutamine, asparagine, histidine, serine, threonine, tyrosine, and cysteine. Polar amino acids can, in some embodiments, form hydrogen bonds as proton donors or acceptors, depending on the identity of their side chains. As used herein, "base-stacking" includes the interaction of aromatic side chains of an amino acid residue (such as tryptophan, tyrosine, phenylalanine, or histidine) with stacked nucleotide bases in a nucleic acid. Any modification to a region of non-contiguous amino acids that are in close spatial proximity to form a functional part of the CasX variant protein is envisaged as within the scope of the disclosure.

i. CasX Variant Proteins with Domains from Multiple Source Proteins

In certain embodiments, the disclosure provides a chimeric CasX protein comprising protein domains from two or more different CasX proteins, such as two or more reference CasX proteins, or two or more CasX variant protein sequences as described herein. As used herein, a "chimeric CasX protein" refers to a CasX containing at least two domains isolated or derived from different sources, such as two naturally occurring proteins, which may, in some embodiments, be isolated from different species. For example, in some embodiments, a chimeric CasX protein comprises a first domain from a first CasX protein and a second domain from a second, different CasX protein. In some embodiments, the first domain can be selected from the group consisting of the NTSB, TSL, Helical I, Helical II, OBD and RuvC domains. In some embodiments, the second domain is selected from the group consisting of the NTSB, TSL, Helical I, Helical II, OBD and RuvC domains with the second domain being different from the foregoing first domain. For example, a chimeric CasX protein may comprise an NTSB, TSL, Helical I, Helical II, OBD domains from a CasX protein of SEQ ID NO:2, and a RuvC domain from a CasX protein of SEQ ID NO:1, or vice versa. As a further example, a chimeric CasX protein may comprise an NTSB, TSL, Helical II, OBD and RuvC domain from CasX protein of SEQ ID NO:2, and a Helical I domain from a CasX protein of SEQ ID NO:1, or vice versa. Thus, in certain embodiments, a chimeric CasX protein may comprise an NTSB, TSL, Helical II, OBD and RuvC domain from a first CasX protein, and a Helical I domain from a second CasX protein. In some embodiments of the chimeric CasX proteins, the domains of the first CasX protein are derived from the sequences of SEQ ID NO:1, SEQ ID NO:2 or SEQ ID NO:3, and the domains of the second CasX protein are derived from the sequences of SEQ ID NO:1, SEQ ID NO:2 or SEQ ID NO:3, and the first and second CasX proteins are not the same. In some embodiments, domains of the first CasX protein comprise sequences derived from SEQ ID NO:1 and domains of the second CasX protein comprise sequences derived from SEQ ID NO:2. In some embodiments, domains of the first CasX protein comprise sequences derived from SEQ ID NO:1 and domains of the second CasX protein comprise sequences derived from SEQ ID NO:3. In some embodiments, domains of the first CasX protein comprise sequences derived from SEQ ID NO:2 and domains of the second CasX protein comprise sequences derived from SEQ ID NO:3. In some embodiments, the CasX variant is selected of group consisting of CasX variants 387, 388, 389, 390, 395, 485, 486, 487, 488, 489, 490, and 491, the sequences of which are set forth in Table 4.

In some embodiments, a CasX variant protein comprises at least one chimeric domain comprising a first part from a first CasX protein and a second part from a second, different CasX protein. As used herein, a "chimeric domain" refers to a domain containing at least two parts isolated or derived from different sources, such as two naturally occurring proteins or portions of domains from two reference CasX proteins. The at least one chimeric domain can be any of the NTSB, TSL, helical I, helical II, OBD or RuvC domains as described herein. In some embodiments, the first portion of a CasX domain comprises a sequence of SEQ ID NO:1 and the second portion of a CasX domain comprises a sequence of SEQ ID NO:2. In some embodiments, the first portion of the CasX domain comprises a sequence of SEQ ID NO:1 and the second portion of the CasX domain comprises a sequence of SEQ ID NO:3. In some embodiments, the first portion of the CasX domain comprises a sequence of SEQ ID NO:2 and the second portion of the CasX domain comprises a sequence of SEQ ID NO:3. In some embodiments, the at least one chimeric domain comprises a chimeric RuvC domain. As an example of the foregoing, the chimeric RuvC domain comprises amino acids 661 to 824 of SEQ ID NO:1 and amino acids 922 to 978 of SEQ ID NO:2. As an alternative example of the foregoing, a chimeric RuvC domain comprises amino acids 648 to 812 of SEQ ID NO:2 and amino acids 935 to 986 of SEQ ID NO:1. In some embodiments, a CasX protein comprises a first domain from a first CasX protein and a second domain from a second CasX protein, and at least one chimeric domain comprising at least two parts isolated from different CasX proteins using the approach of the embodiments described in this paragraph. In the foregoing embodiments, the chimeric CasX proteins having domains or portions of domains derived from SEQ ID NOS:1, 2 and 3, can further comprise amino acid insertions, deletions, or substitutions of any of the embodiments disclosed herein.

In some embodiments, a CasX variant protein comprises a sequence set forth in Tables 4, 7, 8, 9, or 11. In some embodiments, a CasX variant protein consists of a sequence set forth in Table 4. In other embodiments, a CasX variant protein comprises a sequence at least 60% identical, at least 65% identical, at least 70% identical, at least 75% identical, at least 80% identical, at least 81% identical, at least 82% identical, at least 83% identical, at least 84% identical, at least 85% identical, at least 86% identical, at least 86% identical, at least 87% identical, at least 88% identical, at least 89% identical, at least 89% identical, at least 90% identical, at least 91% identical, at least 92% identical, at least 93% identical, at least 94% identical, at least 95% identical, at least 96% identical, at least 97% identical, at least 98% identical, at least 99% identical, at least 99.5% identical to a sequence set forth in Tables 4, 7, 8, 9, or 11. In other embodiments, a CasX variant protein comprises a sequence set forth in Table 4, and further comprises one or more NLS disclosed herein at or near either the N-terminus, the C-terminus, or both. It will be understood that in some cases, the N-terminal methionine of the CasX variants of the Tables is removed from the expressed CasX variant during post-translational modification.

TABLE 4

CasX Variant Sequences

| Description* | Amino Acid Sequence |
|---|---|
| TSL, Helical I, Helical II, OBD and RuvC domains from SEQ ID NO: 2 and an NTSB domain from SEQ ID NO: 1 | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPASKKIDQNKLKPEMDEKGNLTTAGFACSQCGQPLFVYKLEQVSEK GKAYTNYFGRCNVAEHEKLILLAQLKPEKDSDEAVTYSLGKFGQRALDF YSIHVTRESNHPVKPLEQIGGNSCASGPVGKALSDACMGAVASFLTKYQ DIILEHQKVIKKNEKRLANLKDIASANGLAFPKITLPPQPHTKEGIEAYNNV VAQIVIWVNLNLWQKLKIGRDEAKPLQRLKGFPSFPLVERQANEVDWW DMVCNVKKLINEKKEDGKVFWQNLAGYKRQEALRPYLSSEEDRKKGKK FARYQFGDLLLHLEKKHGEDWGKVYDEAWERIDKKVEGLSKHIKLEEER RSEDAQSKAALTDWLRAKASFVIEGLKEADKDEFCRCELKLQKWYGDL RGKPFAIEAENSILDISGFSKQYNCAFIWQKDGVKKLNLYLIINYFKGGKL RFKKIKPEAFEANRFYTVINKKSGEIVPMEVNFNFDDPNLIILPLAFGKRQ GREFIWNDLLSLETGSLKLANGRVIEKTLYNRRTRQDEPALFVALTFERR EVLDSSNIKPMNLIGIDRGENIPAVIALTDPEGCPLSRFKDSLGNPTHILRI GESYKEKQRTIQAKKEVEQRRAGGYSRKYASKAKNLADDMVRNTARDL LYYAVTQDAMLIFENLSRGFGRQGKRTFMAERQYTRMEDWLTAKLAYE GLSKTYLSKTLAQYTSKTCSNCGFTITSADYDRVLEKLKKTATGWMTTIN GKELKVEGQITYYNRYKRQNVVKDLSVELDRLSEESVNNDISSWTKGRS GEALSLLKKRFSHRPVQEKFVCLNCGFETHADEQAALNIARSWLFLRSQ EYKKYQTNKTTGNTDKRAFVETWQSFYRKKLKEVWKPAV (SEQ ID NO: 49) |
| NTSB, Helical I, Helical II, OBD and RuvC domains from SEQ ID NO: 2 and a TSL domain from SEQ ID NO: 1. | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAKKEVEQRRAGGYSRKYASKAKNLADDMVRNTARDLLYY AVTQDAMLIFENLSRGFGRQGKRTFMAERQYTRMEDWLTAKLAYEGLS KTYLSKTLAQYTSKTCSNCGFTITTADYDGMLVRLKKTSDGWATTLNNK ELKAEGQITYYNRYKRQTVEKELSAELDRLSEESGNNDISKWTKGRRDE ALFLLKKRFSHRPVQEQFVCLDCGHEVHADEQAALNIARSWLFLRSQEY KKYQTNKTTGNTDKRAFVETWQSFYRKKLKEVWKPAV (SEQ ID NO: 50) |

TABLE 4-continued

CasX Variant Sequences

| Description* | Amino Acid Sequence |
|---|---|
| TSL, Helical I, Helical II, OBD and RuvC domains from SEQ ID NO: 1 and an NTSB domain from SEQ ID NO: 2 | MEKRINKIRKKLSADNATKPVSRSGPMKTLLVRVMTDDLKKRLEKRRKK PEVMPQVISNNAANNLRMLLDDYTKMKEAILQVYWQEFKDDHVGLMCK FAQPAPKNIDQRKLIPVKDGNERLTSSGFACSQCCQPLYVYKLEQVNDK GKPHTNYFGRCNVSEHERLILLSPHKPEANDELVTYSLGKFGQRALDFY SIHVTKESTHPVKPLAQIAGNRYASGPVGKALSDACMGTIASFLSKYQDII IEHQKVVKGNQKRLESLRELAGKENLEYPSVTLPPQPHTKEGVDAYNEV IARVRMWVNLNLWQKLKLSRDDAKPLLRLKGFPSFPVVERRENEVDWW NTINEVKKLIDAKRDMGRVFWSGVTAEKRNTILEGYNYLPNENDHKKRE GSLENPKKPAKRQFGDLLLYLEKKYAGDWGKVFDEAWERIDKKIAGLTS HIEREEARNAEDAQSKAVLTDWLRAKASFVLERLKEMDEKEFYACEIQL QKWYGDLRGNPFAVEAENRWVDISGFSIGSDGHSIQYRNLLAWKYLEN GKREFYLLMNYGKKGRIRFTDGTDIKKSGKWQGLLYGGGKAKVIDLTFD PDDEQLIILPLAFGTRQGREFIWNDLLSLETGLIKLANGRVIEKTIYNKKIG RDEPALFVALTFERREWDPSNIKPVNLIGVDRGENIPAVIALTDPEGCPL PEFKDSSGGPTDILRIGEGYKEKQRAIQAAKEVEQRRAGGYSRKFASKS RNLADDMVRNSARDLFYHAVTHDAVLVFENLSRGFGRQGKRTFMTER QYTKMEDWLTAKLAYEGLTSKTYLSKTLAQYTSKTCSNCGFTITTADYD GMLVRLKKTSDGWATTLNNKELKAEGQITYYNRYKRQTVEKELSAELDR LSEESGNNDISKWTKGRRDEALFLLKKRFSHRPVQEQFVCLDCGHEVH ADEQAALNIARSWLFLNSNSTEFKSYKSGKQPFVGAWQAFYKRRLKEV WKPNA (SEQ ID NO: 51) |
| NTSB, Helical I, Helical II, OBD and RuvC domains from SEQ ID NO: 1 and an TSL domain from SEQ ID NO: 2. | MEKRINKIRKKLSADNATKPVSRSGPMKTLLVRVMTDDLKKRLEKRRKK PEVMPQVISNNAANNLRMLLDDYTKMKEAILQVYWQEFKDDHVGLMCK FAQPASKKIDQNKLKPEMDEKGNLTTAGFACSQCGQPLFVYKLEQVSE KGKAYTNYFGRCNVAEHEKLILLAQLKPEKDSDEAVTYSLGKFGQRALD FYSIHVTKESTHPVKPLAQIAGNRYASGPVGKALSDACMGTIASFLSKYQ DIIIEHQKVVKGNQKRLESLRELAGKENLEYPSVTLPPQPHTKEGVDAYN EVIARVRMWVNLNLWQKLKLSRDDAKPLLRLKGFPSFPWVERRENEVD WWNTINEVKKLIDAKRDMGRVFWSGVTAEKRNTILEGYNYLPNENDHK KREGSLENPKKPAKRQFGDLLLYLEKKYAGDWGKVFDEAWERIDKKIAG LTSHIEREEARNAEDAQSKAVLTDWLRAKASFVLERLKEMDEKEFYACEI QLQKWYGDLRGNPFAVEAENRVVDISGFSIGSDGHSIQYRNLLAWKYLE NGKREFYLLMNYGKKGRIRFTDGTDIKKSGKWQGLLYGGGKAKVIDLTF DPDDEQLIILPLAFGTRQGREFIWNDLLSLETGLIKLANGRVIEKTIYNKKI GRDEPALFVALTFERREVVDPSNIKPVNLIGVDRGENIPAVIALTDPEGCP LPEFKDSSGGPTDILRIGEGYKEKQRAIQAAKEVEQRRAGGYSRKFASK SRNLADDMVRNSARDLFYHAVTHDAVLVFENLSRGFGRQGKRTFMTER QYTKMEDWLTAKLAYEGLTSKTYLSKTLAQYTSKTCSNCGFTITSADYD RVLEKLKKTATGWMTTINGKELKVEGQITYYNRYKRQNVVKDLSVELDR LSEESVNNDISSWTKGRSGEALSLLKKRFSHRPVQEKFVCLNCGFETHA DEQAALNIARSWLFLNSNSTEFKSYKSGKQPFVGAWQAFYKRRLKEVW KPNA (SEQ ID NO: 52) |
| NTSB, TSL, Helical I, Helical II and OBD domains SEQ ID NO: 2 and an exogenous RuvC domain or a portion thereof from a second CasX protein. | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPVNLIGVDRGENIPAVIALTDPEGCPLPEFKDSSGGPTDILRIGE GYKEKQRAIQAAKEVEQRRAGGYSRKFASKSRNLADDMVRNSARDLFY HAVTHDAVLVFENLSRGFGRQGKRTFMTERQYTKMEDWLTAKLAYEGL TSKTYLSKTLAQYTSKTCSNCGFTITSADYDRVLEKLKKTATGWMTTING KELKVEGQITYYNRYKRQNVVKDLSVELDRLSEESVNNDISSWTKGRSG EALSLLKKRFSHRPVQEKFVCLNCGFETHA (SEQ ID NO: 53) |
| | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE |

TABLE 4-continued

CasX Variant Sequences

| Description* | Amino Acid Sequence |
|---|---|
| | FIWNDLLSLETGSLKLANGRVIEKTLYNRRTRQDEPALFVALTFERREVL<br>DSSNIKPMNLIGIDRGENIPAVIALTDPEGCPLSRFKDSLGNPTHILRIGES<br>YKEKQRTIQAKKEVEQRRAGGYSRKYASKAKNLADDMVRNTARDLLYY<br>AVTQDAMLIFENLSRGFGRQGKRTFMAERQYTRMEDWLTAKLAYEGLS<br>KTYLSKTLAQYTSKTCSNCGFTITSADYDRVLEKLKKTATGWMTTINGKE<br>LKVEGQITYYNRYKRQNVVKDLSVELDRLSEESVNNDISSWTKGRSGEA<br>LSLLKKRFSHRPVQEKFVCLNCGFETHA (SEQ ID NO: 54) |
| NTSB, TSL, Helical II, OBD and RuvC domains from SEQ ID NO: 2 and a Helical I domain from SEQ ID NO: 1 | MQEIKRINKIRRRLVKDSNTKKAGKTGPMKTLLVRVMTPDLRERLENLRK<br>KPENIPQPISNNAANNLRMLLDDYTKMKEAILQVYWQEFKDDHVGLMCK<br>FAQPAPKNIDQRKLIPVKDGNERLTSSGFACSQCCQPLYVYKLEQVNDK<br>GKPHTNYFGRCNVSEHERLILLSPHKPEANDELVTYSLGKFGQRALDFY<br>SIHVTKESTHPVKPLAQIAGNRYASGPVGKALSDACMGTIASFLSKYQDII<br>IEHQKVVKGNQKRLESLRELAGKENLEYPSVTLPPQPHTKEGVDAYNEV<br>IARVRMWVNLNLWQKLKLSRDDAKPLLRLKGFPSFPLVERQANEVDWW<br>DMVCNVKKLINEKKEDGKVFWQNLAGYKRQEALRPYLSSEEDRKKGKK<br>FARYQFGDLLLHLEKKHGEDWGKVYDEAWERIDKKVEGLSKHIKLEEER<br>RSEDAQSKAALTDWLRAKASFVIEGLKEADKDEFCRCELKLQKWYGDL<br>RGKPFAIEAENSILDISGFSKQYNCAFIWQKDGVKKLNLYLIINYFKGGKL<br>RFKKIKPEAFEANRFYTVINKKSGEIVPMEVNFNFDDPNLIILPLAFGKRQ<br>GREFIWNDLLSLETGSLKLANGRVIEKTLYNRRTRQDEPALFVALTFERR<br>EVLDSSNIKPMNLIGIDRGENIPAVIALTDPEGCPLSRFKDSLGNPTHILRI<br>GESYKEKQRTIQAKKEVEQRRAGGYSRKYASKAKNLADDMVRNTARDL<br>LYYAVTQDAMLIFENLSRGFGRQGKRTFMAERQYTRMEDWLTAKLAYE<br>GLSKTYLSKTLAQYTSKTCSNCGFTITSADYDRVLEKLKKTATGWMTTIN<br>GKELKVEGQITYYNRYKRQNVVKDLSVELDRLSEESVNNDISSWTKGRS<br>GEALSLLKKRFSHRPVQEKFVCLNCGFETHADEQAALNIARSWLFLRSQ<br>EYKKYQTNKTTGNTDKRAFVETWQSFYRKKLKEVWKPAV<br>(SEQ ID NO: 55) |
| NTSB, TSL, Helical I, OBD and RuvC domains from SEQ ID NO: 2 and a Helical II domain from SEQ ID NO: 1 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPVVERRENEVDWWNTI<br>NEVKKLIDAKRDMGRVFWSGVTAEKRNTILEGYNYLPNENDHKKREGSL<br>ENPKKPAKRQFGDLLLYLEKKYAGDWGKVFDEAWERIDKKIAGLTSHIE<br>REEARNAEDAQSKAVLTDWLRAKASFVLERLKEMDEKEFYACEIQLQK<br>WYGDLRGNPFAVEAENSILDISGFSKQYNCAFIWQKDGVKKLNLYLIINY<br>FKGGKLRFKKIKPEAFEANRFYTVINKKSGEIVPMEVNFNFDDPNLIILPLA<br>FGKRQGREFIWNDLLSLETGSLKLANGRVIEKTLYNRRTRQDEPALFVAL<br>TFERREVLDSSNIKPMNLIGIDRGENIPAVIALTDPEGCPLSRFKDSLGNP<br>THILRIGESYKEKQRTIQAKKEVEQRRAGGYSRKYASKAKNLADDMVRN<br>TARDLLYYAVTQDAMLIFENLSRGFGRQGKRTFMAERQYTRMEDWLTA<br>KLAYEGLSKTYLSKTLAQYTSKTCSNCGFTITSADYDRVLEKLKKTATGW<br>MTTINGKELKVEGQITYYNRYKRQNVVKDLSVELDRLSEESVNNDISSW<br>TKGRSGEALSLLKKRFSHRPVQEKFVCLNCGFETHADEQAALNIARSWL<br>FLRSQEYKKYQTNKTTGNTDKRAFVETWQSFYRKKLKEVWKPAV<br>(SEQ ID NO: 56) |
| NTSB, TSL, Helical I, Helical II and RuvC domains from a first CasX protein and an exogenous OBD or a part thereof from a second CasX protein | MISNTSRANLNKLLTDYTEMKKAILHVYWEEFQKDPVGLMSRVAQPAPK<br>NIDQRKLIPVKDGNERLTSSGFACSQCCQPLYVYKLEQVNDKGKPHTNY<br>FGRCNVSEHERLILLSPHKPEANDELVTYSLGKFGQRALDFYSIHVTRES<br>NHPVKPLEQIGGNSCASGPVGKALSDACMGAVASFLTKYQDIILEHQKVI<br>KKNEKRLANLKDIASANGLAFPKITLPPQPHTKEGIEAYNNVVAQIVIWVN<br>LNLWQKLKIGRDEAKPLQRLKGFPSFPLVERQANEVDWWDMVCNVKKL<br>INEKKEDGKVFWQNLAGYKRQEALRPYLSSEEDRKKGKKFARYQFGDL<br>LLHLEKKHGEDWGKVYDEAWERIDKKVEGLSKHIKLEEERRSEDAQSKA<br>ALTDWLRAKASFVIEGLKEADKDEFCRCELKLQKWYGDLRGKPFAIEAE<br>NRVVDISGFSIGSDGHSIQYRNLLAWKYLENGKREFYLLMNYGKKGRIR<br>FTDGTDIKKSGKWQGLLYGGGKAKVIDLTFDPDDEQLIILPLAFGTRQGR<br>EFIWNDLLSLETGLIKLANGRVIEKTIYNKKIGRDEPALFVALTFERREVVD<br>PSNIKPMNLIGIDRGENIPAVIALTDPEGCPLSRFKDSLGNPTHILRIGESY<br>KEKQRTIQAKKEVEQRRAGGYSRKYASKAKNLADDMVRNTARDLLYYA<br>VTQDAMLIFENLSRGFGRQGKRTFMAERQYTRMEDWLTAKLAYEGLSK<br>TYLSKTLAQYTSKTCSNCGFTITSADYDRVLEKLKKTATGWMTTINGKEL<br>KVEGQITYYNRYKRQNVVKDLSVELDRLSEESVNNDISSWTKGRSGEAL<br>SLLKKRFSHRPVQEKFVCLNCGFETHADEQAALNIARSWLFLRSQEYKK<br>YQTNKTTGNTDKRAFVETWQSFYRKKLKEVWKPAV<br>(SEQ ID NO: 57) |
| | MEKRINKIRKKLSADNATKPVSRSGPMKTLLVRVMTDDLKKRLEKRRKK<br>PEVMPQVISNTSRANLNKLLTDYTEMKKAILHVYWEEFQKDPVGLMSRV<br>AQPAPKNIDQRKLIPVKDGNERLTSSGFACSQCCQPLYVYKLEQVNDKG |

TABLE 4-continued

CasX Variant Sequences

| Description* | Amino Acid Sequence |
|---|---|
| | KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAKKEVEQRRAGGYSRKYASKAKNLADDMVRNTARDLLYY AVTQDAMLIFENLSRGFGRQGKRTFMAERQYTRMEDWLTAKLAYEGLS KTYLSKTLAQYTSKTCSNCGFTITSADYDRVLEKLKKTATGWMTTINGKE LKVEGQITYYNRYKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 58) |
| | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENRWDISGFSIGSDGHSIQYRNLLAWKYLENGKREFYLLMNY GKKGRIRFTDGTDIKKSGKWQGLLYGGGKAKVIDLTFDPDDEQLIILPLAF GTRQGREFIWNDLLSLETGLIKLANGRVIEKTIYNKKIGRDEPALFVALTF ERREVVDPSNIKPMNLIGIDRGENIPAVIALTDPEGCPLSRFKDSLGNPTH ILRIGESYKEKQRTIQAKKEVEQRRAGGYSRKYASKAKNLADDMVRNTA RDLLYYAVTQDAMLIFENLSRGFGRQGKRTFMAERQYTRMEDWLTAKL AYEGLSKTYLSKTLAQYTSKTCSNCGFTITSADYDRVLEKLKKTATGWM TTINGKELKVEGQITYYNRYKRQNVVKDLSVELDRLSEESVNNDISSWTK GRSGEALSLLKKRFSHRPVQEKFVCLNCGFETHADEQAALNIARSWLFL RSQEYKKYQTNKTTGNTDKRAFVETWQSFYRKKLKEVWKPAV (SEQ ID NO: 59) |
| substitution of L379R, a substitution of C477K, a substitution of A708K, a deletion of P at position 793 and a substitution of T620P of SEQ ID NO: 2 | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFKRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKPLYNRRTRQDEPALFVALTFERREVL DSSNIKPMNLIGIDRGENIPAVIALTDPEGCPLSRFKDSLGNPTHILRIGES YKEKQRTIQAKKEVEQRRAGGYSRKYASKAKNLADDMVRNTARDLLYY AVTQDAMLIFENLSRGFGRQGKRTFMAERQYTRMEDWLTAKLAYEGLS KTYLSKTLAQYTSKTCSNCGFTITSADYDRVLEKLKKTATGWMTTINGKE LKVEGQITYYNRYKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 60) |
| substitution of M771A of SEQ ID NO: 2. | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALLPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL |

TABLE 4-continued

| CasX Variant Sequences | |
|---|---|
| Description* | Amino Acid Sequence |
| | DSSNIKPMNLIGIDRGENIPAVIALTDPEGCPLSRFKDSLGNPTHILRIGES<br>YKEKQRTIQAAKEVEQRRAGGYSRKYASKAKNLADDMVRNTARDLLYY<br>AVTQDAMLIFENLSRGFGRQGKRTFAAERQYTRMEDWLTAKLAYEGLP<br>SKTYLSKTLAQYTSKTCSNCGFTITSADYDRVLEKLKKTATGWMTTINGK<br>ELKVEGQITYYNRYKRQNVVKDLSVELDRLSEESVNNDISSWTKGRSGE<br>ALSLLKKRFSHRPVQEKFVCLNCGFETHADEQAALNIARSWLFLRSQEY<br>KKYQTNKTTGNTDKRAFVETWQSFYRKKLKEVWKPA<br>(SEQ ID NO: 61) |
| substitution of L379R, a substitution of A708K, a deletion of P at position 793 and a substitution of D732N of SEQ ID NO: 2. | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSEEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGIDRGENIPAVIALTDPEGCPLSRFKDSLGNPTHILRIGES<br>YKEKQRTIQAKKEVEQRRAGGYSRKYASKAKNLANDMVRNTARDLLYY<br>AVTQDAMLIFENLSRGFGRQGKRTFMAERQYTRMEDWLTAKLAYEGLS<br>KTYLSKTLAQYTSKTCSNCGFTITSADYDRVLEKLKKTATGWMTTINGKE<br>LKVEGQITYYNRYKRQNVVKDLSVELDRLSEESVNNDISSWTKGRSGEA<br>LSLLKKRFSHRPVQEKFVCLNCGFETHADEQAALNIARSWLFLRSQEYK<br>KYQTNKTTGNTDKRAFVETWQSFYRKKLKEVWKPAV<br>(SEQ ID NO: 62) |
| substitution of W782Q of SEQ ID NO: 2. | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALLPYLSSEEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGIDRGENIPAVIALTDPEGCPLSRFKDSLGNPTHILRIGES<br>YKEKQRTIQAAKEVEQRRAGGYSRKYASKAKNLADDMVRNTARDLLYY<br>AVTQDAMLIFENLSRGFGRQGKRTFMAERQYTRMEDQLTAKLAYEGLP<br>SKTYLSKTLAQYTSKTCSNCGFTITSADYDRVLEKLKKTATGWMTTINGK<br>ELKVEGQITYYNRYKRQNVVKDLSVELDRLSEESVNNDISSWTKGRSGE<br>ALSLLKKRFSHRPVQEKFVCLNCGFETHADEQAALNIARSWLFLRSQEY<br>KKYQTNKTTGNTDKRAFVETWQSFYRKKLKEVWKPAV<br>(SEQ ID NO: 63) |
| substitution of M771Q of SEQID NO: 2 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALLPYLSSEEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGIDRGENIPAVIALTDPEGCPLSRFKDSLGNPTHILRIGES<br>YKEKQRTIQAAKEVEQRRAGGYSRKYASKAKNLADDMVRNTARDLLYY<br>AVTQDAMLIFENLSRGFGRQGKRTFQAERQYTRMEDWLTAKLAYEGLP<br>SKTYLSKTLAQYTSKTCSNCGFTITSADYDRVLEKLKKTATGWMTTINGK<br>ELKVEGQITYYNRYKRQNVVKDLSVELDRLSEESVNNDISSWTKGRSGE<br>ALSLLKKRFSHRPVQEKFVCLNCGFETHADEQAALNIARSWLFLRSQEY<br>KKYQTNKTTGNTDKRAFVETWQSFYRKKLKEVWKPAV<br>(SEQ ID NO: 64) |

TABLE 4-continued

CasX Variant Sequences

| Description* | Amino Acid Sequence |
|---|---|
| substitution of R458I and a substitution of A739V of SEQ ID NO: 2. | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALLPYLSSEEDRKKGKKFA<br>RYQFGDLLLHLEKKHGEDWGKVYDEAWERIDKKVEGLSKHIKLEEERRS<br>EDAQSKAALTDWLIAKASFVIEGLKEADKDEFCRCELKLQKWYGDLRGK<br>PFAIEAENSILDISGFSKQYNCAFIWQKDGVKKLNLYLIINYFKGGKLRFKK<br>IKPEAFEANRFYTVINKKSGEIVPMEVNFNFDDPNLIILPLAFGKRQGREFI<br>WNDLLSLETGSLKLANGRVIEKTLYNRRTRQDEPALFVALTFERREVLDS<br>SNIKPMNLIGIDRGENIPAVIALTDPEGCPLSRFKDSLGNPTHILRIGESYK<br>EKQRTIQAAKEVEQRRAGGYSRKYASKAKNLADDMVRNTVRDLLYYAV<br>TQDAMLIFENLSRGFGRQGKRTFMAERQYTRMEDWLTAKLAYEGLPSK<br>TYLSKTLAQYTSKTCSNCGFTITSADYDRVLEKLKKTATGWMTTINGKEL<br>KVEGQITYYNRYKRQNVVKDLSVELDRLSEESVNNDISSWTKGRSGEAL<br>SLLKKRFSHRPVQEKFVCLNCGFETHADEQAALNIARSWLFLRSQEYKK<br>YQTNKTTGNTDKRAFVETWQSFYRKKLKEVWKPAV<br>(SEQ ID NO: 65) |
| L379R, a substitution of A708K, a deletion of P at position 793 and a substitution of M771N of SEQ ID NO: 2 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSEEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGIDRGENIPAVIALTDPEGCPLSRFKDSLGNPTHILRIGES<br>YKEKQRTIQAKKEVEQRRAGGYSRKYASKAKNLADDMVRNTARDLLYY<br>AVTQDAMLIFENLSRGFGRQGKRTFNAERQYTRMEDWLTAKLAYEGLS<br>KTYLSKTLAQYTSKTCSNCGFTITSADYDRVLEKLKKTATGWMTTINGKE<br>LKVEGQITYYNRYKRQNVVKDLSVELDRLSEESVNNDISSWTKGRSGEA<br>LSLLKKRFSHRPVQEKFVCLNCGFETHADEQAALNIARSWLFLRSQEYK<br>KYQTNKTTGNTDKRAFVETWQSFYRKKLKEVWKPAV<br>(SEQ ID NO: 66) |
| substitution of L379R, a substitution of A708K, a deletion of P at position 793 and a substitution of A739T of SEQ ID NO: 2 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSEEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGIDRGENIPAVIALTDPEGCPLSRFKDSLGNPTHILRIGES<br>YKEKQRTIQAKKEVEQRRAGGYSRKYASKAKNLADDMVRNTTRDLLYY<br>AVTQDAMLIFENLSRGFGRQGKRTFMAERQYTRMEDWLTAKLAYEGLS<br>KTYLSKTLAQYTSKTCSNCGFTITSADYDRVLEKLKKTATGWMTTINGKE<br>LKVEGQITYYNRYKRQNVVKDLSVELDRLSEESVNNDISSWTKGRSGEA<br>LSLLKKRFSHRPVQEKFVCLNCGFETHADEQAALNIARSWLFLRSQEYK<br>KYQTNKTTGNTDKRAFVETWQSFYRKKLKEVWKPAV<br>(SEQ ID NO: 67) |
| substitution of L379R, a substitution of C477K, a substitution of A708K, a deletion of P at position 793 and a | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSEEDRKKGKKFA<br>RYQFGDLLLHLEKKHGEDWGKVYDEAWERIDKKVEGLSKHIKLEEERRS |

TABLE 4-continued

CasX Variant Sequences

| Description* | Amino Acid Sequence |
|---|---|
| substitution of D489S of SEQ ID NO: 2. | EDAQSKAALTDWLRAKASFVIEGLKEADKDEFKRCELKLQKWYGSLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGIDRGENIPAVIALTDPEGCPLSRFKDSLGNPTHILRIGES<br>YKEKQRTIQAKKEVEQRRAGGYSRKYASKAKNLADDMVRNTARDLLYY<br>AVTQDAMLIFENLSRGFGRQGKRTFMAERQYTRMEDWLTAKLAYEGLS<br>KTYLSKTLAQYTSKTCSNCGFTITSADYDRVLEKLKKTATGWMTTINGKE<br>LKVEGQITYYNRYKRQNVVKDLSVELDRLSEESVNNDISSWTKGRSGEA<br>LSLLKKRFSHRPVQEKFVCLNCGFETHADEQAALNIARSWLFLRSQEYK<br>KYQTNKTTGNTDKRAFVETWQSFYRKKLKEVWKPAV<br>(SEQ ID NO: 68) |
| substitution of L379R, a substitution of C477K, a substitution of A708K, a deletion of P at position 793 and a substitution of D732N of SEQ ID NO: 2. | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSEEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFKRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGIDRGENIPAVIALTDPEGCPLSRFKDSLGNPTHILRIGES<br>YKEKQRTIQAKKEVEQRRAGGYSRKYASKAKNLANDMVRNTARDLLYY<br>AVTQDAMLIFENLSRGFGRQGKRTFMAERQYTRMEDWLTAKLAYEGLS<br>KTYLSKTLAQYTSKTCSNCGFTITSADYDRVLEKLKKTATGWMTTINGKE<br>LKVEGQITYYNRYKRQNVVKDLSVELDRLSEESVNNDISSWTKGRSGEA<br>LSLLKKRFSHRPVQEKFVCLNCGFETHADEQAALNIARSWLFLRSQEYK<br>KYQTNKTTGNTDKRAFVETWQSFYRKKLKEVWKPAV<br>(SEQ ID NO: 69) |
| substitution of V711K of SEQ ID NO: 2. | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALLPYLSSEEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGIDRGENIPAVIALTDPEGCPLSRFKDSLGNPTHILRIGES<br>YKEKQRTIQAAKEKEQRRAGGYSRKYASKAKNLADDMVRNTARDLLYY<br>AVTQDAMLIFENLSRGFGRQGKRTFMAERQYTRMEDWLTAKLAYEGLP<br>SKTYLSKTLAQYTSKTCSNCGFTITSADYDRVLEKLKKTATGWMTTINGK<br>ELKVEGQITYYNRYKRQNVVKDLSVELDRLSEESVNNDISSWTKGRSGE<br>ALSLLKKRFSHRPVQEKFVCLNCGFETHADEQAALNIARSWLFLRSQEY<br>KKYQTNKTTGNTDKRAFVETWQSFYRKKLKEVWKPAV<br>(SEQ ID NO: 70) |
| substitution of L379R, a substitution of C477K, a substitution of A708K, a deletion of P at position 793 and a substitution of Y797L of SEQ ID NO: 2. | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSEEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFKRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGIDRGENIPAVIALTDPEGCPLSRFKDSLGNPTHILRIGES<br>YKEKQRTIQAKKEVEQRRAGGYSRKYASKAKNLADDMVRNTARDLLYY<br>AVTQDAMLIFENLSRGFGRQGKRTFMAERQYTRMEDWLTAKLAYEGLS<br>KTLLSKTLAQYTSKTCSNCGFTITSADYDRVLEKLKKTATGWMTTINGKE |

TABLE 4-continued

| CasX Variant Sequences | |
|---|---|
| Description* | Amino Acid Sequence |
| | LKVEGQITYYNRYKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 71) |
| 119: substitution of L379R, a substitution of A708K and a deletion of P at position 793 of SEQ ID NO: 2. | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAKKEVEQRRAGGYSRKYASKAKNLADDMVRNTARDLLYY AVTQDAMLIFENLSRGFGRQGKRTFMAERQYTRMEDWLTAKLAYEGLS KTYLSKTLAQYTSKTCSNCGFTITSADYDRVLEKLKKTATGWMTTINGKE LKVEGQITYYNRYKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 72) |
| substitution of L379R, a substitution of C477K, a substitution of A708K, a deletion of P at position 793 and a substitution of M771N of SEQ ID NO: 2. | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFKRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAKKEVEQRRAGGYSRKYASKAKNLADDMVRNTARDLLYY AVTQDAMLIFENLSRGFGRQGKRTFNAERQYTRMEDWLTAKLAYEGLS KTYLSKTLAQYTSKTCSNCGFTITSADYDRVLEKLKKTATGWMTTINGKE LKVEGQITYYNRYKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 73) |
| substitution of A708K, a deletion of P at position 793 and a substitution of E386S of SEQ ID NO: 2. | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALLPYLSSESDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAKKEVEQRRAGGYSRKYASKAKNLADDMVRNTARDLLYY AVTQDAMLIFENLSRGFGRQGKRTFMAERQYTRMEDWLTAKLAYEGLS KTYLSKTLAQYTSKTCSNCGFTITSADYDRVLEKLKKTATGWMTTINGKE LKVEGQITYYNRYKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 74) |
| substitution of L379R, a substitution of C477K, a substitution | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII |

TABLE 4-continued

CasX Variant Sequences

| Description* | Amino Acid Sequence |
|---|---|
| of A708K and a deletion of P at position 793 of SEQ ID NO: 2. | LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFKRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAKKEVEQRRAGGYSRKYASKAKNLADDMVRNTARDLLYY AVTQDAMLIFENLSRGFGRQGKRTFMAERQYTRMEDWLTAKLAYEGLS KTYLSKTLAQYTSKTCSNCGFTITSADYDRVLEKLKKTATGWMTTINGKE LKVEGQITYYNRYKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 75) |
| substitution of L792D of SEQ ID NO: 2. | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALLPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAAKEVEQRRAGGYSRKYASKAKNLADDMVRNTARDLLYY AVTQDAMLIFENLSRGFGRQGKRTFMAERQYTRMEDWLTAKLAYEGDP SKTYLSKTLAQYTSKTCSNCGFTITSADYDRVLEKLKKTATGWMTTINGK ELKVEGQITYYNRYKRQNVVKDLSVELDRLSEESVNNDISSWTKGRSGE ALSLLKKRFSHRPVQEKFVCLNCGFETHADEQAALNIARSWLFLRSQEY KKYQTNKTTGNTDKRAFVETWQSFYRKKLKEVWKPAV (SEQ ID NO: 76) |
| substitution of G791F of SEQ ID NO: 2. | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALLPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAAKEVEQRRAGGYSRKYASKAKNLADDMVRNTARDLLYY AVTQDAMLIFENLSRGFGRQGKRTFMAERQYTRMEDWLTAKLAYEFLP SKTYLSKTLAQYTSKTCSNCGFTITSADYDRVLEKLKKTATGWMTTINGK ELKVEGQITYYNRYKRQNVVKDLSVELDRLSEESVNNDISSWTKGRSGE ALSLLKKRFSHRPVQEKFVCLNCGFETHADEQAALNIARSWLFLRSQEY KKYQTNKTTGNTDKRAFVETWQSFYRKKLKEVWKPAV (SEQ ID NO: 77) |
| substitution of A708K, a deletion of P at position 793 and a substitution of A739V of SEQ ID NO: 2. | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALLPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAKKEVEQRRAGGYSRKYASKAKNLADDMVRNTVRDLLYY |

TABLE 4-continued

CasX Variant Sequences

| Description* | Amino Acid Sequence |
|---|---|
| | AVTQDAMLIFENLSRGFGRQGKRTFMAERQYTRMEDWLTAKLAYEGLS KTYLSKTLAQYTSKTCSNCGFTITSADYDRVLEKLKKTATGWMTTINGKE LKVEGQITYYNRYKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 78) |
| substitution of L379R, a substitution of A708K, a deletion of P at position 793 and a substitution of A739V of SEQ ID NO: 2. | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAKKEVEQRRAGGYSRKYASKAKNLADDMVRNTVRDLLYY AVTQDAMLIFENLSRGFGRQGKRTFMAERQYTRMEDWLTAKLAYEGLS KTYLSKTLAQYTSKTCSNCGFTITSADYDRVLEKLKKTATGWMTTINGKE LKVEGQITYYNRYKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 79) |
| substitution of C477K, a substitution of A708K and a deletion of P at position 793 of SEQ IDN O: 2. | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALLPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFKRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAKKEVEQRRAGGYSRKYASKAKNLADDMVRNTARDLLYY AVTQDAMLIFENLSRGFGRQGKRTFMAERQYTRMEDWLTAKLAYEGLS KTYLSKTLAQYTSKTCSNCGFTITSADYDRVLEKLKKTATGWMTTINGKE LKVEGQITYYNRYKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 80) |
| substitution of L249I and a substitution of M771N of SEQ ID NO: 2. | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDIII EHQKVIKKNEKRLANLKDIASANGLAFPKITLPPQPHTKEGIEAYNNVVAQ IVIWVNLNLWQKLKIGRDEAKPLQRLKGFPSFPLVERQANEVDWWDMV CNVKKLINEKKEDGKVFWQNLAGYKRQEALLPYLSSEEDRKKGKKFAR YQFGDLLLHLEKKHGEDWGKVYDEAWERIDKKVEGLSKHIKLEEERRSE DAQSKAALTDWLRAKASFVIEGLKEADKDEFCRCELKLQKWYGDLRGK PFAIEAENSILDISGFSKQYNCAFIWQKDGVKKLNLYLIINYFKGGKLRFKK IKPEAFEANRFYTVINKKSGEIVPMEVNFNFDDPNLIILPLAFGKRQGREFI WNDLLSLETGSLKLANGRVIEKTLYNRRTRQDEPALFVALTFERREVLDS SNIKPMNLIGIDRGENIPAVIALTDPEGCPLSRFKDSLGNPTHILRIGESYK EKQRTIQAAKEVEQRRAGGYSRKYASKAKNLADDMVRNTARDLLYYAV TQDAMLIFENLSRGFGRQGKRTFNAERQYTRMEDWLTAKLAYEGLPSK TYLSKTLAQYTSKTCSNCGFTITSADYDRVLEKLKKTATGWMTTINGKEL KVEGQITYYNRYKRQNVVKDLSVELDRLSEESVNNDISSWTKGRSGEAL SLLKKRFSHRPVQEKFVCLNCGFETHADEQAALNIARSWLFLRSQEYKK YQTNKTTGNTDKRAFVETWQSFYRKKLKEVWKPAV (SEQ ID NO: 81) |
| substitution of V747K of SEQ ID | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG |

TABLE 4-continued

CasX Variant Sequences

| Description* | Amino Acid Sequence |
|---|---|
| NO: 2. | KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALLPYLSSEEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGIDRGENIPAVIALTDPEGCPLSRFKDSLGNPTHILRIGES<br>YKEKQRTIQAAKEVEQRRAGGYSRKYASKAKNLADDMVRNTARDLLYY<br>AKTQDAMLIFENLSRGFGRQGKRTFMAERQYTRMEDWLTAKLAYEGLP<br>SKTYLSKTLAQYTSKTCSNCGFTITSADYDRVLEKLKKTATGWMTTINGK<br>ELKVEGQITYYNRYKRQNVVKDLSVELDRLSEESVNNDISSWTKGRSGE<br>ALSLLKKRFSHRPVQEKFVCLNCGFETHADEQAALNIARSWLFLRSQEY<br>KKYQTNKTTGNTDKRAFVETWQSFYRKKLKEVWKPAV<br>(SEQ ID NO: 82) |
| substitution of L379R, a substitution of C477K, a substitution of A708K, a deletion of P at position 793 and a substitution of M779N of SEQ ID NO: 2. | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSEEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFKRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGIDRGENIPAVIALTDPEGCPLSRFKDSLGNPTHILRIGES<br>YKEKQRTIQAKKEVEQRRAGGYSRKYASKAKNLADDMVRNTARDLLYY<br>AVTQDAMLIFENLSRGFGRQGKRTFMAERQYTRNEDWLTAKLAYEGLS<br>KTYLSKTLAQYTSKTCSNCGFTITSADYDRVLEKLKKTATGWMTTINGKE<br>LKVEGQITYYNRYKRQNVVKDLSVELDRLSEESVNNDISSWTKGRSGEA<br>LSLLKKRFSHRPVQEKFVCLNCGFETHADEQAALNIARSWLFLRSQEYK<br>KYQTNKTTGNTDKRAFVETWQSFYRKKLKEVWKPAV<br>(SEQ ID NO: 83) |
| L379R, F755M | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALLPYLSSEEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGIDRGENIPAVIALTDPEGCPLSRFKDSLGNPTHILRIGES<br>YKEKQRTIQAAKEVEQRRAGGYSRKYASKAKNLADDMVRNTARDLLYY<br>AVTQDAMLIMENLSRGFGRQGKRTFMAERQYTRMEDWLTAKLAYEGLP<br>SKTYLSKTLAQYTSKTCSNCGFTITSADYDRVLEKLKKTATGWMTTINGK<br>ELKVEGQITYYNRYKRQNVVKDLSVELDRLSEESVNNDISSWTKGRSGE<br>ALSLLKKRFSHRPVQEKFVCLNCGFETHADEQAALNIARSWLFLRSQEY<br>KKYQTNKTTGNTDKRAFVETWQSFYRKKLKEVWKPAV<br>(SEQ ID NO: 84) |
| 429: L379R, A708K, P793_, Y857R | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSEEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL |

TABLE 4-continued

| CasX Variant Sequences | |
|---|---|
| Description* | Amino Acid Sequence |
| | DSSNIKPMNLIGIDRGENIPAVIALTDPEGCPLSRFKDSLGNPTHILRIGES<br>YKEKQRTIQAKKEVEQRRAGGYSRKYASKAKNLADDMVRNTARDLLYY<br>AVTQDAMLIFENLSRGFGRQGKRTFMAERQYTRMEDWLTAKLAYEGLS<br>KTYLSKTLAQYTSKTCSNCGFTITSADYDRVLEKLKKTATGWMTTINGKE<br>LKVEGQITYYNRRKRQNVVKDLSVELDRLSEESVNNDISSWTKGRSGEA<br>LSLLKKRFSHRPVQEKFVCLNCGFETHADEQAALNIARSWLFLRSQEYK<br>KYQTNKTTGNTDKRAFVETWQSFYRKKLKEVWKPAV<br>(SEQ ID NO: 85) |
| 430:<br>L379R,<br>A708K,<br>P793_,<br>Y857R,<br>I658V | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSEEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGVDRGENIPAVIALTDPEGCPLSRFKDSLGNPTHILRIGE<br>SYKEKQRTIQAKKEVEQRRAGGYSRKYASKAKNLADDMVRNTARDLLY<br>YAVTQDAMLIFENLSRGFGRQGKRTFMAERQYTRMEDWLTAKLAYEGL<br>SKTYLSKTLAQYTSKTCSNCGFTITSADYDRVLEKLKKTATGWMTTINGK<br>ELKVEGQITYYNRRKRQNVVKDLSVELDRLSEESVNNDISSWTKGRSGE<br>ALSLLKKRFSHRPVQEKFVCLNCGFETHADEQAALNIARSWLFLRSQEY<br>KKYQTNKTTGNTDKRAFVETWQSFYRKKLKEVWKPAV<br>(SEQ ID NO: 86) |
| 431:<br>L379R,<br>A708K,<br>P793_,<br>Y857R,<br>I658V,<br>E386N | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSENDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGVDRGENIPAVIALTDPEGCPLSRFKDSLGNPTHILRIGE<br>SYKEKQRTIQAKKEVEQRRAGGYSRKYASKAKNLADDMVRNTARDLLY<br>YAVTQDAMLIFENLSRGFGRQGKRTFMAERQYTRMEDWLTAKLAYEGL<br>SKTYLSKTLAQYTSKTCSNCGFTITSADYDRVLEKLKKTATGWMTTINGK<br>ELKVEGQITYYNRRKRQNVVKDLSVELDRLSEESVNNDISSWTKGRSGE<br>ALSLLKKRFSHRPVQEKFVCLNCGFETHADEQAALNIARSWLFLRSQEY<br>KKYQTNKTTGNTDKRAFVETWQSFYRKKLKEVWKPAV<br>(SEQ ID NO: 87) |
| 432:<br>L379R,<br>A708K,<br>P793_,<br>Y857R,<br>I658V,<br>L404K | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSEEDRKKGKKFA<br>RYQFGDLLKHLEKKHGEDWGKVYDEAWERIDKKVEGLSKHIKLEEERR<br>SEDAQSKAALTDWLRAKASFVIEGLKEADKDEFCRCELKLQKWYGDLR<br>GKPFAIEAENSILDISGFSKQYNCAFIWQKDGVKKLNLYLIINYFKGGKLR<br>FKKIKPEAFEANRFYTVINKKSGEIVPMEVNFNFDDPNLIILPLAFGKRQG<br>REFIWNDLLSLETGSLKLANGRVIEKTLYNRRTRQDEPALFVALTFERRE<br>VLDSSNIKPMNLIGVDRGENIPAVIALTDPEGCPLSRFKDSLGNPTHILRI<br>GESYKEKQRTIQAKKEVEQRRAGGYSRKYASKAKNLADDMVRNTARDL<br>LYYAVTQDAMLIFENLSRGFGRQGKRTFMAERQYTRMEDWLTAKLAYE<br>GLSKTYLSKTLAQYTSKTCSNCGFTITSADYDRVLEKLKKTATGWMTTIN<br>GKELKVEGQITYYNRRKRQNVVKDLSVELDRLSEESVNNDISSWTKGRS<br>GEALSLLKKRFSHRPVQEKFVCLNCGFETHADEQAALNIARSWLFLRSQ<br>EYKKYQTNKTTGNTDKRAFVETWQSFYRKKLKEVWKPAV<br>(SEQ ID NO: 88) |

TABLE 4-continued

CasX Variant Sequences

| Description* | Amino Acid Sequence |
|---|---|
| 433: | MQEIKRINKIRRRLVKDSNTKKAGKTGPMKTLLVRVMTPDLRERLENLRK |
| L379R, | KPENIPQPISNTSRANLNKLLTDYTEMKKAILHVYWEEFQKDPVGLMSRV |
| A708K, | AQPAPKNIDQRKLIPVKDGNERLTSSGFACSQCCQPLYVYKLEQVNDKG |
| P793_, | KPHTNYFGRCNVSEHERLILLSPHKPEANDELVTYSLGKFGQVRALDFY |
| Y857R, | SIHVTRESNHPVKPLEQIGGNSCASGPVGKALSDACMGAVASFLTKYQD |
| I658V, | IILEHQKVIKKNEKRLANLKDIASANGLAFPKITLPPQPHTKEGIEAYNNVV |
| V192 | AQIVIWVNLNLWQKLKIGRDEAKPLQRLKGFPSFPLVERQANEVDWWD |
| | MVCNVKKLINEKKEDGKVFWQNLAGYKRQEALRPYLSSEEDRKKGKKF |
| | ARYQFGDLLLHLEKKHGEDWGKVYDEAWERIDKKVEGLSKHIKLEEERR |
| | SEDAQSKAALTDWLRAKASFVIEGLKEADKDEFCRCELKLQKWYGDLR |
| | GKPFAIEAENSILDISGFSKQYNCAFIWQKDGVKKLNLYLIINYFKGGKLR |
| | FKKIKPEAFEANRFYTVINKKSGEIVPMEVNFNFDDPNLIILPLAFGKRQG |
| | REFIWNDLLSLETGSLKLANGRVIEKTLYNRRTRQDEPALFVALTFERRE |
| | VLDSSNIKPMNLIGVDRGENIPAVIALTDPEGCPLSRFKDSLGNPTHILRI |
| | GESYKEKQRTIQAKKEVEQRRAGGYSRKYASKAKNLADDMVRNTARDL |
| | LYYAVTQDAMLIFENLSRGFGRQGKRTFMAERQYTRMEDWLTAKLAYE |
| | GLSKTYLSKTLAQYTSKTCSNCGFTITSADYDRVLEKLKKTATGWMTTIN |
| | GKELKVEGQITYYNRRKRQNVVKDLSVELDRLSEESVNNDISSWTKGRS |
| | GEALSLLKKRFSHRPVQEKFVCLNCGFETHADEQAALNIARSWLFLRSQ |
| | EYKKYQTNKTTGNTDKRAFVETWQSFYRKKLKEVWKPAV |
| | (SEQ ID NO: 89) |
| 434: | MQEIKRINKIRRRLVKDSNTKKAGKTGPMKTLLVRVMTPDLRERLENLRK |
| L379R, | KPENIPQPISNTSRANLNKLLTDYTEMKKAILHVYWEEFQKDPVGLMSRV |
| A708K, | AQPAPKNIDQRKLIPVKDGNERLTSSGFACSQCCQPLYVYKLEQVNDKG |
| P793_, | KPHTNYFGRCNVSEHERLILLSPHKPEANDELVTYSLGKFGQRALDFYSI |
| Y857R, | HVTRESNHPVKPLEQIGGNSCASGPVGKALSDACMGAVASFLTKYQDII |
| I658V, | LEHQKVIKKNEKRLANLKDIASANGLAFPKITLPPQPHTKEGIEAYNNVVA |
| L404K, | QIVIWVNLNLWQKLKIGRDEAKPLQRLKGFPSFPLVERQANEVDWWDM |
| E386N | VCNVKKLINEKKEDGKVFWQNLAGYKRQEALRPYLSSENDRKKGKKFA |
| | RYQFGDLLKHLEKKHGEDWGKVYDEAWERIDKKVEGLSKHIKLEEERR |
| | SEDAQSKAALTDWLRAKASFVIEGLKEADKDEFCRCELKLQKWYGDLR |
| | GKPFAIEAENSILDISGFSKQYNCAFIWQKDGVKKLNLYLIINYFKGGKLR |
| | FKKIKPEAFEANRFYTVINKKSGEIVPMEVNFNFDDPNLIILPLAFGKRQG |
| | REFIWNDLLSLETGSLKLANGRVIEKTLYNRRTRQDEPALFVALTFERRE |
| | VLDSSNIKPMNLIGVDRGENIPAVIALTDPEGCPLSRFKDSLGNPTHILRI |
| | GESYKEKQRTIQAKKEVEQRRAGGYSRKYASKAKNLADDMVRNTARDL |
| | LYYAVTQDAMLIFENLSRGFGRQGKRTFMAERQYTRMEDWLTAKLAYE |
| | GLSKTYLSKTLAQYTSKTCSNCGFTITSADYDRVLEKLKKTATGWMTTIN |
| | GKELKVEGQITYYNRRKRQNVVKDLSVELDRLSEESVNNDISSWTKGRS |
| | GEALSLLKKRFSHRPVQEKFVCLNCGFETHADEQAALNIARSWLFLRSQ |
| | EYKKYQTNKTTGNTDKRAFVETWQSFYRKKLKEVWKPAV |
| | (SEQ ID NO: 90) |
| 435: | MQEIKRINKIRRRLVKDSNTKKAGKTGPMKTLLVRVMTPDLRERLENLRK |
| L379R, | KPENIPQPISNTSRANLNKLLTDYTEMKKAILHVYWEEFQKDPVGLMSRV |
| A708K, | AQPAPKNIDQRKLIPVKDGNERLTSSGFACSQCCQPLYVYKLEQVNDKG |
| P793_, | KPHTNYFGRCNVSEHERLILLSPHKPEANDELVTYSLGKFGQRALDFYSI |
| Y857R, | HVTRESNHPVKPLEQIGGNSCASGPVGKALSDACMGAVASFLTKYQDII |
| I658V, | LEHQKVIKKNEKRLANLKDIASANGLAFPKITLPPQPHTKEGIEAYNNVVA |
| F399L | QIVIWVNLNLWQKLKIGRDEAKPLQRLKGFPSFPLVERQANEVDWWDM |
| | VCNVKKLINEKKEDGKVFWQNLAGYKRQEALRPYLSSEEDRKKGKKFA |
| | RYQLGDLLLHLEKKHGEDWGKVYDEAWERIDKKVEGLSKHIKLEEERRS |
| | EDAQSKAALTDWLRAKASFVIEGLKEADKDEFCRCELKLQKWYGDLRG |
| | KPFAIEAENSILDISGFSKQYNCAFIWQKDGVKKLNLYLIINYFKGGKLRFK |
| | KIKPEAFEANRFYTVINKKSGEIVPMEVNFNFDDPNLIILPLAFGKRQGRE |
| | FIWNDLLSLETGSLKLANGRVIEKTLYNRRTRQDEPALFVALTFERREVL |
| | DSSNIKPMNLIGVDRGENIPAVIALTDPEGCPLSRFKDSLGNPTHILRIGE |
| | SYKEKQRTIQAKKEVEQRRAGGYSRKYASKAKNLADDMVRNTARDLLY |
| | YAVTQDAMLIFENLSRGFGRQGKRTFMAERQYTRMEDWLTAKLAYEGL |
| | SKTYLSKTLAQYTSKTCSNCGFTITSADYDRVLEKLKKTATGWMTTINGK |
| | ELKVEGQITYYNRRKRQNVVKDLSVELDRLSEESVNNDISSWTKGRSGE |
| | ALSLLKKRFSHRPVQEKFVCLNCGFETHADEQAALNIARSWLFLRSQEY |
| | KKYQTNKTTGNTDKRAFVETWQSFYRKKLKEVWKPAV |
| | (SEQ ID NO: 91) |
| 436: | MQEIKRINKIRRRLVKDSNTKKAGKTGPMKTLLVRVMTPDLRERLENLRK |
| L379R, | KPENIPQPISNTSRANLNKLLTDYTEMKKAILHVYWEEFQKDPVGLMSRV |
| A708K, | AQPAPKNIDQRKLIPVKDGNERLTSSGFACSQCCQPLYVYKLEQVNDKG |
| P793_, | KPHTNYFGRCNVSEHERLILLSPHKPEANDELVTYSLGKFGQRALDFYSI |
| Y857R, | HVTRESNHPVKPLEQIGGNSCASGPVGKALSDACMGAVASFLTKYQDII |
| I658V, | LEHQKVIKKNEKRLANLKDIASANGLAFPKITLPPQPHTKEGIEAYNNVVA |
| F399L, | QIVIWVNLNLWQKLKIGRDEAKPLQRLKGFPSFPLVERQANEVDWWDM |
| E386N | VCNVKKLINEKKEDGKVFWQNLAGYKRQEALRPYLSSENDRKKGKKFA |
| | RYQLGDLLLHLEKKHGEDWGKVYDEAWERIDKKVEGLSKHIKLEEERRS |

TABLE 4-continued

CasX Variant Sequences

| Description* | Amino Acid Sequence |
|---|---|
| | EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGVDRGENIPAVIALTDPEGCPLSRFKDSLGNPTHILRIGE<br>SYKEKQRTIQAKKEVEQRRAGGYSRKYASKAKNLADDMVRNTARDLLY<br>YAVTQDAMLIFENLSRGFGRQGKRTFMAERQYTRMEDWLTAKLAYEGL<br>SKTYLSKTLAQYTSKTCSNCGFTITSADYDRVLEKLKKTATGWMTTINGK<br>ELKVEGQITYYNRRKRQNVVKDLSVELDRLSEESVNNDISSWTKGRSGE<br>ALSLLKKRFSHRPVQEKFVCLNCGFETHADEQAALNIARSWLFLRSQEY<br>KKYQTNKTTGNTDKRAFVETWQSFYRKKLKEVWKPAV<br>(SEQ ID NO: 92) |
| 437:<br>L379R,<br>A708K,<br>P793_,<br>Y857R,<br>I658V,<br>F399L,<br>C477S | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSEEDRKKGKKFA<br>RYQLGDLLLHLEKKHGEDWGKVYDEAWERIDKKVEGLSKHIKLEEERRS<br>EDAQSKAALTDWLRAKASFVIEGLKEADKDEFSRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGVDRGENIPAVIALTDPEGCPLSRFKDSLGNPTHILRIGE<br>SYKEKQRTIQAKKEVEQRRAGGYSRKYASKAKNLADDMVRNTARDLLY<br>YAVTQDAMLIFENLSRGFGRQGKRTFMAERQYTRMEDWLTAKLAYEGL<br>SKTYLSKTLAQYTSKTCSNCGFTITSADYDRVLEKLKKTATGWMTTINGK<br>ELKVEGQITYYNRRKRQNVVKDLSVELDRLSEESVNNDISSWTKGRSGE<br>ALSLLKKRFSHRPVQEKFVCLNCGFETHADEQAALNIARSWLFLRSQEY<br>KKYQTNKTTGNTDKRAFVETWQSFYRKKLKEVWKPAV<br>(SEQ ID NO: 93) |
| 438:<br>L379R,<br>A708K,<br>P793_,<br>Y857R,<br>I658V,<br>F399L,<br>L404K | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSEEDRKKGKKFA<br>RYQLGDLLKHLEKKHGEDWGKVYDEAWERIDKKVEGLSKHIKLEEERR<br>SEDAQSKAALTDWLRAKASFVIEGLKEADKDEFCRCELKLQKWYGDLR<br>GKPFAIEAENSILDISGFSKQYNCAFIWQKDGVKKLNLYLIINYFKGGKLR<br>FKKIKPEAFEANRFYTVINKKSGEIVPMEVNFNFDDPNLIILPLAFGKRQG<br>REFIWNDLLSLETGSLKLANGRVIEKTLYNRRTRQDEPALFVALTFERRE<br>VLDSSNIKPMNLIGVDRGENIPAVIALTDPEGCPLSRFKDSLGNPTHILRI<br>GESYKEKQRTIQAKKEVEQRRAGGYSRKYASKAKNLADDMVRNTARDL<br>LYYAVTQDAMLIFENLSRGFGRQGKRTFMAERQYTRMEDWLTAKLAYE<br>GLSKTYLSKTLAQYTSKTCSNCGFTITSADYDRVLEKLKKTATGWMTTIN<br>GKELKVEGQITYYNRRKRQNNNKDLSVELDRLSEESVNNDISSWTKGRS<br>GEALSLLKKRFSHRPVQEKFVCLNCGFETHADEQAALNIARSWLFLRSQ<br>EYKKYQTNKTTGNTDKRAFVETWQSFYRKKLKEVWKPAV<br>(SEQ ID NO: 94) |
| 439:<br>L379R,<br>A708K,<br>P793_,<br>Y857R,<br>I658V,<br>F399L,<br>E386N,<br>C477S,<br>L404K | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSENDRKKGKKFA<br>RYQLGDLLKHLEKKHGEDWGKVYDEAWERIDKKVEGLSKHIKLEEERR<br>SEDAQSKAALTDWLRAKASFVIEGLKEADKDEFSRCELKLQKWYGDLR<br>GKPFAIEAENSILDISGFSKQYNCAFIWQKDGVKKLNLYLIINYFKGGKLR<br>FKKIKPEAFEANRFYTVINKKSGEIVPMEVNFNFDDPNLIILPLAFGKRQG<br>REFIWNDLLSLETGSLKLANGRVIEKTLYNRRTRQDEPALFVALTFERRE<br>VLDSSNIKPMNLIGVDRGENIPAVIALTDPEGCPLSRFKDSLGNPTHILRI<br>GESYKEKQRTIQAKKEVEQRRAGGYSRKYASKAKNLADDMVRNTARDL<br>LYYAVTQDAMLIFENLSRGFGRQGKRTFMAERQYTRMEDWLTAKLAYE<br>GLSKTYLSKTLAQYTSKTCSNCGFTITSADYDRVLEKLKKTATGWMTTIN |

TABLE 4-continued

| CasX Variant Sequences | |
|---|---|
| Description* | Amino Acid Sequence |
| | GKELKVEGQITYYNRRKRQNVVKDLSVELDRLSEESVNNDISSWTKGRS<br>GEALSLLKKRFSHRPVQEKFVCLNCGFETHADEQAALNIARSWLFLRSQ<br>EYKKYQTNKTTGNTDKRAFVETWQSFYRKKLKEVWKPAV<br>(SEQ ID NO: 95) |
| 440:<br>L379R,<br>A708K,<br>P793_,<br>Y857R,<br>I658V,<br>F399L,<br>Y797L | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSEEDRKKGKKFA<br>RYQLGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGVDRGENIPAVIALTDPEGCPLSRFKDSLGNPTHILRIGE<br>SYKEKQRTIQAKKEVEQRRAGGYSRKYASKAKNLADDMVRNTARDLLY<br>YAVTQDAMLIFENLSRGFGRQGKRTFMAERQYTRMEDWLTAKLAYEGL<br>SKTLLSKTLAQYTSKTCSNCGFTITSADYDRVLEKLKKTATGWMTTINGK<br>ELKVEGQITYYNRRKRQNVVKDLSVELDRLSEESVNNDISSWTKGRSGE<br>ALSLLKKRFSHRPVQEKFVCLNCGFETHADEQAALNIARSWLFLRSQEY<br>KKYQTNKTTGNTDKRAFVETWQSFYRKKLKEVWKPAV<br>(SEQ ID NO: 96) |
| 441:<br>L379R,<br>A708K,<br>P793_,<br>Y857R,<br>I658V,<br>F399L,<br>Y797L,<br>E386N | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSENDRKKGKKFA<br>RYQLGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGVDRGENIPAVIALTDPEGCPLSRFKDSLGNPTHILRIGE<br>SYKEKQRTIQAKKEVEQRRAGGYSRKYASKAKNLADDMVRNTARDLLY<br>YAVTQDAMLIFENLSRGFGRQGKRTFMAERQYTRMEDWLTAKLAYEGL<br>SKTLLSKTLAQYTSKTCSNCGFTITSADYDRVLEKLKKTATGWMTTINKG<br>ELKVEGQITYYNRRKRQNVVKDLSVELDRLSEESVNNDISSWTKGRSGE<br>ALSLLKKRFSHRPVQEKFVCLNCGFETHADEQAALNIARSWLFLRSQEY<br>KKYQTNKTTGNTDKRAFVETWQSFYRKKLKEVWKPAV<br>(SEQ ID NO: 97) |
| 442:<br>L379R,<br>A708K,<br>P793_,<br>Y857R,<br>I658V,<br>F399L,<br>Y797L,<br>E386N,<br>C477S,<br>L404K | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSENDRKKGKKFA<br>RYQLGDLLKHLEKKHGEDWGKVYDEAWERIDKKVEGLSKHIKLEEERR<br>SEDAQSKAALTDWLRAKASFVIEGLKEADKDEFSRCELKLQKWYGDLR<br>GKPFAIEAENSILDISGFSKQYNCAFIWQKDGVKKLNLYLIINYFKGGKLR<br>FKKIKPEAFEANRFYTVINKKSGEIVPMEVNFNFDDPNLIILPLAFGKRQG<br>REFIWNDLLSLETGSLKLANGRVIEKTLYNRRTRQDEPALFVALTFERRE<br>VLDSSNIKPMNLIGVDRGENIPAVIALTDPEGCPLSRFKDSLGNPTHILRI<br>GESYKEKQRTIQAKKEVEQRRAGGYSRKYASKAKNLADDMVRNTARDL<br>LYYAVTQDAMLIFENLSRGFGRQGKRTFMAERQYTRMEDWLTAKLAYE<br>GLSKTLLSKTLAQYTSKTCSNCGFTITSADYDRVLEKLKKTATGWMTTIN<br>GKELKVEGQITYYNRRKRQNVVKDLSVELDRLSEESVNNDISSWTKGRS<br>GEALSLLKKRFSHRPVQEKFVCLNCGFETHADEQAALNIARSWLFLRSQ<br>EYKKYQTNKTTGNTDKRAFVETWQSFYRKKLKEVWKPAV<br>(SEQ ID NO: 98) |
| 443:<br>L379R,<br>A708K,<br>P793_,<br>Y857R, | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII |

TABLE 4-continued

| CasX Variant Sequences | |
|---|---|
| Description* | Amino Acid Sequence |
| I658V,<br>Y797L | LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSEEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGVDRGENIPAVIALTDPEGCPLSRFKDSLGNPTHILRIGE<br>SYKEKQRTIQAKKEVEQRRAGGYSRKYASKAKNLADDMVRNTARDLLY<br>YAVTQDAMLIFENLSRGFGRQGKRTFMAERQYTRMEDWLTAKLAYEGL<br>SKTLLSKTLAQYTSKTCSNCGFTITSADYDRVLEKLKKTATGWMTTINGK<br>ELKVEGQITYYNRRKRQNVVKDLSVELDRLSEESVNNDISSWTKGRSGE<br>ALSLLKKRFSHRPVQEKFVCLNCGFETHADEQAALNIARSWLFLRSQEY<br>KKYQTNKTTGNTDKRAFVETWQSFYRKKLKEVWKPAV<br>(SEQ ID NO: 99) |
| 444:<br>L379R,<br>A708K,<br>P793_,<br>Y857R,<br>I658V,<br>Y797L,<br>L404K | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSEEDRKKGKKFA<br>RYQFGDLLKHLEKKHGEDWGKVYDEAWERIDKKVEGLSKHIKLEEERR<br>SEDAQSKAALTDWLRAKASFVIEGLKEADKDEFCRCELKLQKWYGDLR<br>GKPFAIEAENSILDISGFSKQYNCAFIWQKDGVKKLNLYLIINYFKGGKLR<br>FKKIKPEAFEANRFYTVINKKSGEIVPMEVNFNFDDPNLIILPLAFGKRQG<br>REFIWNDLLSLETGSLKLANGRVIEKTLYNRRTRQDEPALFVALTFERRE<br>VLDSSNIKPMNLIGVDRGENIPAVIALTDPEGCPLSRFKDSLGNPTHILRI<br>GESYKEKQRTIQAKKEVEQRRAGGYSRKYASKAKNLADDMVRNTARDL<br>LYYAVTQDAMLIFENLSRGFGRQGKRTFMAERQYTRMEDWLTAKLAYE<br>GLSKTLLSKTLAQYTSKTCSNCGFTITSADYDRVLEKLKKTATGWMTTIN<br>GKELKVEGQITYYNRRKRQNVVKDLSVELDRLSEESVNNDISSWTKGRS<br>GEALSLLKKRFSHRPVQEKFVCLNCGFETHADEQAALNIARSWLFLRSQ<br>EYKKYQTNKTTGNTDKRAFVETWQSFYRKKLKEVWKPAV<br>(SEQ ID NO: 100) |
| 445:<br>L379R,<br>A708K,<br>P793_,<br>Y857R,<br>I658V,<br>Y797L,<br>E386N | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSENDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGVDRGENIPAVIALTDPEGCPLSRFKDSLGNPTHILRIGE<br>SYKEKQRTIQAKKEVEQRRAGGYSRKYASKAKNLADDMVRNTARDLLY<br>YAVTQDAMLIFENLSRGFGRQGKRTFMAERQYTRMEDWLTAKLAYEGL<br>SKTLLSKTLAQYTSKTCSNCGFTITSADYDRVLEKLKKTATGWMTTINGK<br>ELKVEGQITYYNRRKRQNVVKDLSVELDRLSEESVNNDISSWTKGRSGE<br>ALSLLKKRFSHRPVQEKFVCLNCGFETHADEQAALNIARSWLFLRSQEY<br>KKYQTNKTTGNTDKRAFVETWQSFYRKKLKEVWKPAV<br>(SEQ ID NO: 101) |
| 446:<br>L379R,<br>A708K,<br>P793_,<br>Y857R,<br>I658V,<br>Y797L,<br>E386N,<br>C477S,<br>L404K | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSENDRKKGKKFA<br>RYQFGDLLKHLEKKHGEDWGKVYDEAWERIDKKVEGLSKHIKLEEERR<br>SEDAQSKAALTDWLRAKASFVIEGLKEADKDEFSRCELKLQKWYGDLR<br>GKPFAIEAENSILDISGFSKQYNCAFIWQKDGVKKLNLYLIINYFKGGKLR<br>FKKIKPEAFEANRFYTVINKKSGEIVPMEVNFNFDDPNLIILPLAFGKRQG<br>REFIWNDLLSLETGSLKLANGRVIEKTLYNRRTRQDEPALFVALTFERRE<br>VLDSSNIKPMNLIGVDRGENIPAVIALTDPEGCPLSRFKDSLGNPTHILRI<br>GESYKEKQRTIQAKKEVEQRRAGGYSRKYASKAKNLADDMVRNTARDL |

TABLE 4-continued

CasX Variant Sequences

| Description* | Amino Acid Sequence |
|---|---|
| | LYYAVTQDAMLIFENLSRGFGRQGKRTFMAERQYTRMEDWLTAKLAYE GLSKTLLSKTLAQYTSKTCSNCGFTITSADYDRVLEKLKKTATGWMTTIN GKELKVEGQITYYNRRKRQNVVKDLSVELDRLSEESVNNDISSWTKGRS GEALSLLKKRFSHRPVQEKFVCLNCGFETHADEQAALNIARSWLFLRSQ EYKKYQTNKTTGNTDKRAFVETWQSFYRKKLKEVWKPAV (SEQ ID NO: 102) |
| 447: L379R, A708K, P793_, Y857R, E386N | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSENDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAKKEVEQRRAGGYSRKYASKAKNLADDMVRNTARDLLYY AVTQDAMLIFENLSRGFGRQGKRTFMAERQYTRMEDWLTAKLAYEGLS KTYLSKTLAQYTSKTCSNCGFTITSADYDRVLEKLKKTATGWMTTINGKE LKVEGQITYYNRRKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 103) |
| 448: L379R, A708K, P793_ Y857R, E386N, L404K | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSENDRKKGKKFA RYQFGDLLKHLEKKHGEDWGKVYDEAWERIDKKVEGLSKHIKLEEERR SEDAQSKAALTDWLRAKASFVIEGLKEADKDEFCRCELKLQKWYGDLR GKPFAIEAENSILDISGFSKQYNCAFIWQKDGVKKLNLYLIINYFKGGKLR FKKIKPEAFEANRFYTVINKKSGEIVPMEVNFNFDDPNLIILPLAFGKRQG REFIWNDLLSLETGSLKLANGRVIEKTLYNRRTRQDEPALFVALTFERRE VLDSSNIKPMNLIGIDRGENIPAVIALTDPEGCPLSRFKDSLGNPTHILRIG ESYKEKQRTIQAKKEVEQRRAGGYSRKYASKAKNLADDMVRNTARDLL YYAVTQDAMLIFENLSRGFGRQGKRTFMAERQYTRMEDWLTAKLAYEG LSKTYLSKTLAQYTSKTCSNCGFTITSADYDRVLEKLKKTATGWMTTING KELKVEGQITYYNRRKRQNVVKDLSVELDRLSEESVNNDISSWTKGRSG EALSLLKKRFSHRPVQEKFVCLNCGFETHADEQAALNIARSWLFLRSQE YKKYQTNKTTGNTDKRAFVETWQSFYRKKLKEVWKPAV (SEQ ID NO: 104) |
| 449: L379R, A708K, P793_, D732N, E385P, Y857R | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSPEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAKKEVEQRRAGGYSRKYASKAKNLANDMVRNTARDLLYY AVTQDAMLIFENLSRGFGRQGKRTFMAERQYTRMEDWLTAKLAYEGLS KTYLSKTLAQYTSKTCSNCGFTITSADYDRVLEKLKKTATGWMTTINGKE LKVEGQITYYNRRKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 105) |
| 450: L379R, A708K, | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG |

TABLE 4-continued

| CasX Variant Sequences | |
|---|---|
| Description* | Amino Acid Sequence |
| P793_, | KPHTNYFGRCNVSEHERLILLSPHKPEANDELVTYSLGKFGQRALDFYSI |
| D732N, | HVTRESNHPVKPLEQIGGNSCASGPVGKALSDACMGAVASFLTKYQDII |
| E385P | LEHQKVIKKNEKRLANLKDIASANGLAFPKITLPPQPHTKEGIEAYNNVVA |
| Y857R, | QIVIWVNLNLWQKLKIGRDEAKPLQRLKGFPSFPLVERQANEVDWWDM |
| I658V | VCNVKKLINEKKEDGKVFWQNLAGYKRQEALRPYLSSPEDRKKGKKFA |
| | RYQFGDLLLHLEKKHGEDWGKVYDEAWERIDKKVEGLSKHIKLEEERRS |
| | EDAQSKAALTDWLRAKASFVIEGLKEADKDEFCRCELKLQKWYGDLRG |
| | KPFAIEAENSILDISGFSKQYNCAFIWQKDGVKKLNLYLIINYFKGGKLRFK |
| | KIKPEAFEANRFYTVINKKSGEIVPMEVNFNFDDPNLIILPLAFGKRQGRE |
| | FIWNDLLSLETGSLKLANGRVIEKTLYNRRTRQDEPALFVALTFERREVL |
| | DSSNIKPMNLIGVDRGENIPAVIALTDPEGCPLSRFKDSLGNPTHILRIGE |
| | SYKEKQRTIQAKKEVEQRRAGGYSRKYASKAKNLANDMVRNTARDLLY |
| | YAVTQDAMLIFENLSRGFGRQGKRTFMAERQYTRMEDWLTAKLAYEGL |
| | SKTYLSKTLAQYTSKTCSNCGFTITSADYDRVLEKLKKTATGWMTTINGK |
| | ELKVEGQITYYNRRKRQNVVKDLSVELDRLSEESVNNDISSWTKGRSGE |
| | ALSLLKKRFSHRPVQEKFVCLNCGFETHADEQAALNIARSWLFLRSQEY |
| | KKYQTNKTTGNTDKRAFVETWQSFYRKKLKEVWKPAV |
| | (SEQ ID NO: 106) |
| 451: | MQEIKRINKIRRRLVKDSNTKKAGKTGPMKTLLVRVMTPDLRERLENLRK |
| L379R, | KPENIPQPISNTSRANLNKLLTDYTEMKKAILHVYWEEFQKDPVGLMSRV |
| A708K, | AQPAPKNIDQRKLIPVKDGNERLTSSGFACSQCCQPLYVYKLEQVNDKG |
| P793_, | KPHTNYFGRCNVSEHERLILLSPHKPEANDELVTYSLGKFGQRALDFYSI |
| D732N, | HVTRESNHPVKPLEQIGGNSCASGPVGKALSDACMGAVASFLTKYQDII |
| E385P, | LEHQKVIKKNEKRLANLKDIASANGLAFPKITLPPQPHTKEGIEAYNNVVA |
| Y857R, | QIVIWVNLNLWQKLKIGRDEAKPLQRLKGFPSFPLVERQANEVDWWDM |
| I658V, | VCNVKKLINEKKEDGKVFWQNLAGYKRQEALRPYLSSPEDRKKGKKFA |
| F399L | RYQLGDLLLHLEKKHGEDWGKVYDEAWERIDKKVEGLSKHIKLEEERRS |
| | EDAQSKAALTDWLRAKASFVIEGLKEADKDEFCRCELKLQKWYGDLRG |
| | KPFAIEAENSILDISGFSKQYNCAFIWQKDGVKKLNLYLIINYFKGGKLRFK |
| | KIKPEAFEANRFYTVINKKSGEIVPMEVNFNFDDPNLIILPLAFGKRQGRE |
| | FIWNDLLSLETGSLKLANGRVIEKTLYNRRTRQDEPALFVALTFERREVL |
| | DSSNIKPMNLIGVDRGENIPAVIALTDPEGCPLSRFKDSLGNPTHILRIGE |
| | SYKEKQRTIQAKKEVEQRRAGGYSRKYASKAKNLANDMVRNTARDLLY |
| | YAVTQDAMLIFENLSRGFGRQGKRTFMAERQYTRMEDWLTAKLAYEGL |
| | SKTYLSKTLAQYTSKTCSNCGFTITSADYDRVLEKLKKTATGWMTTINGK |
| | ELKVEGQITYYNRRKRQNVVKDLSVELDRLSEESVNNDISSWTKGRSGE |
| | ALSLLKKRFSHRPVQEKFVCLNCGFETHADEQAALNIARSWLFLRSQEY |
| | KKYQTNKTTGNTDKRAFVETWQSFYRKKLKEVWKPAV |
| | (SEQ ID NO: 107) |
| 452: | MQEIKRINKIRRRLVKDSNTKKAGKTGPMKTLLVRVMTPDLRERLENLRK |
| L379R, | KPENIPQPISNTSRANLNKLLTDYTEMKKAILHVYWEEFQKDPVGLMSRV |
| A708K, | AQPAPKNIDQRKLIPVKDGNERLTSSGFACSQCCQPLYVYKLEQVNDKG |
| P793_, | KPHTNYFGRCNVSEHERLILLSPHKPEANDELVTYSLGKFGQRALDFYSI |
| D732N, | HVTRESNHPVKPLEQIGGNSCASGPVGKALSDACMGAVASFLTKYQDII |
| E385P, | LEHQKVIKKNEKRLANLKDIASANGLAFPKITLPPQPHTKEGIEAYNNVVA |
| Y857R, | QIVIWVNLNLWQKLKIGRDEAKPLQRLKGFPSFPLVERQANEVDWWDM |
| I658V, | VCNVKKLINEKKEDGKVFWQNLAGYKRQEALRPYLSSPNDRKKGKKFA |
| E386N | RYQFGDLLLHLEKKHGEDWGKVYDEAWERIDKKVEGLSKHIKLEEERRS |
| | EDAQSKAALTDWLRAKASFVIEGLKEADKDEFCRCELKLQKWYGDLRG |
| | KPFAIEAENSILDISGFSKQYNCAFIWQKDGVKKLNLYLIINYFKGGKLRFK |
| | KIKPEAFEANRFYTVINKKSGEIVPMEVNFNFDDPNLIILPLAFGKRQGRE |
| | FIWNDLLSLETGSLKLANGRVIEKTLYNRRTRQDEPALFVALTFERREVL |
| | DSSNIKPMNLIGVDRGENIPAVIALTDPEGCPLSRFKDSLGNPTHILRIGE |
| | SYKEKQRTIQAKKEVEQRRAGGYSRKYASKAKNLANDMVRNTARDLLY |
| | YAVTQDAMLIFENLSRGFGRQGKRTFMAERQYTRMEDWLTAKLAYEGL |
| | SKTYLSKTLAQYTSKTCSNCGFTITSADYDRVLEKLKKTATGWMTTINGK |
| | ELKVEGQITYYNRRKRQNVVKDLSVELDRLSEESVNNDISSWTKGRSGE |
| | ALSLLKKRFSHRPVQEKFVCLNCGFETHADEQAALNIARSWLFLRSQEY |
| | KKYQTNKTTGNTDKRAFVETWQSFYRKKLKEVWKPAV |
| | (SEQ ID NO: 108) |
| 453: | MQEIKRINKIRRRLVKDSNTKKAGKTGPMKTLLVRVMTPDLRERLENLRK |
| L379R, | KPENIPQPISNTSRANLNKLLTDYTEMKKAILHVYWEEFQKDPVGLMSRV |
| A708K, | AQPAPKNIDQRKLIPVKDGNERLTSSGFACSQCCQPLYVYKLEQVNDKG |
| P793_, | KPHTNYFGRCNVSEHERLILLSPHKPEANDELVTYSLGKFGQRALDFYSI |
| D732N, | HVTRESNHPVKPLEQIGGNSCASGPVGKALSDACMGAVASFLTKYQDII |
| E385P, | LEHQKVIKKNEKRLANLKDIASANGLAFPKITLPPQPHTKEGIEAYNNVVA |
| Y857R, | QIVIWVNLNLWQKLKIGRDEAKPLQRLKGFPSFPLVERQANEVDWWDM |
| I658V, | VCNVKKLINEKKEDGKVFWQNLAGYKRQEALRPYLSSPEDRKKGKKFA |
| L404K | RYQFGDLLKHLEKKHGEDWGKVYDEAWERIDKKVEGLSKHIKLEEERR |
| | SEDAQSKAALTDWLRAKASFVIEGLKEADKDEFCRCELKLQKWYGDLR |
| | GKPFAIEAENSILDISGFSKQYNCAFIWQKDGVKKLNLYLIINYFKGGKLR |
| | FKKIKPEAFEANRFYTVINKKSGEIVPMEVNFNFDDPNLIILPLAFGKRQG |
| | REFIWNDLLSLETGSLKLANGRVIEKTLYNRRTRQDEPALFVALTFERRE |

TABLE 4-continued

| CasX Variant Sequences | |
|---|---|
| Description* | Amino Acid Sequence |
| | VLDSSNIKPMNLIGVDRGENIPAVIALTDPEGCPLSRFKDSLGNPTHILRI<br>GESYKEKQRTIQAKKEVEQRRAGGYSRKYASKAKNLANDMVRNTARDL<br>LYYAVTQDAMLIFENLSRGFGRQGKRTFMAERQYTRMEDWLTAKLAYE<br>GLSKTYLSKTLAQYTSKTCSNCGFTITSADYDRVLEKLKKTATGWMTTIN<br>GKELKVEGQITYYNRRKRQNVVKDLSVELDRLSEESVNNDISSWTKGRS<br>GEALSLLKKRFSHRPVQEKFVCLNCGFETHADEQAALNIARSWLFLRSQ<br>EYKKYQTNKTTGNTDKRAFVETWQSFYRKKLKEVWKPAV<br>(SEQ ID NO: 109) |
| 454:<br>L379R,<br>A708K,<br>P793_,<br>T620P,<br>E385P,<br>Y857R,<br>Q252K | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHKKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSPEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKPLYNRRTRQDEPALFVALTFERREVL<br>DSSNIKPMNLIGIDRGENIPAVIALTDPEGCPLSRFKDSLGNPTHILRIGES<br>YKEKQRTIQAKKEVEQRRAGGYSRKYASKAKNLADDMVRNTARDLLYY<br>AVTQDAMLIFENLSRGFGRQGKRTFMAERQYTRMEDWLTAKLAYEGLS<br>KTYLSKTLAQYTSKTCSNCGFTITSADYDRVLEKLKKTATGWMTTINGKE<br>LKVEGQITYYNRRKRQNVVKDLSVELDRLSEESVNNDISSWTKGRSGEA<br>LSLLKKRFSHRPVQEKFVCLNCGFETHADEQAALNIARSWLFLRSQEYK<br>KYQTNKTTGNTDKRAFVETWQSFYRKKLKEVWKPAV<br>(SEQ ID NO: 110) |
| 455:<br>L379R,<br>A708K,<br>P793_,<br>T620P,<br>E385P,<br>Y857R,<br>I658V,<br>Q252K | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHKKVIKKNEKRLANLKDIASANGLAFPKITLPPQPHTKEGIEAYNNVVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSPEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKPLYNRRTRQDEPALFVALTFERREVL<br>DSSNIKPMNLIGVDRGENIPAVIALTDPEGCPLSRFKDSLGNPTHILRIGE<br>SYKEKQRTIQAKKEVEQRRAGGYSRKYASKAKNLADDMVRNTARDLLY<br>YAVTQDAMLIFENLSRGFGRQGKRTFMAERQYTRMEDWLTAKLAYEGL<br>SKTYLSKTLAQYTSKTCSNCGFTITSADYDRVLEKLKKTATGWMTTINGK<br>ELKVEGQITYYNRRKRQNVVKDLSVELDRLSEESVNNDISSWTKGRSGE<br>ALSLLKKRFSHRPVQEKFVCLNCGFETHADEQAALNIARSWLFLRSQEY<br>KKYQTNKTTGNTDKRAFVETWQSFYRKKLKEVWKPAV<br>(SEQ ID NO: 111) |
| 456:<br>L379R,<br>A708K,<br>P793_,<br>T620P,<br>E385P,<br>Y857R,<br>I658V,<br>E386N,<br>Q252K | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHKKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSPNDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKPLYNRRTRQDEPALFVALTFERREVL<br>DSSNIKPMNLIGVDRGENIPAVIALTDPEGCPLSRFKDSLGNPTHILRIGE<br>SYKEKQRTIQAKKEVEQRRAGGYSRKYASKAKNLADDMVRNTARDLLY<br>YAVTQDAMLIFENLSRGFGRQGKRTFMAERQYTRMEDWLTAKLAYEGL<br>SKTYLSKTLAQYTSKTCSNCGFTITSADYDRVLEKLKKTATGWMTTINGK<br>ELKVEGQITYYNRRKRQNVVKDLSVELDRLSEESVNNDISSWTKGRSGE<br>ALSLLKKRFSHRPVQEKFVCLNCGFETHADEQAALNIARSWLFLRSQEY<br>KKYQTNKTTGNTDKRAFVETWQSFYRKKLKEVWKPAV<br>(SEQ ID NO: 112) |

TABLE 4-continued

CasX Variant Sequences

| Description* | Amino Acid Sequence |
|---|---|
| 457: | MQEIKRINKIRRRLVKDSNTKKAGKTGPMKTLLVRVMTPDLRERLENLRK |
| L379R, | KPENIPQPISNTSRANLNKLLTDYTEMKKAILHVYWEEFQKDPVGLMSRV |
| A708K, | AQPAPKNIDQRKLIPVKDGNERLTSSGFACSQCCQPLYVYKLEQVNDKG |
| P793_, | KPHTNYFGRCNVSEHERLILLSPHKPEANDELVTYSLGKFGQRALDFYSI |
| T620P, | HVTRESNHPVKPLEQIGGNSCASGPVGKALSDACMGAVASFLTKYQDII |
| E385P, | LEHKKVIKKNEKRLANLKDIASANGLAFPKITLPPQPHTKEGIEAYNNVVA |
| Y857R, | QIVIWVNLNLWQKLKIGRDEAKPLQRLKGFPSFPLVERQANEVDWWDM |
| I658V, | VCNVKKLINEKKEDGKVFWQNLAGYKRQEALRPYLSSPEDRKKGKKFA |
| F399L, | RYQLGDLLLHLEKKHGEDWGKVYDEAWERIDKKVEGLSKHIKLEEERRS |
| Q252K | EDAQSKAALTDWLRAKASFVIEGLKEADKDEFCRCELKLQKWYGDLRG |
| | KPFAIEAENSILDISGFSKQYNCAFIWQKDGVKKLNLYLIINYFKGGKLRFK |
| | KIKPEAFEANRFYTVINKKSGEIVPMEVNFNFDDPNLIILPLAFGKRQGRE |
| | FIWNDLLSLETGSLKLANGRVIEKPLYNRRTRQDEPALFVALTFERREVL |
| | DSSNIKPMNLIGVDRGENIPAVIALTDPEGCPLSRFKDSLGNPTHILRIGE |
| | SYKEKQRTIQAKKEVEQRRAGGYSRKYASKAKNLADDMVRNTARDLLY |
| | YAVTQDAMLIFENLSRGFGRQGKRTFMAERQYTRMEDWLTAKLAYEGL |
| | SKTYLSKTLAQYTSKTCSNCGFTITSADYDRVLEKLKKTATGWMTTINGK |
| | ELKVEGQITYYNRRKRQNVVKDLSVELDRLSEESVNNDISSWTKGRSGE |
| | ALSLLKKRFSHRPVQEKFVCLNCGFETHADEQAALNIARSWLFLRSQEY |
| | KKYQTNKTTGNTDKRAFVETWQSFYRKKLKEVWKPAV |
| | (SEQ ID NO: 113) |
| 458: | MQEIKRINKIRRRLVKDSNTKKAGKTGPMKTLLVRVMTPDLRERLENLRK |
| L379R, | KPENIPQPISNTSRANLNKLLTDYTEMKKAILHVYWEEFQKDPVGLMSRV |
| A708K, | AQPAPKNIDQRKLIPVKDGNERLTSSGFACSQCCQPLYVYKLEQVNDKG |
| P793_, | KPHTNYFGRCNVSEHERLILLSPHKPEANDELVTYSLGKFGQRALDFYSI |
| T620P, | HVTRESNHPVKPLEQIGGNSCASGPVGKALSDACMGAVASFLTKYQDII |
| E385P, | LEHKKVIKKNEKRLANLKDIASANGLAFPKITLPPQPHTKEGIEAYNNVVVA |
| Y857R, | QIVIWVNLNLWQKLKIGRDEAKPLQRLKGFPSFPLVERQANEVDWWDM |
| I658V, | VCNVKKLINEKKEDGKVFWQNLAGYKRQEALRPYLSSPEDRKKGKKFA |
| L404K, | RYQFGDLLKHLEKKHGEDWGKVYDEAWERIDKKVEGLSKHIKLEEERR |
| Q252K | SEDAQSKAALTDWLRAKASFVIEGLKEADKDEFCRCELKLQKWYGDLR |
| | GKPFAIEAENSILDISGFSKQYNCAFIWQKDGVKKLNLYLIINYFKGGKLR |
| | FKKIKPEAFEANRFYTVINKKSGEIVPMEVNFNFDDPNLIILPLAFGKRQG |
| | REFIWNDLLSLETGSLKLANGRVIEKPLYNRRTRQDEPALFVALTFERRE |
| | VLDSSNIKPMNLIGVDRGENIPAVIALTDPEGCPLSRFKDSLGNPTHILRI |
| | GESYKEKQRTIQAKKEVEQRRAGGYSRKYASKAKNLADDMVRNTARDL |
| | LYYAVTQDAMLIFENLSRGFGRQGKRTFMAERQYTRMEDWLTAKLAYE |
| | GLSKTYLSKTLAQYTSKTCSNCGFTITSADYDRVLEKLKKTATGWMTTIN |
| | GKELKVEGQITYYNRRKRQNVVKDLSVELDRLSEESVNNDISSWTKGRS |
| | GEALSLLKKRFSHRPVQEKFVCLNCGFETHADEQAALNIARSWLFLRSQ |
| | EYKKYQTNKTTGNTDKRAFVETWQSFYRKKLKEVWKPAV |
| | (SEQ ID NO: 114) |
| 459: | MQEIKRINKIRRRLVKDSNTKKAGKTGPMKTLLVRVMTPDLRERLENLRK |
| L379R, | KPENIPQPISNTSRANLNKLLTDYTEMKKAILHVYWEEFQKDPVGLMSRV |
| A708K, | AQPAPKNIDQRKLIPVKDGNERLTSSGFACSQCCQPLYVYKLEQVNDKG |
| P793_, | KPHTNYFGRCNVSEHERLILLSPHKPEANDELVTYSLGKFGQRALDFYSI |
| T620P, | HVTRESNHPVKPLEQIGGNSCASGPVGKALSDACMGAVASFLTKYQDII |
| Y857R, | LEHQKVIKKNEKRLANLKDIASANGLAFPKITLPPQPHTKEGIEAYNNVVA |
| I658V, | QIVIWVNLNLWQKLKIGRDEAKPLQRLKGFPSFPLVERQANEVDWWDM |
| E386N | VCNVKKLINEKKEDGKVFWQNLAGYKRQEALRPYLSSENDRKKGKKFA |
| | RYQFGDLLLHLEKKHGEDWGKVYDEAWERIDKKVEGLSKHIKLEEERRS |
| | EDAQSKAALTDWLRAKASFVIEGLKEADKDEFCRCELKLQKWYGDLRG |
| | KPFAIEAENSILDISGFSKQYNCAFIWQKDGVKKLNLYLIINYFKGGKLRFK |
| | KIKPEAFEANRFYTVINKKSGEIVPMEVNFNFDDPNLIILPLAFGKRQGRE |
| | FIWNDLLSLETGSLKLANGRVIEKPLYNRRTRQDEPALFVALTFERREVL |
| | DSSNIKPMNLIGVDRGENIPAVIALTDPEGCPLSRFKDSLGNPTHILRIGE |
| | SYKEKQRTIQAKKEVEQRRAGGYSRKYASKAKNLADDMVRNTARDLLY |
| | YAVTQDAMLIFENLSRGFGRQGKRTFMAERQYTRMEDWLTAKLAYEGL |
| | SKTYLSKTLAQYTSKTCSNCGFTITSADYDRVLEKLKKTATGWMTTINGK |
| | ELKVEGQITYYNRRKRQNVVKDLSVELDRLSEESVNNDISSWTKGRSGE |
| | ALSLLKKRFSHRPVQEKFVCLNCGFETHADEQAALNIARSWLFLRSQEY |
| | KKYQTNKTTGNTDKRAFVETWQSFYRKKLKEVWKPAV |
| | (SEQ ID NO: 115) |
| 460: | MQEIKRINKIRRRLVKDSNTKKAGKTGPMKTLLVRVMTPDLRERLENLRK |
| L379R, | KPENIPQPISNTSRANLNKLLTDYTEMKKAILHVYWEEFQKDPVGLMSRV |
| A708K, | AQPAPKNIDQRKLIPVKDGNERLTSSGFACSQCCQPLYVYKLEQVNDKG |
| P793_, | KPHTNYFGRCNVSEHERLILLSPHKPEANDELVTYSLGKFGQRALDFYSI |
| T620P, | HVTRESNHPVKPLEQIGGNSCASGPVGKALSDACMGAVASFLTKYQDII |
| E385P, | LEHKKVIKKNEKRLANLKDIASANGLAFPKITLPPQPHTKEGIEAYNNVVA |
| Q252K | QIVIWVNLNLWQKLKIGRDEAKPLQRLKGFPSFPLVERQANEVDWWDM |
| | VCNVKKLINEKKEDGKVFWQNLAGYKRQEALRPYLSSPEDRKKGKKFA |
| | RYQFGDLLLHLEKKHGEDWGKVYDEAWERIDKKVEGLSKHIKLEEERRS |

TABLE 4-continued

CasX Variant Sequences

| Description* | Amino Acid Sequence |
|---|---|
| | EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKPLYNRRTRQDEPALFVALTFERREVL<br>DSSNIKPMNLIGIDRGENIPAVIALTDPEGCPLSRFKDSLGNPTHILRIGES<br>YKEKQRTIQAKKEVEQRRAGGYSRKYASKAKNLADDMVRNTARDLLYY<br>AVTQDAMLIFENLSRGFGRQGKRTFMAERQYTRMEDWLTAKLAYEGLS<br>KTYLSKTLAQYTSKTCSNCGFTITSADYDRVLEKLKKTATGWMTTINGKE<br>LKVEGQITYYNRYKRQNVVKDLSVELDRLSEESVNNDISSWTKGRSGEA<br>LSLLKKRFSHRPVQEKFVCLNCGFETHADEQAALNIARSWLFLRSQEYK<br>KYQTNKTTGNTDKRAFVETWQSFYRKKLKEVWKPAV<br>(SEQ ID NO: 116) |
| 278 | QEIKRINKIRRRLVKDSNTKKAGKTGPMKTLLVRVMTPDLRERLENLRKK<br>PENIPQPISNTSRANLNKLLTDYTEMKKAILHVYWEEFQKDPVGLMSRVA<br>QPAPKNIDQRKLIPVKDGNERLTSSGFACSQCCQPLYVYKLEQVNDKGK<br>PHTNYFGRCNVSEHERLILLSPHKPEANDELVTYSLGKFGQRALDFYSIH<br>VTRESNHPVKPLEQIGGNSCASGPVGKALSDACMGAVASFLTKYQDIIL<br>EHQKVIKKNEKRLANLKDIASANGLAFPKITLPPQPHTKEGIEAYNNVVAQ<br>IVIWVNLNLWQKLKIGRDEAKPLQRLKGFPSFPLVERQANEVDWWDMV<br>CNVKKLINEKKEDGKVFWQNLAGYKRQEALRPYLSSEEDRKKGKKFAR<br>YQFGDLLLHLEKKHGEDWGKVYDEAWERIDKKVEGLSKHIKLEEERRSE<br>DAQSKAALTDWLRAKASFVIEGLKEADKDEFCRCELKLQKWYGDLRGK<br>PFAIEAENSILDISGFSKQYNCAFIWQKDGVKKLNLYLIINYFKGGKLRFKK<br>IKPEAFEANRFYTVINKKSGEIVPMEVNFNFDDPNLIILPLAFGKRQGREFI<br>WNDLLSLETGSLKLANGRVIEKTLYNRRTRQDEPALFVALTFERREVLDS<br>SNIKPMNLIGIDRGENIPAVIALTDPEGCPLSRFKDSLGNPTHILRIGESYK<br>EKQRTIQAKKEVEQRRAGGYSRKYASKAKNLADDMVRNTARDLLYYAV<br>TQDAMLIFENLSRGFGRQGKRTFMAERQYTRMEDWLTAKLAYEGLSKT<br>YLSKTLAQYTSKTCSNCGFTITSADYDRVLEKLKKTATGWMTTINGKELK<br>VEGQITYYNRYKRQNVVKDLSVELDRLSEESVNNDISSWTKGRSGEALS<br>LLKKRFSHRPVQEKFVCLNCGFETHADEQAALNIARSWLFLRSQEYKKY<br>QTNKTTGNTDKRAFVETWQSFYRKKLKEVWKPAV<br>(SEQ ID NO: 117) |
| 279 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSEEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGIDRGENIPAVIALTDPEGCPLSRFKDSLGNPTHILRIGES<br>YKEKQRTIQAKKEVEQRRAGGYSRKYASKAKNLADDMVRNTARDLLYY<br>AVTQDAMLIFENLSRGFGRQGKRTFMAERQYTRMEDWLTAKLAYEGLS<br>KTYLSKTLAQYTSKTCSNCGFTITSADYDRVLEKLKKTATGWMTTINGKE<br>LKVEGQITYYNRYKRQNVVKDLSVELDRLSEESVNNDISSWTKGRSGEA<br>LSLLKKRFSHRPVQEKFVCLNCGFETHADEQAALNIARSWLFLRSQEYK<br>KYQTNKTTGNTDKRAFVETWQSFYRKKLKEVWKPAV<br>(SEQ ID NO: 118) |
| 280 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSEEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGIDRGENIPAVIALTDPEGCPLSRFKDSLGNPTHILRIGES<br>YKEKQRTIQAKKEVEQRRAGGYSRKYASKAKNLADDMVRNTARDLLYY<br>AVTQDAMLIFENLSRGFGRQGKRTFMAERQYTRMEDWLTAKLAYEGLS<br>KTYLSKTLAQYTSKTCSNCGFTITSADYDRVLEKLKKTATGWMTTINGKE |

TABLE 4-continued

CasX Variant Sequences

| Description* | Amino Acid Sequence |
|---|---|
| | LKVEGQITYYNRYKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 119) |
| 285 | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAKKEVEQRRAGGYSRKYASKAKNLADDMVRNTARDLLYY AVTQDAMLIFENLSRGFGRQGKRTFMAERQYTRMEDWLTAKLAYEGLS KTYLSKTLAQYTSKTCSNCGFTITSADYDRVLEKLKKTATGWMTTINGKE LKVEGQITYYNRYKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 120) |
| 286 | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAKKEVEQRRAGGYSRKYASKAKNLADDMVRNTARDLLYY AVTQDAMLIFENLSRGFGRQGKRTFMAERQYTRMEDWLTAKLAYEGLS KTYLSKTLAQYTSKTCSNCGFTITSADYDRVLEKLKKTATGWMTTINGKE LKVEGQITYYNRYKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 121) |
| 287 | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAKKEVEQRRAGGYSRKYASKAKNLADDMVRNTARDLLYY AVTQDAMLIFENLSRGFGRQGKRTFMAERQYTRMEDWLTAKLAYEGLS KTYLSKTLAQYTSKTCSNCGFTITSADYDRVLEKLKKTATGWMTTINGKE LKVEGQITYYNRYKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 122) |
| 288 | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTMSSGFACSQCCQPLYVYKLEQVNDK GKPHTNYFGRCNVSEHERLILLSPHKPEANDELVTYSLGKFGQRALDFY SIHVTRESNHPVKPLEQIGGNSCASGPVGKALSDACMGAVASFLTKYQD |

TABLE 4-continued

CasX Variant Sequences

| Description* | Amino Acid Sequence |
|---|---|
| | IILEHQKVIKKNEKRLANLKDIASANGLAFPKITLPPQPHTKEGIEAYNNVV<br>AQIVIWVNLNLWQKLKIGRDEAKPLQRLKGFPSFPLVERQANEVDWWD<br>MVCNVKKLINEKKEDGKVFWQNLAGYKRQEALRPYLSSEEDRKKGKKF<br>ARYQFGDLLLHLEKKHGEDWGKVYDEAWERIDKKVEGLSKHIKLEEERR<br>SEDAQSKAALTDWLRAKASFVIEGLKEADKDEFCRCELKLQKWYGDLR<br>GKPFAIEAENSILDISGFSKQYNCAFIWQKDGVKKLNLYLIINYFKGGKLR<br>FKKIKPEAFEANRFYTVINKKSGEIVPMEVNFNFDDPNLIILPLAFGKRQG<br>REFIWNDLLSLETGSLKLANGRVIEKTLYNRRTRQDEPALFVALTFERRE<br>VLDSSNIKPMNLIGIDRGENIPAVIALTDPEGCPLSRFKDSLGNPTHILRIG<br>ESYKEKQRTIQAKKEVEQRRAGGYSRKYASKAKNLADDMVRNTARDLL<br>YYAVTQDAMLIFENLSRGFGRQGKRTFMAERQYTRMEDWLTAKLAYEG<br>LSKTYLSKTLAQYTSKTCSNCGFTITSADYDRVLEKLKKTATGWMTTING<br>KELKVEGQITYYNRYKRQNVVKDLSVELDRLSEESVNNDISSWTKGRSG<br>EALSLLKKRFSHRPVQEKFVCLNCGFETHADEQAALNIARSWLFLRSQE<br>YKKYQTNKTTGNTDKRAFVETWQSFYRKKLKEVWKPAV<br>(SEQ ID NO: 123) |
| 290 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSEEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGIDRGENIPAVIALTDPEGCPLSRFKDSLGNPTHILRIGES<br>YKEKQRTIQAKKEVEQRRAGGYSRKYASKAKNLADDMVRNTARDLLYY<br>AVTQDAMLIFENLSRGFGRQGKRTFMAERQYTRMEDWLTAKLAYEGLS<br>KTYLSKTLAQYTSKTCSNCGFTITSADYDRVLEKLKKTATGWMTTINGKE<br>LKVEGQITYYNRYKRQNVVKDLSVELDRLSEESVNNDISSWTKGRSGEA<br>LSLLKKRFSHRPVQEKFVCLNCGFETHADEQAALNIARSWLFLRSQEYK<br>KYQTNKTTGNTDKRAFVETWQSFYRKKLKEVWKPAV<br>(SEQ ID NO: 124) |
| 291 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSEEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGIDRGENIPAVIALTDPEGCPLSRFKDSLGNPTHILRIGES<br>YKEKQRTIQAKKEVEQRRAGGYSRKYASKAKNLADDMVRNTARDLLYY<br>AVTQDAMLIFENLSRGFGRQGKRTFMAERQYTRMEDWLTAKLAYEGLS<br>KTYLSKTLAQYTSKTCSNCGFTITSADYDRVLEKLKKTATGWMTTINGKE<br>LKVEGQITYYNRYKRQNVVKDLSVELDRLSEESVNNDISSWTKGRSGEA<br>LSLLKKRFSHRPVQEKFVCLNCGFETHADEQAALNIARSWLFLRSQEYK<br>KYQTNKTTGNTDKRAFVETWQSFYRKKLKEVWKPAV<br>(SEQ ID NO: 125) |
| 293 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALRPYLSSEEDRKKGKKFA<br>RYQFGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGIDRGENIPAVIALTDPEGCPLSRFKDSLGNPTHILRIGES<br>YKEKQRTIQAKKEVEQRRAGGYSRKYASKAKNLADDMVRNTARDLLYY |

TABLE 4-continued

CasX Variant Sequences

| Description* | Amino Acid Sequence |
|---|---|
| | AVTQDAMLIFENLSRGFGRQGKRTFMAERQYTRMEDWLTAKLAYEGLS KTYLSKTLAQYTSKTCSNCGFTITSADYDRVLEKLKKTATGWMTTINGKE LKVEGQITYYNRYKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 126) |
| 300 | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAKKEVEQRRAGGYSRKYASKAKNLADDMVRNTARDLLYY AVTQDAMLIFENLSRGFGRQGKRTFMAERQYTRMEDWLTAKLAYEGLS KTYLSKTLAQYTSKTCSNCGFTITSADYDRVLEKLKKTATGWMTTINGKE LKVEGQITYYNRYKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 127) |
| 492 | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAKKEVEQRRAGGYSRKYASKAKNLADDMVRNTARDLLYY AVTQDAMLIFENLSRGFGRQGKRTFMAERQYTRMEDWLTAKLAYEGLS KTYLSKTLAQYTSKTCSNCGFTITSADYDRVLEKLKKTATGWMTTINGKE LKVEGQITYYNRYKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 128) |
| 493 | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAKKEVEQRRAGGYSRKYASKAKNLADDMVRNTARDLLYY AVTQDAMLIFENLSRGFGRQGKRTFMAERQYTRMEDWLTAKLAYEGLS KTYLSKTLAQYTSKTCSNCGFTITSADYDRVLEKLKKTATGWMTTINGKE LKVEGQITYYNRYKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 129) |
| 387: NTSB swap from SEQ ID | QEIKRINKIRRRLVKDSNTKKAGKTGPMKTLLVRVMTPDLRERLENLRKK PENIPQPISNTSRANLNKLLTDYTEMKKAILHVYWEEFQKDPVGLMSRVA QPASKKIDQNKLKPEMDEKGNLTTAGFACSQCGQPLFVYKLEQVSEKG |

TABLE 4-continued

CasX Variant Sequences

| Description* | Amino Acid Sequence |
|---|---|
| NO: 1 | KAYTNYFGRCNVAEHEKLILLAQLKPEKDSDEAVTYSLGKFGQRALDFY SIHVTRESNHPVKPLEQIGGNSCASGPVGKALSDACMGAVASFLTKYQD IILEHQKVIKKNEKRLANLKDIASANGLAFPKITLPPQPHTKEGIEAYNNVV AQIVIWVNLNLWQKLKIGRDEAKPLQRLKGFPSFPLVERQANEVDWWD MVCNVKKLINEKKEDGKVFWQNLAGYKRQEALRPYLSSEEDRKKGKKF ARYQFGDLLLHLEKKHGEDWGKVYDEAWERIDKKVEGLSKHIKLEEERR SEDAQSKAALTDWLRAKASFVIEGLKEADKDEFCRCELKLQKWYGDLR GKPFAIEAENSILDISGFSKQYNCAFIWQKDGVKKLNLYLIINYFKGGKLR FKKIKPEAFEANRFYTVINKKSGEIVPMEVNFNFDDPNLIILPLAFGKRQG REFIWNDLLSLETGSLKLANGRVIEKTLYNRRTRQDEPALFVALTFERRE VLDSSNIKPMNLIGIDRGENIPAVIALTDPEGCPLSRFKDSLGNPTHILRIG ESYKEKQRTIQAKKEVEQRRAGGYSRKYASKAKNLADDMVRNTARDLL YYAVTQDAMLIFENLSRGFGRQGKRTFMAERQYTRMEDWLTAKLAYEG LSKTYLSKTLAQYTSKTCSNCGFTITSADYDRVLEKLKKTATGWMTTING KELKVEGQITYYNRYKRQNVVKDLSVELDRLSEESVNNDISSWTKGRSG EALSLLKKRFSHRPVQEKFVCLNCGFETHADEQAALNIARSWLFLRSQE YKKYQTNKTTGNTDKRAFVETWQSFYRKKLKEVWKPAV (SEQ ID NO: 130) |
| 395: Helical 1B swap from SEQ ID NO: 1 | QEIKRINKIRRRLVKDSNTKKAGKTGPMKTLLVRVMTPDLRERLENLRKK PENIPQPISNTSRANLNKLLTDYTEMKKAILHVYWEEFQKDPVGLMSRVA QPAPKNIDQRKLIPVKDGNERLTSSGFACSQCCQPLYVYKLEQVNDKGK PHTNYFGRCNVSEHERLILLSPHKPEANDELVTYSLGKFGQRALDFYSIH VTKESTHPVKPLAQIAGNRYASGPVGKALSDACMGTIASFLSKYQDIIIEH QKVVKGNQKRLESLRELAGKENLEYPSVTLPPQPHTKEGVDAYNEVIAR VRMWVNLNLWQKLKLSRDDAKPLLRLKGFPSFPLVERQANEVDWWDM VCNVKKLINEKKEDGKVFWQNLAGYKRQEALRPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAKKEVEQRRAGGYSRKYASKAKNLADDMVRNTARDLLYY AVTQDAMLIFENLSRGFGRQGKRTFMAERQYTRMEDWLTAKLAYEGLS KTYLSKTLAQYTSKTCSNCGFTITSADYDRVLEKLKKTATGWMTTINGKE LKVEGQITYYNRYKRQNVVKDLSVELDRLSEESVNNDISSWTKGRSGEA LSLLKKRFSHRPVQEKFVCLNCGFETHADEQAALNIARSWLFLRSQEYK KYQTNKTTGNTDKRAFVETWQSFYRKKLKEVWKPAV (SEQ ID NO: 131) |
| 485: Helical 1B swap from SEQ ID NO: 1 | QEIKRINKIRRRLVKDSNTKKAGKTGPMKTLLVRVMTPDLRERLENLRKK PENIPQPISNTSRANLNKLLTDYTEMKKAILHVYWEEFQKDPVGLMSRVA QPAPKNIDQRKLIPVKDGNERLTSSGFACSQCCQPLYVYKLEQVNDKGK PHTNYFGRCNVSEHERLILLSPHKPEANDELVTYSLGKFGQRALDFYSIH VTKESTHPVKPLAQIAGNRYASGPVGKALSDACMGTIASFLSKYQDIIIEH QKVVKGNQKRLESLRELAGKENLEYPSVTLPPQPHTKEGVDAYNEVIAR VRMWVNLNLWQKLKLSRDDAKPLLRLKGFPSFPLVERQANEVDWWDM VCNVKKLINEKKEDGKVFWQNLAGYKRQEALRPYLSSEEDRKKGKKFA RYQLGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGVDRGENIPAVIALTDPEGCPLSRFKDSLGNPTHILRIGE SYKEKQRTIQAKKEVEQRRAGGYSRKYASKAKNLADDMVRNTARDLLY YAVTQDAMLIFENLSRGFGRQGKRTFMAERQYTRMEDWLTAKLAYEGL SKTYLSKTLAQYTSKTCSNCGFTITSADYDRVLEKLKKTATGWMTTINGK ELKVEGQITYYNRRKRQNVVKDLSVELDRLSEESVNNDISSWTKGRSGE ALSLLKKRFSHRPVQEKFVCLNCGFETHADEQAALNIARSWLFLRSQEY KKYQTNKTTGNTDKRAFVETWQSFYRKKLKEVWKPAV (SEQ ID NO: 132) |
| 486: Helical 1B swap from SEQ ID NO: 1 | QEIKRINKIRRRLVKDSNTKKAGKTGPMKTLLVRVMTPDLRERLENLRKK PENIPQPISNTSRANLNKLLTDYTEMKKAILHVYWEEFQKDPVGLMSRVA QPAPKNIDQRKLIPVKDGNERLTSSGFACSQCCQPLYVYKLEQVNDKGK PHTNYFGRCNVSEHERLILLSPHKPEANDELVTYSLGKFGQRALDFYSIH VTKESTHPVKPLAQIAGNRYASGPVGKALSDACMGTIASFLSKYQDIIIEH QKVVKGNQKRLESLRELAGKENLEYPSVTLPPQPHTKEGVDAYNEVIAR VRMWVNLNLWQKLKLSRDDAKPLLRLKGFPSFPLVERQANEVDWWDM VCNVKKLINEKKEDGKVFWQNLAGYKRQEALRPYLSSEEDRKKGKKFA RYQLGDLLKHLEKKHGEDWGKVYDEAWERIDKKVEGLSKHIKLEEERR SEDAQSKAALTDWLRAKASFVIEGLKEADKDEFCRCELKLQKWYGDLR GKPFAIEAENSILDISGFSKQYNCAFIWQKDGVKKLNLYLIINYFKGGKLR FKKIKPEAFEANRFYTVINKKSGEIVPMEVNFNFDDPNLIILPLAFGKRQG REFIWNDLLSLETGSLKLANGRVIEKTLYNRRTRQDEPALFVALTFERRE |

TABLE 4-continued

CasX Variant Sequences

| Description* | Amino Acid Sequence |
|---|---|
| | VLDSSNIKPMNLIGVDRGENIPAVIALTDPEGCPLSRFKDSLGNPTHILRI<br>GESYKEKQRTIQAKKEVEQRRAGGYSRKYASKAKNLADDMVRNTARDL<br>LYYAVTQDAMLIFENLSRGFGRQGKRTFMAERQYTRMEDWLTAKLAYE<br>GLSKTYLSKTLAQYTSKTCSNCGFTITSADYDRVLEKLKKTATGWMTTIN<br>GKELKVEGQITYYNRRKRQNVVKDLSVELDRLSEESVNNDISSWTKGRS<br>GEALSLLKKRFSHRPVQEKFVCLNCGFETHADEQAALNIARSWLFLRSQ<br>EYKKYQTNKTTGNTDKRAFVETWQSFYRKKLKEVWKPAV<br>(SEQ ID NO: 133) |
| 487:<br>Helical 1B<br>swap from<br>SEQ ID<br>NO: 1 | QEIKRINKIRRRLVKDSNTKKAGKTGPMKTLLVRVMTPDLRERLENLRKK<br>PENIPQPISNTSRANLNKLLTDYTEMKKAILHVYWEEFQKDPVGLMSRVA<br>QPAPKNIDQRKLIPVKDGNERLTSSGFACSQCCQPLYVYKLEQVNDKGK<br>PHTNYFGRCNVSEHERLILLSPHKPEANDELVTYSLGKFGQRALDFYSIH<br>VTKESTHPVKPLAQIAGNRYASGPVGKALSDACMGTIASFLSKYQDIIIEH<br>QKVVKGNQKRLESLRELAGKENLEYPSVTLPPQPHTKEGVDAYNEVIAR<br>VRMWVNLNLWQKLKLSRDDAKPLLRLKGFPSFPLVERQANEVDWWDM<br>VCNVKKLINEKKEDGKVFWQNLAGYKRQEALRPYLSSEEDRKKGKKFA<br>RYQLGDLLLHLEKKHGEDWGKVYDEAWERIDKKVEGLSKHIKLEEERRS<br>EDAQSKAALTDWLRAKASFVIEGLKEADKDEFCRCELKLQKWYGDLRG<br>KPFAIEAENSILDISGFSKQYNCAFIWQKDGVKKLNLYLIINYFKGGKLRFK<br>KIKPEAFEANRFYTVINKKSGEIVPMEVNFNFDDPNLIILPLAFGKRQGRE<br>FIWNDLLSLETGSLKLANGRVIEKTLYNRRTRQDEPALFVALTFERREVL<br>DSSNIKPMNLIGVDRGENIPAVIALTDPEGCPLSRFKDSLGNPTHILRIGE<br>SYKEKQRTIQAKKEVEQRRAGGYSRKYASKAKNLADDMVRNTARDLLY<br>YAVTQDAMLIFENLSRGFGRQGKRTFMAERQYTRMEDWLTAKLAYEGL<br>SKTYLSKTLAQYTSKTCSNCGFTITSADYDRVLEKLKKTATGWMTTINGK<br>ELKVEGQITYYNRYKRQNVVKDLSVELDRLSEESVNNDISSWTKGRSGE<br>ALSLLKKRFSHRPVQEKFVCLNCGFETHADEQAALNIARSWLFLRSQEY<br>KKYQTNKTTGNTDKRAFVETWQSFYRKKLKEVWKPAV<br>(SEQ ID NO: 134) |
| 488:<br>NTSB and<br>Helical 1B<br>swap from<br>SEQ ID<br>NO: 1 | QEIKRINKIRRRLVKDSNTKKAGKTGPMKTLLVRVMTPDLRERLENLRKK<br>PENIPQPISNTSRANLNKLLTDYTEMKKAILHVYWEEFQKDPVGLMSRVA<br>QPASKKIDQNKLKPEMDEKGNLTTAGFACSQCGQPLFVYKLEQVSEKG<br>KAYTNYFGRCNVAEHEKLILLAQLKPEKDSDEAVTYSLGKFGQRALDFY<br>SIHVTKESTHPVKPLAQIAGNRYASGPVGKALSDACMGTIASFLSKYQDII<br>IEHQKWKGNQKRLESLRELAGKENLEYPSVTLPPQPHTKEGVDAYNEV<br>IARVRMWVNLNLWQKLKLSRDDAKPLLRLKGFPSFPLVERQANEVDWW<br>DMVCNVKKLINEKKEDGKVFWQNLAGYKRQEALRPYLSSEEDRKKGKK<br>FARYQFGDLLLHLEKKHGEDWGKVYDEAWERIDKKVEGLSKHIKLEEER<br>RSEDAQSKAALTDWLRAKASFVIEGLKEADKDEFCRCELKLQKWYGDL<br>RGKPFAIEAENSILDISGFSKQYNCAFIWQKDGVKKLNLYLIINYFKGGKL<br>RFKKIKPEAFEANRFYTVINKKSGEIVPMEVNFNFDDPNLIILPLAFGKRQ<br>GREFIWNDLLSLETGSLKLANGRVIEKTLYNRRTRQDEPALFVALTFERR<br>EVLDSSNIKPMNLIGIDRGENIPAVIALTDPEGCPLSRFKDSLGNPTHILRI<br>GESYKEKQRTIQAKKEVEQRRAGGYSRKYASKAKNLADDMVRNTARDL<br>LYYAVTQDAMLIFENLSRGFGRQGKRTFMAERQYTRMEDWLTAKLAYE<br>GLSKTYLSKTLAQYTSKTCSNCGFTITSADYDRVLEKLKKTATGWMTTIN<br>GKELKVEGQITYYNRYKRQNVVKDLSVELDRLSEESVNNDISSWTKGRS<br>GEALSLLKKRFSHRPVQEKFVCLNCGFETHADEQAALNIARSWLFLRSQ<br>EYKKYQTNKTTGNTDKRAFVETWQSFYRKKLKEVWKPAV<br>(SEQ ID NO: 135) |
| 489:<br>NTSB and<br>Helical 1B<br>swap from<br>SEQ ID<br>NO: 1 | QEIKRINKIRRRLVKDSNTKKAGKTGPMKTLLVRVMTPDLRERLENLRKK<br>PENIPQPISNTSRANLNKLLTDYTEMKKAILHVYWEEFQKDPVGLMSRVA<br>QPASKKIDQNKLKPEMDEKGNLTTAGFACSQCGQPLFVYKLEQVSEKG<br>KAYTNYFGRCNVAEHEKLILLAQLKPEKDSDEAVTYSLGKFGQRALDFY<br>SIHVTKESTHPVKPLAQIAGNRYASGPVGKALSDACMGTIASFLSKYQDII<br>IEHQKVVVKGNQKRLESLRELAGKENLEYPSVTLPPQPHTKEGVDAYNEV<br>IARVRMWVNLNLWQKLKLSRDDAKPLLRLKGFPSFPLVERQANEVDWW<br>DMVCNVKKLINEKKEDGKVFWQNLAGYKRQEALRPYLSSEEDRKKGKK<br>FARYQLGDLLLHLEKKHGEDWGKVYDEAWERIDKKVEGLSKHIKLEEER<br>RSEDAQSKAALTDWLRAKASFVIEGLKEADKDEFCRCELKLQKWYGDL<br>RGKPFAIEAENSILDISGFSKQYNCAFIWQKDGVKKLNLYLIINYFKGGKL<br>RFKKIKPEAFEANRFYTVINKKSGEIVPMEVNFNFDDPNLIILPLAFGKRQ<br>GREFIWNDLLSLETGSLKLANGRVIEKTLYNRRTRQDEPALFVALTFERR<br>EVLDSSNIKPMNLIGVDRGENIPAVIALTDPEGCPLSRFKDSLGNPTHILRI<br>GESYKEKQRTIQAKKEVEQRRAGGYSRKYASKAKNLADDMVRNTARDL<br>LYYAVTQDAMLIFENLSRGFGRQGKRTFMAERQYTRMEDWLTAKLAYE<br>GLSKTYLSKTLAQYTSKTCSNCGFTITSADYDRVLEKLKKTATGWMTTIN<br>GKELKVEGQITYYNRRKRQNVVKDLSVELDRLSEESVNNDISSWTKGRS<br>GEALSLLKKRFSHRPVQEKFVCLNCGFETHADEQAALNIARSWLFLRSQ<br>EYKKYQTNKTTGNTDKRAFVETWQSFYRKKLKEVWKPAV<br>(SEQ ID NO: 136) |

TABLE 4-continued

| CasX Variant Sequences | |
|---|---|
| Description* | Amino Acid Sequence |
| 490:<br>NTSB and<br>Helical 1B<br>swap from<br>SEQ ID<br>NO: 1 | QEIKRINKIRRRLVKDSNTKKAGKTGPMKTLLVRVMTPDLRERLENLRKK<br>PENIPQPISNTSRANLNKLLTDYTEMKKAILHVYWEEFQKDPVGLMSRVA<br>QPASKKIDQNKLKPEMDEKGNLTTAGFACSQCGQPLFVYKLEQVSEKG<br>KAYTNYFGRCNVAEHEKLILLAQLKPEKDSDEAVTYSLGKFGQRALDFY<br>SIHVTKESTHPVKPLAQIAGNRYASGPVGKALSDACMGTIASFLSKYQDII<br>IEHQKVVKGNQKRLESLRELAGKENLEYPSVTLPPQPHTKEGVDAYNEV<br>IARVRMWVNLNLWQKLKLSRDDAKPLLRLKGFPSFPLVERQANEVDWW<br>DMVCNVKKLINEKKEDGKVFWQNLAGYKRQEALRPYLSSEEDRKKGKK<br>FARYQLGDLLKHLEKKHGEDWGKVYDEAWERIDKKVEGLSKHIKLEEER<br>RSEDAQSKAALTDWLRAKASFVIEGLKEADKDEFCRCELKLQKWYGDL<br>RGKPFAIEAENSILDISGFSKQYNCAFIWQKDGVKKLNLYLIINYFKGGKL<br>RFKKIKPEAFEANRFYTVINKKSGEIVPMEVNFNFDDPNLIILPLAFGKRQ<br>GREFIWNDLLSLETGSLKLANGRVIEKTLYNRRTRQDEPALFVALTFERR<br>EVLDSSNIKPMNLIGVDRGENIPAVIALTDPEGCPLSRFKDSLGNPTHILRI<br>GESYKEKQRTIQAKKEVEQRRAGGYSRKYASKAKNLADDMVRNTARDL<br>LYYAVTQDAMLIFENLSRGFGRQGKRTFMAERQYTRMEDWLTAKLAYE<br>GLSKTYLSKTLAQYTSKTCSNCGFTITSADYDRVLEKLKKTATGWMTTIN<br>GKELKVEGQITYYNRRKRQNVVKDLSVELDRLSEESVNNDISSWTKGRS<br>GEALSLLKKRFSHRPVQEKFVCLNCGFETHADEQAALNIARSWLFLRSQ<br>EYKKYQTNKTTGNTDKRAFVETWQSFYRKKLKEVWKPAV<br>(SEQ ID NO: 137) |
| 491:<br>NTSB and<br>Helical 1B<br>swap from<br>SEQ ID<br>NO: 1 | QEIKRINKIRRRLVKDSNTKKAGKTGPMKTLLVRVMTPDLRERLENLRKK<br>PENIPQPISNTSRANLNKLLTDYTEMKKAILHVYWEEFQKDPVGLMSRVA<br>QPASKKIDQNKLKPEMDEKGNLTTAGFACSQCGQPLFVYKLEQVSEKG<br>KAYTNYFGRCNVAEHEKLILLAQLKPEKDSDEAVTYSLGKFGQRALDFY<br>SIHVTKESTHPVKPLAQIAGNRYASGPVGKALSDACMGTIASFLSKYQDII<br>IEHQKWKGNQKRLESLRELAGKENLEYPSVTLPPQPHTKEGVDAYNEV<br>IARVRMWVNLNLWQKLKLSRDDAKPLLRLKGFPSFPLVERQANEVDWW<br>DMVCNVKKLINEKKEDGKVFWQNLAGYKRQEALRPYLSSEEDRKKGKK<br>FARYQLGDLLLHLEKKHGEDWGKVYDEAWERIDKKVEGLSKHIKLEEER<br>RSEDAQSKAALTDWLRAKASFVIEGLKEADKDEFCRCELKLQKWYGDL<br>RGKPFAIEAENSILDISGFSKQYNCAFIWQKDGVKKLNLYLIINYFKGGKL<br>RFKKIKPEAFEANRFYTVINKKSGEIVPMEVNFNFDDPNLIILPLAFGKRQ<br>GREFIWNDLLSLETGSLKLANGRVIEKTLYNRRTRQDEPALFVALTFERR<br>EVLDSSNIKPMNLIGVDRGENIPAVIALTDPEGCPLSRFKDSLGNPTHILRI<br>GESYKEKQRTIQAKKEVEQRRAGGYSRKYASKAKNLADDMVRNTARDL<br>LYYAVTQDAMLIFENLSRGFGRQGKRTFMAERQYTRMEDWLTAKLAYE<br>GLSKTYLSKTLAQYTSKTCSNCGFTITSADYDRVLEKLKKTATGWMTTIN<br>GKELKVEGQITYYNRYKRQNVVKDLSVELDRLSEESVNNDISSWTKGRS<br>GEALSLLKKRFSHRPVQEKFVCLNCGFETHADEQAALNIARSWLFLRSQ<br>EYKKYQTNKTTGNTDKRAFVETWQSFYRKKLKEVWKPAV<br>(SEQ ID NO: 138) |
| 494:<br>NTSB swap<br>from SEQ ID<br>NO: 1 | QEIKRINKIRRRLVKDSNTKKAGKTGPMKTLLVRVMTPDLRERLENLRKK<br>PENIPQPISNTSRANLNKLLTDYTEMKKAILHVYWEEFQKDPVGLMSRVA<br>QPASKKIDQNKLKPEMDEKGNLTTAGFACSQCGQPLFVYKLEQVSEKG<br>KAYTNYFGRCNVAEHEKLILLAQLKPEKDSDEAVTYSLGKFGQRALDFY<br>SIHVTRESNHPVKPLEQIGGNSCASGPVGKALSDACMGAVASFLTKYQD<br>IILEHQKVIKKNEKRLANLKDIASANGLAFPKITLPPQPHTKEGIEAYNNVV<br>AQIVIWVNLNLWQKLKIGRDEAKPLQRLKGFPSFPLVERQANEVDWWD<br>MVCNVKKLINEKKEDGKVFWQNLAGYKRQEALRPYLSSEEDRKKGKKF<br>ARYQLGDLLLHLEKKHGEDWGKVYDEAWERIDKKVEGLSKHIKLEEERR<br>SEDAQSKAALTDWLRAKASFVIEGLKEADKDEFCRCELKLQKWYGDLR<br>GKPFAIEAENSILDISGFSKQYNCAFIWQKDGVKKLNLYLIINYFKGGKLR<br>FKKIKPEAFEANRFYTVINKKSGEIVPMEVNFNFDDPNLIILPLAFGKRQG<br>REFIWNDLLSLETGSLKLANGRVIEKTLYNRRTRQDEPALFVALTFERRE<br>VLDSSNIKPMNLIGVDRGENIPAVIALTDPEGCPLSRFKDSLGNPTHILRI<br>GESYKEKQRTIQAKKEVEQRRAGGYSRKYASKAKNLADDMVRNTARDL<br>LYYAVTQDAMLIFENLSRGFGRQGKRTFMAERQYTRMEDWLTAKLAYE<br>GLSKTYLSKTLAQYTSKTCSNCGFTITSADYDRVLEKLKKTATGWMTTIN<br>GKELKVEGQITYYNRYKRQNVVKDLSVELDRLSEESVNNDISSWTKGRS<br>GEALSLLKKRFSHRPVQEKFVCLNCGFETHADEQAALNIARSWLFLRSQ<br>EYKKYQTNKTTGNTDKRAFVETWQSFYRKKLKEVWKPAV<br>(SEQ ID NO: 139) |
| 328: S867G | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDII<br>LEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDM<br>VCNVKKLINEKKEDGKVFWQNLAGYKRQEALLPYLSSEEDRKKGKKFA<br>RYQFGDLLLHLEKKHGEDWGKVYDEAWERIDKKVEGLSKHIKLEEERRS |

TABLE 4-continued

CasX Variant Sequences

| Description* | Amino Acid Sequence |
|---|---|
| | EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAAKEVEQRRAGGYSRKYASKAKNLADDMVRNTARDLLYY AVTQDAMLIFENLSRGFGRQGKRTFMAERQYTRMEDWLTAKLAYEGLP SKTYLSKTLAQYTSKTCSNCGFTITSADYDRVLEKLKKTATGWMTTINGK ELKVEGQITYYNRYKRQNVVKDLGVELDRLSEESVNNDISSWTKGRSGE ALSLLKKRFSHRPVQEKFVCLNCGFETHADEQAALNIARSWLFLRSQEY KKYQTNKTTGNTDKRAFVETWQSFYRKKLKEVWKPAV (SEQ ID NO: 140) |
| 388: L379R + A708K + [P793] + X1 Helical2 swap | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVVA QIVIWVNLNLWQKLKIGRDEAKPLQRLKGFPSFPVVERRENEVDWWNTI NEVKKLIDAKRDMGRVFWSGVTAEKRNTILEGYNYLPNENDHKKREGSL ENPKKPAKRQFGDLLLYLEKKYAGDWGKVFDEAWERIDKKIAGLTSHIE REEARNAEDAQSKAVLTDWLRAKASFVLERLKEMDEKEFYACEIQLQK WYGDLRGNPFAVEAENSILDISGFSKQYNCAFIWQKDGVKKLNLYLIINY FKGGKLRFKKIKPEAFEANRFYTVINKKSGEIVPMEVNFNFDDPNLIILPLA FGKRQGREFIWNDLLSLETGSLKLANGRVIEKTLYNRRTRQDEPALFVAL TFERREVLDSSNIKPMNLIGIDRGENIPAVIALTDPEGCPLSRFKDSLGNP THILRIGESYKEKQRTIQAKKEVEQRRAGGYSRKYASKAKNLADDMVRN TARDLLYYAVTQDAMLIFENLSRGFGRQGKRTFMAERQYTRMEDWLTA KLAYEGLSKTYLSKTLAQYTSKTCSNCGFTITSADYDRVLEKLKKTATGW MTTINGKELKVEGQITYYNRYKRQNVVKDLSVELDRLSEESVNNDISSW TKGRSGEALSLLKKRFSHRPVQEKFVCLNCGFETHADEQAALNIARSWL FLRSQEYKKYQTNKTTGNTDKRAFVETWQSFYRKKLKEVWKPAV (SEQ ID NO: 141) |
| 389: L379R + A708K + [P793] + X1 RuvC1 swap | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPVNLIGVDRGENIPAVIALTDPEGCPLPEFKDSSGGPTDILRIGE GYKEKQRAIQAAKEVEQRRAGGYSRKFASKSRNLADDMVRNSARDLFY HAVTHDAVLVFENLSRGFGRQGKRTFMTERQYTKMEDWLTAKLAYEGL TSKTYLSKTLAQYTSKTCSNCGFTITSADYDRVLEKLKKTATGWMTTING KELKVEGQITYYNRYKRQNVVKDLSVELDRLSEESVNNDISSWTKGRSG EALSLLKKRFSHRPVQEKFVCLNCGFETHADEQAALNIARSWLFLRSQE YKKYQTNKTTGNTDKRAFVETWQSFYRKKLKEVWKPAV (SEQ ID NO: 142) |
| 390: L379R + A708K + [P793] + X1 RuvC2 swap | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDII LEHQKVIKKNEKRLANLKDIASANGLAFPKITLPPQPHTKEGIEAYNNVVA QIVIWVNLNLWQKLKIGRDEAKPLQRLKGFPSFPLVERQANEVDWWDM VCNVKKLINEKKEDGKVFWQNLAGYKRQEALRPYLSSEEDRKKGKKFA RYQFGDLLLHLEKKHGEDWGKVYDEAWERIDKKVEGLSKHIKLEEERRS EDAQSKAALTDWLRAKASFVIEGLKEADKDEFCRCELKLQKWYGDLRG KPFAIEAENSILDISGFSKQYNCAFIWQKDGVKKLNLYLIINYFKGGKLRFK KIKPEAFEANRFYTVINKKSGEIVPMEVNFNFDDPNLIILPLAFGKRQGRE FIWNDLLSLETGSLKLANGRVIEKTLYNRRTRQDEPALFVALTFERREVL DSSNIKPMNLIGIDRGENIPAVIALTDPEGCPLSRFKDSLGNPTHILRIGES YKEKQRTIQAKKEVEQRRAGGYSRKYASKAKNLADDMVRNTARDLLYY AVTQDAMLIFENLSRGFGRQGKRTFMAERQYTRMEDWLTAKLAYEGLS |

TABLE 4-continued

| CasX Variant Sequences | |
|---|---|
| Description* | Amino Acid Sequence |
| | KTYLSKTLAQYTSKTCSNCGFTITSADYDRVLEKLKKTATGWMTTINGKE LKVEGQITYYNRYKRQNVVKDLSVELDRLSEESVNNDISSWTKGRSGEA LSLLKKRFSHRPVQEKFVCLNCGFETHADEQAALNIARSWLFLNSNSTE FKSYKSGKQPFVGAWQAFYKRRLKEVWKPNA (SEQ ID NO: 143) |

In some embodiments, the CasX variant protein comprises a sequence selected from the group consisting of SEQ ID NOs: 49-143, 438, 440, 442, 444, 446, 448-460, 472, 474, 478, 480, 482, 484, 486, 488, 490, 612 and 613. In some embodiments, the CasX variant protein comprises a sequence selected from the group consisting of SEQ ID NOs: 49-143, 438, 440, 442, 444, 446, 448-460, 472, 474, 478, 480, 482, 484, 486, 488, 490, 612 and 613, or a sequence having at least about 50%, at least about 60%, at least about 70%, at least about 80%, at least about 90%, or at least about 95%, or at least about 95%, or at least about 96%, or at least about 97%, or at least about 98%, or at least about 99% sequence identity thereto. In some embodiments, the CasX variant protein comprises a sequence selected from the group consisting of SEQ ID NOs: 49-143, or a sequence having at least about 50%, at least about 60%, at least about 70%, at least about 80%, at least about 90%, or at least about 95%, or at least about 95%, or at least about 96%, or at least about 97%, or at least about 98%, or at least about 99% sequence identity thereto. In some embodiments, the CasX variant protein comprises a sequence selected from the group consisting of SEQ ID NOs: 49-143.

In some embodiments, the CasX variant protein has one or more improved characteristic of the CasX protein when compared to a reference CasX protein, for example a reference protein of SEQ ID NO:1, SEQ ID NO:2 or SEQ ID NO:3. In some embodiments, the at least one improved characteristic of the CasX variant is at least about 1.1 to about 100,000-fold improved relative to the reference protein. In some embodiments, the at least one improved characteristic of the CasX variant is at least about 1.1 to about 10,000-fold improved, at least about 1.1 to about 1,000-fold improved, at least about 1.1 to about 500-fold improved, at least about 1.1 to about 400-fold improved, at least about 1.1 to about 300-fold improved, at least about 1.1 to about 200-fold improved, at least about 1.1 to about 100-fold improved, at least about 1.1 to about 50-fold improved, at least about 1.1 to about 40-fold improved, at least about 1.1 to about 30-fold improved, at least about 1.1 to about 20-fold improved, at least about 1.1 to about 10-fold improved, at least about 1.1 to about 9-fold improved, at least about 1.1 to about 8-fold improved, at least about 1.1 to about 7-fold improved, at least about 1.1 to about 6-fold improved, at least about 1.1 to about 5-fold improved, at least about 1.1 to about 4-fold improved, at least about 1.1 to about 3-fold improved, at least about 1.1 to about 2-fold improved, at least about 1.1 to about 1.5-fold improved, at least about 1.5 to about 3-fold improved, at least about 1.5 to about 4-fold improved, at least about 1.5 to about 5-fold improved, at least about 1.5 to about 10-fold improved, at least about 5 to about 10-fold improved, at least about 10 to about 20-fold improved, at least 10 to about 30-fold improved, at least 10 to about 50-fold improved or at least 10 to about 100-fold improved than the reference CasX protein. In some embodiments, the at least one improved characteristic of the CasX variant is at least about 10 to about 1000-fold improved relative to the reference CasX protein.

In some embodiments, the one or more improved characteristics of the CasX variant protein is at least about 5, at least about 10, at least about 20, at least about 30, at least about 40, at least about 50, at least about 60, at least about 70, at least about 80, at least about 90, at least about 100, at least about 250, at least about 500, or at least about 1000, at least about 5,000, at least about 10,000, or at least about 100,000-fold improved relative to a reference CasX protein. In some embodiments, an improved characteristics of the CasX variant protein is at least about 1.1, at least about 1.2, at least about 1.3, at least about 1.4, at least about 1.5, at least about 1.6, at least about 1.7, at least about 1.8, at least about 1.9, at least about 2, at least about 2.1, at least about 2.2, at least about 2.3, at least about 2.4, at least about 2.5, at least about 2.6, at least about 2.7, at least about 2.8, at least about 2.9, at least about 3, at least about 3.5, at least about 4, at least about 4.5, at least about 5, at least about 5.5, at least about 6, at least about 6.5, at least about 7.0, at least about 7.5, at least about 8, at least about 8.5, at least about 9, at least about 9.5, at least about 10, at least about 11, at least about 12, at least about 13, at least about 14, at least about 15, at least about 20, at least about 30, at least about 40, at least about 50, at least about 60, at least about 70, at least about 80, at least about 90 at least about 100, at least about 500, at least about 1,000, at least about 10,000, or at least about 100,000-fold improved relative to a reference CasX protein. In other cases, the one or more improved characteristics of the CasX variant is about 1.1 to 100,00-fold, about 1.1 to 10,00-fold, about 1.1 to 1,000-fold, about 1.1 to 500-fold, about 1.1 to 100-fold, about 1.1 to 50-fold, about 1.1 to 20-fold, about 10 to 100,00-fold, about 10 to 10,00-fold, about 10 to 1,000-fold, about 10 to 500-fold, about 10 to 100-fold, about 10 to 50-fold, about 10 to 20-fold, about 2 to 70-fold, about 2 to 50-fold, about 2 to 30-fold, about 2 to 20-fold, about 2 to 10-fold, about 5 to 50-fold, about 5 to 30-fold, about 5 to 10-fold, about 100 to 100,00-fold, about 100 to 10,00-fold, about 100 to 1,000-fold, about 100 to 500-fold, about 500 to 100,00-fold, about 500 to 10,00-fold, about 500 to 1,000-fold, about 500 to 750-fold, about 1,000 to 100,00-fold, about 10,000 to 100,00-fold, about 20 to 500-fold, about 20 to 250-fold, about 20 to 200-fold, about 20 to 100-fold, about 20 to 50-fold, about 50 to 10,000-fold, about 50 to 1,000-fold, about 50 to 500-fold, about 50 to 200-fold, or about 50 to 100-fold, improved relative to the reference CasX of SEQ ID NO:1, SEQ ID NO:2 or SEQ ID NO:3. In other cases, the one or more improved characteristics of the CasX variant is about 1.1-fold, 1.2-fold, 1.3-fold, 1.4-fold, 1.5-fold, 1.6-fold, 1.7-fold, 1.8-fold, 1.9-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 45-fold, 50-fold, 55-fold, 60-fold, 70-fold, 80-fold, 90-fold, 100-fold, 110-fold, 120-fold, 130-fold, 140-fold, 150-fold, 160-fold, 170-fold, 180-fold, 190-fold, 200-fold, 210-fold, 220-fold, 230-fold, 240-fold, 250-fold, 260-fold, 270-fold, 280-fold, 290-fold, 300-fold, 310-fold, 320-fold, 330-fold, 340-fold, 350-fold, 360-fold, 370-fold, 380-fold, 390-fold, 400-fold, 425-fold, 450-fold, 475-fold, or 500-fold or more improved relative to the reference CasX of SEQ ID NO:1, SEQ ID NO:2 or SEQ ID NO:3. Exemplary characteristics that can be improved in CasX variant proteins relative to the same characteristics in reference CasX proteins include, but are not limited to, improved folding of the variant, improved binding affinity to the gNA, improved binding affinity to the target DNA, improved ability to utilize a greater spectrum of PAM sequences in the editing and/or binding of target DNA, improved unwinding of the target DNA, increased editing activity, improved editing efficiency, improved editing specificity, increased activity of the nuclease, increased target strand loading for double strand cleavage, decreased target strand loading for single strand nicking, decreased off-target cleavage, improved binding of the non-target strand of DNA, improved protein stability, improved CasX: gNA RNA complex stability, improved protein solubility, improved CasX:gNA RNP complex solubility, improved ability to form cleavage-competent RNP with a gNA, improved protein yield, improved protein expression, and improved fusion characteristics. In some embodiments, the variant comprises at least one improved characteristic. In other embodiments, the variant comprises at least two improved characteristics. In further embodiments, the variant comprises at least three improved characteristics. In some embodiments, the variant comprises at least four improved characteristics. In still further embodiments, the variant comprises at least five, at least six, at least seven, at least eight, at least nine, at least ten, at least eleven, at least twelve, at least thirteen, or more improved characteristics.

Exemplary improved characteristic include, as one example, improved editing efficiency. In some embodiments, an RNP comprising the CasX protein and a gNA of the disclosure, at a concentration of 20 pM or less, is capable of cleaving a double stranded DNA target with an efficiency of at least 80%. In some embodiments, the RNP at a concentration of 20 pM or less, is capable of cleaving a double stranded DNA target with an efficiency of at least 40%, at least 50%, at least 60%, at least 70%, at least 80%, at least 85%, at least 90% or at least 95%. In some embodiments, the RNP at a concentration of 50 pM or less, 40 pM or less, 30 pM or less, 20 pM or less, 10 pM or less, or 5 pM or less, is capable of cleaving a double stranded DNA target with an efficiency of at least 40%, at least 50%, at least 60%, at least 70%, at least 80%, at least 85%, at least 90% or at least 95%.

These improved characteristics are described in more detail below.

j. Protein Stability

In some embodiments, the disclosure provides a CasX variant protein with improved stability relative to a reference CasX protein. In some embodiments, improved stability of the CasX variant protein results in expression of a higher steady state of protein, which improves editing efficiency. In some embodiments, improved stability of the CasX variant protein results in a larger fraction of CasX protein that remains folded in a functional conformation and improves editing efficiency or improves purifiability for manufacturing purposes. As used herein, a "functional conformation" refers to a CasX protein that is in a conformation where the protein is capable of binding a gNA and target DNA. In embodiments wherein the CasX variant does not carry one or more mutations rendering it catalytically dead, the CasX variant is capable of cleaving, nicking, or otherwise modifying the target DNA. For example, a functional CasX variant can, in some embodiments, be used for gene-editing, and a functional conformation refers to an "editing-competent" conformation. In some exemplary embodiments, including those embodiments where the CasX variant protein results in a larger fraction of CasX protein that remains folded in a functional conformation, a lower concentration of CasX variant is needed for applications such as gene editing compared to a reference CasX protein. Thus, in some embodiments, the CasX variant with improved stability has improved efficiency compared to a reference CasX in one or more gene editing contexts.

In some embodiments, the disclosure provides a CasX variant protein having improved thermostability relative to a reference CasX protein. In some embodiments, the CasX variant protein has improved thermostability of the CasX variant protein at a particular temperature range. Without wishing to be bound by any theory, some reference CasX proteins natively function in organisms with niches in groundwater and sediment; thus, some reference CasX proteins may have evolved to exhibit optimal function at lower or higher temperatures that may be desirable for certain applications. For example, one application of CasX variant proteins is gene editing of mammalian cells, which is typically carried out at about 37° C. In some embodiments, a CasX variant protein as described herein has improved thermostability compared to a reference CasX protein at a temperature of at least 16° C., at least 18° C., at least 20° C., at least 22° C., at least 24° C., at least 26° C., at least 28° C., at least 30° C., at least 32° C., at least 34° C., at least 35° C., at least 36° C., at least 37° C., at least 38° C., at least 39° C., at least 40° C., at least 41° C., at least 42° C., at least 44° C., at least 46° C., at least 48° C., at least 50° C., at least 52° C., or greater. In some embodiments, a CasX variant protein has improved thermostability and functionality compared to a reference CasX protein that results in improved gene editing functionality, such as mammalian gene editing applications, which may include human gene editing applications.

In some embodiments, the disclosure provides a CasX variant protein having improved stability of the CasX variant protein:gNA complex relative to the reference CasX protein:gNA complex such that the RNP remains in a functional form. Stability improvements can include increased thermostability, resistance to proteolytic degradation, enhanced pharmacokinetic properties, stability across a range of pH conditions, salt conditions, and tonicity. Improved stability of the complex may, in some embodiments, lead to improved editing efficiency. In some embodiments, the RNP of the CasX variant and gNA variant has at least a 5%, at least a 10%, at least a 15%, or at least a 20%, or at least a 5-20% higher percentage of cleavage-competent RNP compared to an RNP of the reference CasX of SEQ ID NOS: 1-3 and the gNA of any one of SEQ ID NOS:4-16 of Table 1.

In some embodiments, the disclosure provides a CasX variant protein having improved thermostability of the CasX variant protein:gNA complex relative to the reference CasX protein:gNA complex. In some embodiments, a CasX variant protein has improved thermostability relative to a reference CasX protein. In some embodiments, the CasX variant protein:gNA complex has improved thermostability relative to a complex comprising a reference CasX protein at temperatures of at least 16° C., at least 18° C., at least 20° C., at least 22° C., at least 24° C., at least 26° C., at least 28° C., at least 30° C., at least 32° C., at least 34° C., at least 35° C., at least 36° C., at least 37° C., at least 38° C., at least 39° C., at least 40° C., at least 41° C., at least 42° C., at least 44° C., at least 46° C., at least 48° C., at least 50° C., at least 52° C., or greater. In some embodiments, a CasX variant protein has improved thermostability of the CasX variant protein:gNA complex compared to a reference CasX protein:gNA complex, which results in improved function for gene editing applications, such as mammalian gene editing applications, which may include human gene editing applications.

In some embodiments, the improved stability and/or thermostability of the CasX variant protein comprises faster folding kinetics of the CasX variant protein relative to a reference CasX protein, slower unfolding kinetics of the CasX variant protein relative to a reference CasX protein, a larger free energy release upon folding of the CasX variant protein relative to a reference CasX protein, a higher temperature at which 50% of the CasX variant protein is unfolded (Tm) relative to a reference CasX protein, or any combination thereof. These characteristics may be improved by a wide range of values; for example, at least 1.1, at least 1.5, at least 10, at least 50, at least 100, at least 500, at least 1,000, at least 5,000, or at least a 10,000-fold improved, as compared to a reference CasX protein. In some embodiments, improved thermostability of the CasX variant protein comprises a higher Tm of the CasX variant protein relative to a reference CasX protein. In some embodiments, the Tm of the CasX variant protein is between about 20° C. to about 30° C., between about 30° C. to about 40° C., between about 40° C. to about 50° C., between about 50° C. to about 60° C., between about 60° C. to about 70° C., between about 70° C. to about 80° C., between about 80° C. to about 90° C. or between about 90° C. to about 100° C. Thermal stability is determined by measuring the "melting temperature" (Tm), which is defined as the temperature at which half of the molecules are denatured. Methods of measuring characteristics of protein stability such as Tm and the free energy of unfolding are known to persons of ordinary skill in the art, and can be measured using standard biochemical techniques in vitro. For example, Tm may be measured using Differential Scanning Calorimetry, a thermo-analytical technique in which the difference in the amount of heat required to increase the temperature of a sample and a reference is measured as a function of temperature (Chen et al (2003) Pharm Res 20:1952-60; Ghirlando et al (1999) Immunol Lett 68:47-52). Alternatively, or in addition, CasX variant protein Tm may be measured using commercially available methods such as the ThermoFisher Protein Thermal Shift system. Alternatively, or in addition, circular dichroism may be used to measure the kinetics of folding and unfolding, as well as the Tm (Murray et al. (2002) J. Chromatogr Sci 40:343-9). Circular dichroism (CD) relies on the unequal absorption of left-handed and right-handed circularly polarized light by asymmetric molecules such as proteins. Certain structures of proteins, for example alpha-helices and beta-sheets, have characteristic CD spectra. Accordingly, in some embodiments, CD may be used to determine the secondary structure of a CasX variant protein.

In some embodiments, improved stability and/or thermostability of the CasX variant protein comprises improved folding kinetics of the CasX variant protein relative to a reference CasX protein. In some embodiments, folding kinetics of the CasX variant protein are improved relative to a reference CasX protein by at least about 5, at least about 10, at least about 50, at least about 100, at least about 500, at least about 1,000, at least about 2,000, at least about 3,000, at least about 4,000, at least about 5,000, or at least about a 10,000-fold improvement. In some embodiments, folding kinetics of the CasX variant protein are improved relative to a reference CasX protein by at least about 1 kJ/mol, at least about 5 kJ/mol, at least about 10 kJ/mol, at least about 20 kJ/mol, at least about 30 kJ/mol, at least about 40 kJ/mol, at least about 50 kJ/mol, at least about 60 kJ/mol, at least about 70 kJ/mol, at least about 80 kJ/mol, at least about 90 kJ/mol, at least about 100 kJ/mol, at least about 150 kJ/mol, at least about 200 kJ/mol, at least about 250 kJ/mol, at least about 300 kJ/mol, at least about 350 kJ/mol, at least about 400 kJ/mol, at least about 450 kJ/mol, or at least about 500 kJ/mol.

Exemplary amino acid changes that can increase the stability of a CasX variant protein relative to a reference CasX protein may include, but are not limited to, amino acid changes that increase the number of hydrogen bonds within the CasX variant protein, increase the number of disulfide bridges within the CasX variant protein, increase the number of salt bridges within the CasX variant protein, strengthen interactions between parts of the CasX variant protein, increase the buried hydrophobic surface area of the CasX variant protein, or any combinations thereof.

k. Protein Yield

In some embodiments, the disclosure provides a CasX variant protein having improved yield during expression and purification relative to a reference CasX protein. In some embodiments, the yield of CasX variant proteins purified from bacterial or eukaryotic host cells is improved relative to a reference CasX protein. In some embodiments, the bacterial host cells are *Escherichia coli* cells. In some embodiments, the eukaryotic cells are yeast, plant (e.g. tobacco), insect (e.g. *Spodoptera frugiperda* sf9 cells), mouse, rat, hamster, guinea pig, monkey, or human cells. In some embodiments, the eukaryotic host cells are mammalian cells, including, but not limited to human embryonic kidney 293 (HEK293) cells, baby hamster kidney (BHK) cells, NS0 cells, SP2/0 cells, YO myeloma cells, P3X63 mouse myeloma cells, PER cells, PER.C6 cells, hybridoma cells, NIH3T3 cells, COS, HeLa, or chinese hamster ovary (CHO) cells.

In some embodiments, improved yield of the CasX variant protein is achieved through codon optimization. Cells use 64 different codons, 61 of which encode the 20 standard amino acids, while another 3 function as stop codons. In some cases, a single amino acid is encoded by more than one codon. Different organisms exhibit bias towards use of different codons for the same naturally occurring amino acid. Therefore, the choice of codons in a protein, and matching codon choice to the organism in which the protein will be expressed, can, in some cases, significantly affect protein translation and therefore protein expression levels. In some embodiments, the CasX variant protein is encoded by a nucleic acid that has been codon optimized. In some embodiments, the nucleic acid encoding the CasX variant protein has been codon optimized for expression in a bacterial cell, a yeast cell, an insect cell, a plant cell, or a mammalian cell. In some embodiments, the mammal cell is a mouse, a rat, a hamster, a guinea pig, a monkey, or a human. In some embodiments, the CasX variant protein is encoded by a nucleic acid that has been codon optimized for expression in a human cell. In some embodiments, the CasX variant protein is encoded by a nucleic acid from which nucleotide sequences that reduce translation rates in prokaryotes and eukaryotes have been removed. For example, runs of greater than three thymine residues in a row can reduce translation rates in certain organisms or internal polyadenylation signals can reduce translation.

In some embodiments, improvements in solubility and stability, as described herein, result in improved yield of the CasX variant protein relative to a reference CasX protein.

Improved protein yield during expression and purification can be evaluated by methods known in the art. For example, the amount of CasX variant protein can be determined by running the protein on an SDS-page gel, and comparing the CasX variant protein to a either a control whose amount or concentration is known in advance to determine an absolute level of protein. Alternatively, or in addition, a purified CasX variant protein can be run on an SDS-page gel next to a reference CasX protein undergoing the same purification process to determine relative improvements in CasX variant protein yield. Alternatively, or in addition, levels of protein can be measured using immunohistochemical methods such as Western blot or ELISA with an antibody to CasX, or by HPLC. For proteins in solution, concentration can be determined by measuring of the protein's intrinsic UV absorbance, or by methods which use protein-dependent color changes such as the Lowry assay, the Smith copper/bicinchoninic assay or the Bradford dye assay. Such methods can be used to calculate the total protein (such as, for example, total soluble protein) yield obtained by expression under certain conditions. This can be compared, for example, to the protein yield of a reference CasX protein under similar expression conditions.

l. Protein Solubility

In some embodiments, a CasX variant protein has improved solubility relative to a reference CasX protein. In some embodiments, a CasX variant protein has improved solubility of the CasX:gNA ribonucleoprotein complex variant relative to a ribonucleoprotein complex comprising a reference CasX protein.

In some embodiments, an improvement in protein solubility leads to higher yield of protein from protein purification techniques such as purification from *E. coli*. Improved solubility of CasX variant proteins may, in some embodiments, enable more efficient activity in cells, as a more soluble protein may be less likely to aggregate in cells. Protein aggregates can in certain embodiments be toxic or burdensome on cells, and, without wishing to be bound by any theory, increased solubility of a CasX variant protein may ameliorate this result of protein aggregation. Further, improved solubility of CasX variant proteins may allow for enhanced formulations permitting the delivery of a higher effective dose of functional protein, for example in a desired gene editing application. In some embodiments, improved solubility of a CasX variant protein relative to a reference CasX protein results in improved yield of the CasX variant protein during purification of at least about 5, at least about 10, at least about 20, at least about 30, at least about 40, at least about 50, at least about 60, at least about 70, at least about 80, at least about 90, at least about 100, at least about 250, at least about 500, or at least about 1000-fold greater yield. In some embodiments, improved solubility of a CasX variant protein relative to a reference CasX protein improves activity of the CasX variant protein in cells by at least about 1.1, at least about 1.2, at least about 1.3, at least about 1.4, at least about 1.5, at least about 1.6, at least about 1.7, at least about 1.8, at least about 1.9, at least about 2, at least about 2.1, at least about 2.2, at least about 2.3, at least about 2.4, at least about 2.5, at least about 2.6, at least about 2.7, at least about 2.8, at least about 2.9, at least about 3, at least about 3.5, at least about 4, at least about 4.5, at least about 5, at least about 5.5, at least about 6, at least about 6.5, at least about 7.0, at least about 7.5, at least about 8, at least about 8.5, at least about 9, at least about 9.5, at least about 10, at least about 11, at least about 12, at least about 13, at least about 14, or at least about 15-fold greater activity.

Methods of measuring CasX protein solubility, and improvements thereof in CasX variant proteins, will be readily apparent to the person of ordinary skill in the art. For example, CasX variant protein solubility can in some embodiments be measured by taking densitometry readings on a gel of the soluble fraction of lysed *E. coli*. Alternatively, or addition, improvements in CasX variant protein solubility can be measured by measuring the maintenance of soluble protein product through the course of a full protein purification. For example, soluble protein product can be measured at one or more steps of gel affinity purification, tag cleavage, cation exchange purification, running the protein on a sizing column. In some embodiments, the densitometry of every band of protein on a gel is read after each step in the purification process. CasX variant proteins with improved solubility may, in some embodiments, maintain a higher concentration at one or more steps in the protein purification process when compared to the reference CasX protein, while an insoluble protein variant may be lost at one or more steps due to buffer exchanges, filtration steps, interactions with a purification column, and the like.

In some embodiments, improving the solubility of CasX variant proteins results in a higher yield in terms of mg/L of protein during protein purification when compared to a reference CasX protein.

In some embodiments, improving the solubility of CasX variant proteins enables a greater amount of editing events compared to a less soluble protein when assessed in editing assays such as the EGFP disruption assays described herein.

m. Protein Affinity for the gNA

In some embodiments, a CasX variant protein has improved affinity for the gNA relative to a reference CasX protein, leading to the formation of the ribonucleoprotein complex. Increased affinity of the CasX variant protein for the gNA may, for example, result in a lower $K_d$ for the generation of a RNP complex, which can, in some cases, result in a more stable ribonucleoprotein complex formation. In some embodiments, increased affinity of the CasX variant protein for the gNA results in increased stability of the ribonucleoprotein complex when delivered to human cells. This increased stability can affect the function and utility of the complex in the cells of a subject, as well as result in improved pharmacokinetic properties in blood, when delivered to a subject. In some embodiments, increased affinity of the CasX variant protein, and the resulting increased stability of the ribonucleoprotein complex, allows for a lower dose of the CasX variant protein to be delivered to the subject or cells while still having the desired activity, for example in vivo or in vitro gene editing.

In some embodiments, a higher affinity (tighter binding) of a CasX variant protein to a gNA allows for a greater amount of editing events when both the CasX variant protein and the gNA remain in an RNP complex. Increased editing events can be assessed using editing assays such as the EGFP disruption assay described herein.

In some embodiments, the $K_d$ of a CasX variant protein for a gNA is increased relative to a reference CasX protein by a factor of at least about 1.1, at least about 1.2, at least about 1.3, at least about 1.4, at least about 1.5, at least about 1.6, at least about 1.7, at least about 1.8, at least about 1.9, at least about 2, at least about 3, at least about 4, at least about 5, at least about 6, at least about 7, at least about 8, at least about 9, at least about 10, at least about 15, at least about 20, at least about 25, at least about 30, at least about 35, at least about 40, at least about 45, at least about 50, at least about 60, at least about 70, at least about 80, at least about 90, or at least about 100. In some embodiments, the CasX variant has about 1.1 to about 10-fold increased binding affinity to the gNA compared to the reference CasX protein of SEQ ID NO:2.

Without wishing to be bound by theory, in some embodiments amino acid changes in the Helical I domain can increase the binding affinity of the CasX variant protein with the gNA targeting sequence, while changes in the Helical II domain can increase the binding affinity of the CasX variant protein with the gNA scaffold stem loop, and changes in the oligonucleotide binding domain (OBD) increase the binding affinity of the CasX variant protein with the gRNA triplex.

Methods of measuring CasX protein binding affinity for a gNA include in vitro methods using purified CasX protein and gNA. The binding affinity for reference CasX and variant proteins can be measured by fluorescence polarization if the gNA or CasX protein is tagged with a fluorophore. Alternatively, or in addition, binding affinity can be measured by biolayer interferometry, electrophoretic mobility shift assays (EMSAs), or filter binding. Additional standard techniques to quantify absolute affinities of RNA binding proteins such as the reference CasX and variant proteins of the disclosure for specific gNAs such as reference gNAs and variants thereof include, but are not limited to, isothermal calorimetry (ITC), and surface plasmon resonance (SPR), as well as the methods of the Examples.

n. Affinity for Target DNA

In some embodiments, a CasX variant protein has improved binding affinity for a target nucleic acid relative to the affinity of a reference CasX protein for a target nucleic acid. In some embodiments, the improved affinity for the target nucleic acid comprises improved affinity for the target nucleic acid sequence, improved affinity for the PAM sequence, an improved ability to search DNA for the target nucleic acid sequence, or any combinations thereof. Without wishing to be bound by theory, it is thought that CRISPR/Cas system proteins such as CasX may find their target nucleic acid sequences by one-dimension diffusion along a DNA molecule. The process is thought to include (1) binding of the ribonucleoprotein to the DNA molecule followed by (2) stalling at the target nucleic acid sequence, either of which may be, in some embodiments, affected by improved affinity of CasX proteins for a target nucleic acid sequence, thereby improving function of the CasX variant protein compared to a reference CasX protein.

In some embodiments, a CasX variant protein with improved target nucleic acid affinity has increased overall affinity for DNA. In some embodiments, a CasX variant protein with improved target nucleic acid affinity has increased affinity for specific PAM sequences other than the canonical TTC PAM recognized by the reference CasX protein of SEQ ID NO:2, including binding affinity for PAM sequences selected from the group consisting of TTC, ATC, GTC, and CTC. Without wishing to be bound by theory, it is possible that these protein variants will interact more strongly with DNA overall and will have an increased ability to access and edit sequences within the target DNA due to the ability to bind additional PAM sequences beyond those of wild-type Cas X, thereby allowing for a more efficient search process of the CasX protein for the target sequence. A higher overall affinity for DNA also, in some embodiments, can increase the frequency at which a CasX protein can effectively start and finish a binding and unwinding step, thereby facilitating target strand invasion and R-loop formation, and ultimately the cleavage of a target nucleic acid sequence.

Without wishing to be bound by theory, it is possible that amino acid changes in the NTSBD that increase the efficiency of unwinding, or capture, of a non-target DNA strand in the unwound state, can increase the affinity of CasX variant proteins for target DNA. Alternatively, or in addition, amino acid changes in the NTSBD that increase the ability of the NTSBD to stabilize DNA during unwinding can increase the affinity of CasX variant proteins for target DNA. Alternatively, or in addition, amino acid changes in the OBD may increase the affinity of CasX variant protein binding to the protospacer adjacent motif (PAM), thereby increasing affinity of the CasX variant protein for target nucleic acid. Alternatively, or in addition, amino acid changes in the Helical I and/or II, RuvC and TSL domains that increase the affinity of the CasX variant protein for the target nucleic acid strand can increase the affinity of the CasX variant protein for target nucleic acid.

In some embodiments, the CasX variant protein has increased binding affinity to the target nucleic acid sequence compared to the reference protein of SEQ ID NO:1, SEQ ID NO:2, or SEQ ID NO:3. In some embodiments, affinity of a CasX variant protein of the disclosure for a target nucleic acid molecule is increased relative to a reference CasX protein by a factor of at least about 1.1, at least about 1.2, at least about 1.3, at least about 1.4, at least about 1.5, at least about 1.6, at least about 1.7, at least about 1.8, at least about 1.9, at least about 2, at least about 3, at least about 4, at least about 5, at least about 6, at least about 7, at least about 8, at least about 9, at least about 10, at least about 15, at least about 20, at least about 25, at least about 30, at least about 35, at least about 40, at least about 45, at least about 50, at least about 60, at least about 70, at least about 80, at least about 90, or at least about 100.

In some embodiments, a CasX variant protein has improved binding affinity for the non-target strand of the target nucleic acid. As used herein, the term "non-target strand" refers to the strand of the DNA target nucleic acid sequence that does not form Watson and Crick base pairs with the targeting sequence in the gNA, and is complementary to the target strand.

Methods of measuring CasX protein (such as reference or variant) affinity for a target nucleic acid molecule may include electrophoretic mobility shift assays (EMSAs), filter binding, isothermal calorimetry (ITC), and surface plasmon resonance (SPR), fluorescence polarization and biolayer interferometry (BLI). Further methods of measuring CasX protein affinity for a target include in vitro biochemical assays that measure DNA cleavage events over time.

CasX variant proteins with higher affinity for their target nucleic acid may, in some embodiments, cleave the target nucleic acid sequence more rapidly than a reference CasX protein that does not have increased affinity for the target nucleic acid.

In some embodiments, the CasX variant protein is catalytically dead (dCasX). In some embodiments, the disclosure provides RNP comprising a catalytically-dead CasX protein that retains the ability to bind target DNA. An exemplary catalytically-dead CasX variant protein comprises one or more mutations in the active site of the RuvC domain of the CasX protein. In some embodiments, a catalytically-dead CasX variant protein comprises substitutions at residues 672, 769 and/or 935 of SEQ ID NO:1. In some embodiments, a catalytically-dead CasX variant protein comprises substitutions of D672A, E769A and/or D935A in the reference CasX protein of SEQ ID NO:1. In some embodiments, a catalytically-dead CasX protein comprises substitutions at amino acids 659, 765 and/or 922 of SEQ ID NO:2. In some embodiments, a catalytically-dead CasX protein comprises D659A, E756A and/or D922A substitutions in a reference CasX protein of SEQ ID NO:2. In further embodiments, a catalytically-dead CasX variant protein comprises deletions of all or part of the RuvC domain of the reference CasX protein.

In some embodiments, improved affinity for DNA of a CasX variant protein also improves the function of catalytically inactive versions of the CasX variant protein. In some embodiments, the catalytically inactive version of the CasX variant protein comprises one or mutations in the DED motif in the RuvC. Catalytically dead CasX variant proteins can, in some embodiments, be used for base editing or epigenetic modifications. With a higher affinity for DNA, in some embodiments, catalytically dead CasX variant proteins can, relative to catalytically active CasX, find their target DNA faster, remain bound to target DNA for longer periods of time, bind target DNA in a more stable fashion, or a combination thereof, thereby improving the function of the catalytically dead CasX variant protein.

o. Improved Specificity for a Target Site

In some embodiments, a CasX variant protein has improved specificity for a target DNA sequence relative to a reference CasX protein. As used herein, "specificity," sometimes referred to as "target specificity," refers to the degree to which a CRISPR/Cas system ribonucleoprotein complex cleaves off-target sequences that are similar, but not identical to the target DNA sequence; e.g., a CasX variant RNP with a higher degree of specificity would exhibit reduced off-target cleavage of sequences relative to a reference CasX protein. The specificity, and the reduction of potentially deleterious off-target effects, of CRISPR/Cas system proteins can be vitally important in order to achieve an acceptable therapeutic index for use in mammalian subjects.

In some embodiments, a CasX variant protein has improved specificity for a target site within the target sequence that is complementary to the targeting sequence of the gNA.

Without wishing to be bound by theory, it is possible that amino acid changes in the Helical I and II domains that increase the specificity of the CasX variant protein for the target DNA strand can increase the specificity of the CasX variant protein for the target DNA overall. In some embodiments, amino acid changes that increase specificity of CasX variant proteins for target DNA may also result in decreased affinity of CasX variant proteins for DNA.

Methods of testing CasX protein (such as variant or reference) target specificity may include guide and Circularization for In vitro Reporting of Cleavage Effects by Sequencing (CIRCLE-seq), or similar methods. In brief, in CIRCLE-seq techniques, genomic DNA is sheared and circularized by ligation of stem-loop adapters, which are nicked in the stem-loop regions to expose 4 nucleotide palindromic overhangs. This is followed by intramolecular ligation and degradation of remaining linear DNA. Circular DNA molecules containing a CasX cleavage site are subsequently linearized with CasX, and adapter adapters are ligated to the exposed ends followed by high-throughput sequencing to generate paired end reads that contain information about the off-target site. Additional assays that can be used to detect off-target events, and therefore CasX protein specificity include assays used to detect and quantify indels (insertions and deletions) formed at those selected off-target sites such as mismatch-detection nuclease assays and next generation sequencing (NGS). Exemplary mismatch-detection assays include nuclease assays, in which genomic DNA from cells treated with CasX and sgNA is PCR amplified, denatured and rehybridized to form hetero-duplex DNA, containing one wild type strand and one strand with an indel. Mismatches are recognized and cleaved by mismatch detection nucleases, such as Surveyor nuclease or T7 endonuclease I.

p. Unwinding of DNA

In some embodiments, a CasX variant protein has improved ability of unwinding DNA relative to a reference CasX protein. In some embodiments, a CasX variant protein has enhanced DNA unwinding characteristics. Poor dsDNA unwinding has been shown previously to impair or prevent the ability of CRISPR/Cas system proteins anaCas9 or Cas14s to cleave DNA. Therefore, without wishing to be bound by any theory, it is likely that increased DNA cleavage activity by some CasX variant proteins is due at least in part to an increased ability to find and unwind the dsDNA at a target site.

Without wishing to be bound by theory, it is thought that amino acid changes in the NTSB domain may produce CasX variant proteins with increased DNA unwinding characteristics. Alternatively, or in addition, amino acid changes in the OBD or the helical domain regions that interact with the PAM may also produce CasX variant proteins with increased DNA unwinding characteristics.

Methods of measuring the ability of CasX proteins (such as variant or reference) to unwind DNA include, but are not limited to, in vitro assays that observe increased on rates of dsDNA targets in fluorescence polarization or biolayer interferometry.

q. Catalytic Activity

The ribonucleoprotein complex of the CasX:gNA systems disclosed herein comprise a reference CasX protein or variant thereof that bind to a target nucleic acid sequence and cleaves the target nucleic acid sequence. In some embodiments, a CasX variant protein has improved catalytic activity relative to a reference CasX protein. Without wishing to be bound by theory, it is thought that in some cases cleavage of the target strand can be a limiting factor for Cas12-like molecules in creating a dsDNA break. In some embodiments, CasX variant proteins improve bending of the target strand of DNA and cleavage of this strand, resulting in an improvement in the overall efficiency of dsDNA cleavage by the CasX ribonucleoprotein complex.

In some embodiments, a CasX variant protein has increased nuclease activity compared to a reference CasX protein. Variants with increased nuclease activity can be generated, for example, through amino acid changes in the RuvC nuclease domain. In one embodiment, the CasX variant comprises a nuclease domain having nickase activity. In the foregoing embodiment, the CasX nickase of a CasX:gNA system generates a single-stranded break within 10-18 nucleotides 3' of a PAM site in the non-target strand. In another embodiment, the CasX variant comprises a nuclease domain having double-stranded cleavage activity. In the foregoing embodiment, the CasX of the CasX:gNA system generates a double-stranded break within 18-26 nucleotides 5' of a PAM site on the target strand and 10-18 nucleotides 3' on the non-target strand. Nuclease activity can be assayed by a variety of methods, including those of the Examples. In one embodiment, a CasX variant has a Kcleave constant that is at least 2-fold, or at least 3-fold, or at least 4-fold, or at least 5-fold, or at least 6-fold, or at least 7-fold, or at least 8-fold, or at least 9-fold, or at least 10-fold greater compared to a reference wild-type CasX.

In some embodiments, a CasX variant protein has increased target strand loading for double strand cleavage.

Variants with increased target strand loading activity can be generated, for example, through amino acid changes in the TLS domain.

Without wishing to be bound by theory, amino acid changes in the TSL domain may result in CasX variant proteins with improved catalytic activity. Alternatively, or in addition, amino acid changes around the binding channel for the RNA:DNA duplex may also improve catalytic activity of the CasX variant protein.

In some embodiments, a CasX variant protein has increased collateral cleavage activity compared to a reference CasX protein. As used herein, "collateral cleavage activity" refers to additional, non-targeted cleavage of nucleic acids following recognition and cleavage of a target nucleic acid sequence. In some embodiments, a CasX variant protein has decreased collateral cleavage activity compared to a reference CasX protein.

In some embodiments, for example those embodiments encompassing applications where target DNA cleavage is not a desired outcome, improving the catalytic activity of a CasX variant protein comprises altering, reducing, or abolishing the catalytic activity of the CasX variant protein. In some embodiments, a ribonucleoprotein complex comprising a CasX variant protein binds to a target DNA and does not cleave the target DNA.

In some embodiments, the CasX ribonucleoprotein complex comprising a CasX variant protein binds a target DNA but generates a single stranded nick in the target DNA. In some embodiments, particularly those embodiments wherein the CasX protein is a nickase, a CasX variant protein has decreased target strand loading for single strand nicking. Variants with decreased target strand loading may be generated, for example, through amino acid changes in the TSL domain.

Exemplary methods for characterizing the catalytic activity of CasX proteins may include, but are not limited to, in vitro cleavage assays. In some embodiments, electrophoresis of DNA products on agarose gels can interrogate the kinetics of strand cleavage.

r. Affinity for Target DNA and RNA

In some embodiments, a ribonucleoprotein complex comprising a reference CasX protein or variant thereof binds to a target DNA and cleaves the target DNA. In some embodiments, variants of a reference CasX protein increase the specificity of the CasX variant protein for a target RNA, and increase the activity of the CasX variant protein with respect to a target RNA when compared to the reference CasX protein. For example, CasX variant proteins can display increased binding affinity for target RNAs, or increased cleavage of target RNAs, when compared to reference CasX proteins. In some embodiments, a ribonucleoprotein complex comprising a CasX variant protein binds to a target RNA and/or cleaves the target RNA. In one embodiment, a CasX variant has at least about two-fold to about 10-fold increased binding affinity to the target nucleic acid sequence compared to the reference protein of SEQ ID NO:1, SEQ ID NO:2, or SEQ ID NO:3.

s. Combinations of Mutations

In some embodiments, the present disclosure provides variants that are a combination of mutations from separate CasX variant proteins. In some embodiments, any variant to any domain described herein can be combined with other variants described herein. In some embodiments, any variant within any domain described herein can be combined with other variants described herein, in the same domain. Combinations of different amino acid changes may in some embodiments produce new optimized variants whose function is further improved by the combination of amino acid changes. In some embodiments, the effect of combining amino acid changes on CasX protein function is linear. As used herein, a combination that is linear refers to a combination whose effect on function is equal to the sum of the effects of each individual amino acid change when assayed in isolation. In some embodiments, the effect of combining amino acid changes on CasX protein function is synergistic. As used herein, a combination of variants that is synergistic refers to a combination whose effect on function is greater than the sum of the effects of each individual amino acid change when assayed in isolation. In some embodiments, combining amino acid changes produces CasX variant proteins in which more than one function of the CasX protein has been improved relative to the reference CasX protein.

t. CasX Fusion Proteins

In some embodiments, the disclosure provides CasX proteins comprising a heterologous protein fused to the CasX. In some cases, the CasX is a reference CasX protein. In other cases, the CasX is a CasX variant of any of the embodiments described herein.

In some embodiments, the CasX variant protein is fused to one or more proteins or domains thereof that has a different activity of interest (i.e., is part of a fusion protein). For example, in some embodiments, the CasX variant protein is fused to a protein (or domain thereof) that inhibits transcription, modifies a target nucleic acid sequence, or modifies a polypeptide associated with a nucleic acid (e.g., histone modification).

In some embodiments, a heterologous polypeptide (or heterologous amino acid such as a cysteine residue or a non-natural amino acid) can be inserted at one or more positions within a CasX protein to generate a CasX fusion protein. In other embodiments, a cysteine residue can be inserted at one or more positions within a CasX protein followed by conjugation of a heterologous polypeptide described below. In some alternative embodiments, a heterologous polypeptide or heterologous amino acid can be added at the N- or C-terminus of the reference or CasX variant protein. In other embodiments, a heterologous polypeptide or heterologous amino acid can be inserted internally within the sequence of the CasX protein.

In some embodiments, the reference CasX or variant fusion protein retains RNA-guided sequence specific target nucleic acid binding and cleavage activity. In some cases, the reference CasX or variant fusion protein has (retains) 50% or more of the activity (e.g., cleavage and/or binding activity) of the corresponding reference CasX or variant protein that does not have the insertion of the heterologous protein. In some cases, the reference CasX or variant fusion protein retains at least about 60%, or at least about 70% or more, at least about 80%, or at least about 90%, or at least about 92%, or at least about 95%, or at least about 98%, or at least about 100% of the activity (e.g., cleavage and/or binding activity) of the corresponding CasX protein that does not have the insertion of the heterologous protein.

In some cases, the reference CasX or variant fusion polypeptide retains (has) target nucleic acid binding activity relative to the activity of the CasX protein without the inserted heterologous amino acid or heterologous polypeptide. For example, in some cases, the reference CasX or variant fusion polypeptide has (retains) 50% or more of the binding activity of the corresponding CasX protein (the CasX protein that does not have the insertion). For example, in some cases, the reference CasX or variant fusion polypeptide has (retains) 60% or more (70% or more, 80% or more, 90% or more, 92% or more, 95% or more, 98% or more, or 100%) of the binding activity of the corresponding parent CasX protein (the CasX protein that does not have the insertion).

In some cases, the reference CasX or variant fusion polypeptide retains (has) target nucleic acid binding and/or cleavage activity relative to the activity of the parent CasX protein without the inserted heterologous amino acid or heterologous polypeptide. For example, in some cases, the reference CasX or variant fusion polypeptide has (retains) 50% or more of the binding and/or cleavage activity of the corresponding parent CasX protein (the CasX protein that does not have the insertion). For example, in some cases, the reference CasX or variant fusion polypeptide has (retains) 60% or more (70% or more, 80% or more, 90% or more, 92% or more, 95% or more, 98% or more, or 100%) of the binding and/or cleavage activity of the corresponding CasX parent polypeptide (the CasX protein that does not have the insertion). Methods of measuring cleaving and/or binding activity of a CasX protein and/or a CasX fusion polypeptide will be known to one of ordinary skill in the art and any convenient method can be used.

A variety of heterologous polypeptides are suitable for inclusion in a reference CasX or CasX variant fusion protein of the disclosure. In some cases, the fusion partner can modulate transcription (e.g., inhibit transcription, increase transcription) of a target DNA. For example, in some cases the fusion partner is a protein (or a domain from a protein) that inhibits transcription (e.g., a transcriptional repressor, a protein that functions via recruitment of transcription inhibitor proteins, modification of target DNA such as methylation, recruitment of a DNA modifier, modulation of histones associated with target DNA, recruitment of a histone modifier such as those that modify acetylation and/or methylation of histones, and the like). In some cases the fusion partner is a protein (or a domain from a protein) that increases transcription (e.g., a transcription activator, a protein that acts via recruitment of transcription activator proteins, modification of target DNA such as demethylation, recruitment of a DNA modifier, modulation of histones associated with target DNA, recruitment of a histone modifier such as those that modify acetylation and/or methylation of histones, and the like).

In some cases, a fusion partner has enzymatic activity that modifies a target nucleic acid sequence (e.g., nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity).

In some cases, a fusion partner has enzymatic activity that modifies a polypeptide (e.g., a histone) associated with a target nucleic acid (e.g., methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity).

Examples of proteins (or fragments thereof) that can be used as a fusion partner to increase transcription include but are not limited to: transcriptional activators such as VP16, VP64, VP48, VP160, p65 subdomain (e.g., from NFkB), and activation domain of EDLL and/or TAL activation domain (e.g., for activity in plants); histone lysine methyltransferases such as SET domain containing 1A, histone lysine methyltransferase (SET1A), SET domain containing 1B, histone lysine methyltransferase (SET1B), lysine methyltransferase 2A (MLL1 to 5, ASCL1 (ASH1) achaete-scute family bHLH transcription factor 1 (ASH1), SET and MYND domain containing 2 (SYMD2), nuclear receptor binding SET domain protein 1 (NSD1), and the like; histone lysine demethylases such as lysine demethylase 3A (JHDM2a)/Lysine-specific demethylase 3B (JHDM2b), lysine demethylase 6A (UTX), lysine demethylase 6B (JMJD3), and the like; histone acetyltransferases such as lysine acetyltransferase 2A (GCN5), lysine acetyltransferase 2B (PCAF), CREB binding protein (CBP), E1A binding protein p300 (p300), TATA-box binding protein associated factor 1 (TAF1), lysine acetyltransferase 5 (TIP60/PLIP), lysine acetyltransferase 6A (MOZ/MYST3), lysine acetyltransferase 6B (MORF/MYST4), SRC proto-oncogene, non-receptor tyrosine kinase (SRC1), nuclear receptor coactivator 3 (ACTR), MYB binding protein 1a (P160), clock circadian regulator (CLOCK), and the like; and DNA demethylases such as Ten-Eleven Translocation (TET) dioxygenase 1 (TET1CD), tet methylcytosine dioxygenase 1 (TET1), demeter (DME), demeter-like 1 (DML1), demeter-like 2 (DML2), protein ROS1 (ROS1), and the like.

Examples of proteins (or fragments thereof) that can be used as a fusion partner to decrease transcription include but are not limited to: transcriptional repressors such as the Kruppel associated box (KRAB or SKD); KOX1 repression domain; the Mad mSIN3 interaction domain (SID); the ERF repressor domain (ERD), the SRDX repression domain (e.g., for repression in plants), and the like; histone lysine methyltransferases such as PR/SET domain containing protein (Pr-SET7/8), lysine methyltransferase 5B (SUV4-20H1), PR/SET domain 2 (RIZ1), and the like; histone lysine demethylases such as lysine demethylase 4A (JMJD2A/JHDM3A), lysine demethylase 4B (JMJD2B), lysine demethylase 4C (JMJD2C/GASC1), lysine demethylase 4D (JMJD2D), lysine demethylase 5A (JARID1A/RBP2), lysine demethylase 5B (JARID1B/PLU-1), lysine demethylase 5C (JARID 1C/SMCX), lysine demethylase 5D (JARID1D/SMCY), and the like; histone lysine deacetylases such as histone deacetylase 1 (HDAC1), HDAC2, HDAC3, HDAC8, HDAC4, HDAC5, HDAC7, HDAC9, sirtuin 1 (SIRT1), SIRT2, HDAC11, and the like; DNA methylases such as HhaI DNA m5c-methyltransferase (M.HhaI), DNA methyltransferase 1 (DNMT1), DNA methyltransferase 3a (DNMT3a), DNA methyltransferase 3b (DNMT3b), methyltransferase 1 (MET1), S-adenosyl-L-methionine-dependent methyltransferases superfamily protein (DRM3) (plants), DNA cytosine methyltransferase MET2a (ZMET2), chromomethylase 1 (CMT1), chromomethylase 2 (CMT2) (plants), and the like; and periphery recruitment elements such as Lamin A, Lamin B, and the like.

In some cases the fusion partner has enzymatic activity that modifies the target nucleic acid sequence (e.g., ssRNA, dsRNA, ssDNA, dsDNA). Examples of enzymatic activity that can be provided by the fusion partner include but are not limited to: nuclease activity such as that provided by a restriction enzyme (e.g., FokI nuclease), methyltransferase activity such as that provided by a methyltransferase (e.g., Hhal DNA m5c-methyltransferase (M.Hhal), DNA methyltransferase 1 (DNMT1), DNA methyltransferase 3a (DNMT3a), DNA methyltransferase 3b (DNMT3b), METI, DRM3 (plants), ZMET2, CMT1, CMT2 (plants), and the like); demethylase activity such as that provided by a demethylase (e.g., Ten-Eleven Translocation (TET) dioxygenase 1 (TET 1 CD), TET1, DME, DML1, DML2, ROS1, and the like), DNA repair activity, DNA damage activity, deamination activity such as that provided by a deaminase (e.g., a cytosine deaminase enzyme, e.g., an APOBEC protein such as rat APOBECl), dismutase activity, alkylation activity, depurination activity, oxidation activity, pyrimidine dimer forming activity, integrase activity such as that provided by an integrase and/or resolvase (e.g., Gin invertase such as the hyperactive mutant of the Gin invertase, GinH106Y; human immunodeficiency virus type 1 integrase (IN); Tn3 resolvase; and the like), transposase activity, recombinase activity such as that provided by a recombinase (e.g., catalytic domain of Gin recombinase), polymerase activity, ligase activity, helicase activity, photolyase activity, and glycosylase activity).

In some cases, a reference CasX or Cas X variant protein of the present disclosure is fused to a polypeptide selected from: a domain for increasing transcription (e.g., a VP16 domain, a VP64 domain), a domain for decreasing transcription (e.g., a KRAB domain, e.g., from the Kox1 protein), a core catalytic domain of a histone acetyltransferase (e.g., histone acetyltransferase p300), a protein/domain that provides a detectable signal (e.g., a fluorescent protein such as GFP), a nuclease domain (e.g., a FokI nuclease), and a base editor (e.g., cytidine deaminase such as APOBEC1).

In some cases, the fusion partner has enzymatic activity that modifies a protein associated with the target nucleic acid sequence (e.g., ssRNA, dsRNA, ssDNA, dsDNA) (e.g., a histone, an RNA binding protein, a DNA binding protein, and the like). Examples of enzymatic activity (that modifies a protein associated with a target nucleic acid) that can be provided by the fusion partner include but are not limited to: methyltransferase activity such as that provided by a histone methyltransferase (HMT) (e.g., suppressor of variegation 3-9 homolog 1 (SUV39H1, also known as KMT1A), euchromatic histone lysine methyltransferase 2 (G9A, also known as KMT1C and EHMT2), SUV39H2, ESET/SETDB 1, and the like, SET1A, SET1B, MLL1 to 5, ASH1, SYMD2, NSD1, DOT1L, Pr-SET7/8, SUV4-20H1, EZH2, RIZ1), demethylase activity such as that provided by a histone demethylase (e.g., Lysine Demethylase 1A (KDM1A also known as LSD1), JHDM2a/b, JMJD2A/JHDM3A, JMJD2B, JMJD2C/GASC1, JMJD2D, JARID1A/RBP2, JARID1B/PLU-1, JARID1C/SMCX, JARID1D/SMCY, UTX, JMJD3, and the like), acetyltransferase activity such as that provided by a histone acetylase transferase (e.g., catalytic core/fragment of the human acetyltransferase p300, GCN5, PCAF, CBP, TAF1, TIP60/PLIP, MOZ/MYST3, MORF/MYST4, HB01/MYST2, HMOF/MYST1, SRC1, ACTR, P160, CLOCK, and the like), deacetylase activity such as that provided by a histone deacetylase (e.g., HDAC1, HDAC2, HDAC3, HDAC8, HDAC4, HDACS, HDAC7, HDAC9, SIRT1, SIRT2, HDAC11, and the like), kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity, and demyristoylation activity.

Additional examples of suitable fusion partners are (i) a dihydrofolate reductase (DHFR) destabilization domain to generate a chemically controllable subject RNA-guided polypeptide or a conditionally active RNA-guided polypeptide, and (ii) a chloroplast transit peptide.

Suitable chloroplast transit peptides include, but are not limited to:

(SEQ ID NO: 144)
MASMISSSAVTTVSRASRGQSAAMAPFGGLKSMTGFPVRKVNTDITSITS
NGGRVKCMQVWPPIGKKKFETLSYLPPLTRDSRA;

(SEQ ID NO: 145)
MASMISSSAVTTVSRASRGQSAAMAPFGGLKSMTGFPVRKVNTDITSITS
NGGRVKS;

(SEQ ID NO: 146)
MASSMLSSATMVASPAQATMVAPFNGLKSSAAFPATRKANNDITSITSNG
GRVNCMQV WPPIEKKKFETLSYLPDLTDSGGRVNC;

(SEQ ID NO: 147)
MAQVSRICNGVQNPSLISNLSKSSQRKSPLSVSLKTQQHPRAYPISSSWG
LKKSGMTLIG SELRPLKVMSSVSTAC;

(SEQ ID NO: 148)
MAQVSRICNGVWNPSLISNLSKSSQRKSPLSVSLKTQQHPRAYPISSSWG
LKKSGMTLIG SELRPLKVMSSVSTAC;

(SEQ ID NO: 149)
MAQINNMAQGIQTLNPNSNFHKPQVPKSSSFLVFGSKKLKNSANSMLVLK
KDSIFMQLF CSFRISASVATAC;

(SEQ ID NO: 150)
MAALVTSQLATSGTVLSVTDRFRRPGFQGLRPRNPADAALGMRTVGASAA
PKQSRKPH RFDRRCLSMVV;

(SEQ ID NO: 151)
MAALTTSQLATSATGFGIADRSAPSSLLRHGFQGLKPRSPAGGDATSLSV
TTSARATPKQ QRSVQRGSRRFPSVVVC;

(SEQ ID NO: 152)
MASSVLSSAAVATRSNVAQANMVAPFTGLKSAASFPVSRKQNLDITSIAS
NGGRVQC;

(SEQ ID NO: 153)
MESLAATSVFAPSRVAVPAARALVRAGTVVPTRRTSSTSGTSGVKCSAAV
TPQASPVISRSAAAA;
and (SEQ ID NO: 154)
MGAAATSMQSLKFSNRLVPPSRRLSPVPNNVTCNNLPKSAAPVRTVKCCA
SSWNSTINGAAATTNGASAASS.

In some cases, a reference CasX or variant polypeptide of the present disclosure can include an endosomal escape peptide. In some cases, an endosomal escape polypeptide comprises the amino acid sequence GLFX-ALLXLLXSLWXLLLXA (SEQ ID NO: 155), wherein each X is independently selected from lysine, histidine, and arginine. In some cases, an endosomal escape polypeptide comprises the amino acid sequence GLF-HALLHLLHSLWHLLLHA (SEQ ID NO: 156), or HIHHHHHHHHII (SEQ ID NO: 157).

Non-limiting examples of fusion partners for use when targeting ssRNA target nucleic acid sequences include (but are not limited to): splicing factors (e.g., RS domains); protein translation components (e.g., translation initiation, elongation, and/or release factors; e.g., eIF4G); RNA methylases; RNA editing enzymes (e.g., RNA deaminases, e.g., adenosine deaminase acting on RNA (ADAR), including A to I and/or C to U editing enzymes); helicases; RNA-binding proteins; and the like. It is understood that a heterologous polypeptide can include the entire protein or in some cases can include a fragment of the protein (e.g., a functional domain).

A fusion partner can be any domain capable of interacting with ssRNA (which, for the purposes of this disclosure, includes intramolecular and/or intermolecular secondary structures, e.g., double-stranded RNA duplexes such as hairpins, stem-loops, etc.), whether transiently or irreversibly, directly or indirectly, including but not limited to an effector domain selected from the group comprising; Endonucleases (for example RNase III, the CRR22 DYW domain, Dicer, and PIN (PilT N-terminus) domains from proteins such as SMG5 and SMG6); proteins and protein domains responsible for stimulating RNA cleavage (for example CPSF, CstF, CFIm and CFIIm); Exonucleases (for example XRN-1 or Exonuclease T); Deadenylases (for example HNT3); proteins and protein domains responsible for nonsense mediated RNA decay (for example UPF1, UPF2, UPF3, UPF3b, RNP SI, Y14, DEK, REF2, and SRm160); proteins and protein domains responsible for stabilizing RNA (for example PABP); proteins and protein domains responsible for repressing translation (for example Ago2 and Ago4); proteins and protein domains responsible for stimulating translation (for example Staufen); proteins and protein domains responsible for (e.g., capable of) modulating translation (e.g., translation factors such as initiation factors, elongation factors, release factors, etc., e.g., eIF4G); proteins and protein domains responsible for polyadenylation of RNA (for example PAP1, GLD-2, and Star-PAP); proteins and protein domains responsible for polyuridinylation of RNA (for example CI Dl and terminal uridylate transferase); proteins and protein domains responsible for RNA localization (for example from EVIP1, ZBP1, She2p, She3p, and Bicaudal-D); proteins and protein domains responsible for nuclear retention of RNA (for example Rrp6); proteins and protein domains responsible for nuclear export of RNA (for example TAP, NXF1, THO, TREX, REF, and Aly); proteins and protein domains responsible for repression of RNA splicing (for example PTB, Sam68, and hnRNP A1); proteins and protein domains responsible for stimulation of RNA splicing (for example Serine/Arginine-rich (SR) domains); proteins and protein domains responsible for reducing the efficiency of transcription (for example FUS (TLS)); and proteins and protein domains responsible for stimulating transcription (for example CDK7 and HIV Tat). Alternatively, the effector domain may be selected from the group comprising Endonucleases; proteins and protein domains capable of stimulating RNA cleavage; Exonucleases; Deadenylases; proteins and protein domains having nonsense mediated RNA decay activity; proteins and protein domains capable of stabilizing RNA; proteins and protein domains capable of repressing translation; proteins and protein domains capable of stimulating translation; proteins and protein domains capable of modulating translation (e.g., translation factors such as initiation factors, elongation factors, release factors, etc., e.g., eIF4G); proteins and protein domains capable of polyadenylation of RNA; proteins and protein domains capable of polyuridinylation of RNA; proteins and protein domains having RNA localization activity; proteins and protein domains capable of nuclear retention of RNA; proteins and protein domains having RNA nuclear export activity; proteins and protein domains capable of repression of RNA splicing; proteins and protein domains capable of stimulation of RNA splicing; proteins and protein domains capable of reducing the efficiency of transcription; and proteins and protein domains capable of stimulating transcription. Another suitable heterologous polypeptide is a PUF RNA-binding domain, which is described in more detail in WO2012068627, which is hereby incorporated by reference in its entirety.

Some RNA splicing factors that can be used (in whole or as fragments thereof) as a fusion partner have modular organization, with separate sequence-specific RNA binding modules and splicing effector domains. For example, members of the Serine/Arginine-rich (SR) protein family contain N-terminal RNA recognition motifs (RRMs) that bind to exonic splicing enhancers (ESEs) in pre-mRNAs and C-terminal RS domains that promote exon inclusion. As another example, the hnRNP protein hnRNP Al binds to exonic splicing silencers (ESSs) through its RRM domains and inhibits exon inclusion through a C-terminal Glycine-rich domain. Some splicing factors can regulate alternative use of splice site (ss) by binding to regulatory sequences between the two alternative sites. For example, ASF/SF2 can recognize ESEs and promote the use of intron proximal sites, whereas hnRNP Al can bind to ESSs and shift splicing towards the use of intron distal sites. One application for such factors is to generate ESFs that modulate alternative splicing of endogenous genes, particularly disease associated genes. For example, Bcl-x pre-mRNA produces two splicing isoforms with two alternative 5' splice sites to encode proteins of opposite functions. The long splicing isoform Bcl-xL is a potent apoptosis inhibitor expressed in long-lived post mitotic cells and is up-regulated in many cancer cells, protecting cells against apoptotic signals. The short isoform Bcl-xS is a pro-apoptotic isoform and expressed at high levels in cells with a high turnover rate (e.g., developing lymphocytes). The ratio of the two Bcl-x splicing isoforms is regulated by multiple cc-elements that are located in either the core exon region or the exon extension region (i.e., between the two alternative 5' splice sites). For more examples, see WO2010075303, which is hereby incorporated by reference in its entirety.

Further suitable fusion partners include, but are not limited to proteins (or fragments thereof) that are boundary elements (e.g., CTCF), proteins and fragments thereof that provide periphery recruitment (e.g., Lamin A, Lamin B, etc.), protein docking elements (e.g., FKBP/FRB, Pill/Abyl, etc.).

In some cases, a heterologous polypeptide (a fusion partner) provides for subcellular localization, i.e., the heterologous polypeptide contains a subcellular localization sequence (e.g., a nuclear localization signal (NLS) for targeting to the nucleus, a sequence to keep the fusion protein out of the nucleus, e.g., a nuclear export sequence (NES), a sequence to keep the fusion protein retained in the cytoplasm, a mitochondrial localization signal for targeting to the mitochondria, a chloroplast localization signal for targeting to a chloroplast, an ER retention signal, and the like). In some embodiments, a subject RNA-guided polypeptide or a conditionally active RNA-guided polypeptide and/or subject CasX fusion polypeptide does not include a NLS so that the protein is not targeted to the nucleus (which can be advantageous, e.g., when the target nucleic acid sequence is an RNA that is present in the cytosol). In some embodiments, a fusion partner can provide a tag (i.e., the heterologous polypeptide is a detectable label) for ease of tracking and/or purification (e.g., a fluorescent protein, e.g., green fluorescent protein (GFP), yellow fluorescent protein (YFP), red fluorescent protein (RFP), cyan fluorescent protein (CFP), mCherry, tdTomato, and the like; a histidine tag, e.g., a 6×His tag; a hemagglutinin (HA) tag; a FLAG tag; a Myc tag; and the like).

In some cases a reference or CasX variant polypeptide includes (is fused to) a nuclear localization signal (NLS) (e.g., in some cases 2 or more, 3 or more, 4 or more, or 5 or more 6 or more, 7 or more, 8 or more NLSs). Thus, in some cases, a reference or CasX variant polypeptide includes one or more NLSs (e.g., 2 or more, 3 or more, 4 or more, or 5 or more NLSs). In some cases, one or more NLSs (2 or more, 3 or more, 4 or more, or 5 or more NLSs) are positioned at or near (e.g., within 50 amino acids of) the N-terminus and/or the C-terminus. In some cases, one or more NLSs (2 or more, 3 or more, 4 or more, or 5 or more NLSs) are positioned at or near (e.g., within 50 amino acids of) the N-terminus. In some cases, one or more NLSs (2 or more, 3 or more, 4 or more, or 5 or more NLSs) are positioned at or near (e.g., within 50 amino acids of) the C-terminus. In some cases, one or more NLSs (3 or more, 4 or more, or 5 or more NLSs) are positioned at or near (e.g., within 50 amino acids of) both the N-terminus and the C-terminus. In some cases, an NLS is positioned at the N-terminus and an NLS is positioned at the C-terminus. In some cases a reference or CasX variant polypeptide includes (is fused to) between 1 and 10 NLSs (e.g., 1-9, 1-8, 1-7, 1-6, 1-5, 2-10, 2-9, 2-8, 2-7, 2-6, or 2-5 NLSs). In some cases a reference or CasX variant polypeptide includes (is fused to) between 2 and 5 NLSs (e.g., 2-4, or 2-3 NLSs).

Non-limiting examples of NLSs include sequences derived from: the NLS of the SV40 virus large T-antigen, having the amino acid sequence PKKKRKV (SEQ ID NO: 158); the NLS from nucleoplasmin (e.g., the nucleoplasmin bipartite NLS with the sequence KRPAATKKAGQAKKKK (SEQ ID NO: 159); the c-myc NLS having the amino acid sequence PAAKRVKLD (SEQ ID NO: 160) or RQRRNELKRSP (SEQ ID NO: 161); the hRNPAl M9 NLS having the sequence NQSSNFGPMKGGNFGGRSSGPYGGGGQYFAKPRNQGGY (SEQ ID NO: 162); the sequence RMRIZFKNKGKDTAELRRRRVEVSVELRKAKKDEQILKRRNV (SEQ ID NO: 163) of the IBB domain from importin-alpha; the sequences VSRKRPRP (SEQ ID NO: 164) and PPKKARED (SEQ ID NO: 165) of the myoma T protein; the sequence PQPKKKPL (SEQ ID NO: 166) of human p53; the sequence SALIKKKKKMAP (SEQ ID NO: 167) of mouse c-abl IV; the sequences DRLRR (SEQ ID NO: 168) and PKQKKRK (SEQ ID NO: 169) of the influenza virus NS1; the sequence RKLKKKIKKL (SEQ ID NO: 170) of the Hepatitis virus delta antigen; the sequence REKKKFLKRR (SEQ ID NO: 171) of the mouse Mxl protein; the sequence KRKGDEVDGVDEVAKKKSKK (SEQ ID NO: 172) of the human poly(ADP-ribose) polymerase; the sequence RKCLQAGMNLEARKTKK (SEQ ID NO: 173) of the steroid hormone receptors (human) glucocorticoid; the sequence PRPRKIPR (SEQ ID NO: 174) of Borna disease virus P protein (BDV-P1); the sequence PPRKKRTVV (SEQ ID NO: 175) of hepatitis C virus nonstructural protein (HCV-NS5A); the sequence NLSKKKKRKREK (SEQ ID NO: 176) of LEF1; the sequence RRPSRPFRKP (SEQ ID NO: 177) of ORF57 simirae; the sequence KRPRSPSS (SEQ ID NO: 178) of EBV LANA; the sequence KRGINDRNFWRGENERKTR (SEQ ID NO: 179) of Influenza A protein; the sequence PRPPKMARYDN (SEQ ID NO: 180) of human RNA helicase A (RHA); the sequence KRSFSKAF (SEQ ID NO: 181) of nucleolar RNA helicase II; the sequence KLKIKRPVK (SEQ ID NO: 182) of TUS-protein; the sequence PKKKRKVPPPPAAKRVKLD (SEQ ID NO: 183) associated with importin-alpha; the sequence PKTRRRPRRSQRKRPPT (SEQ ID NO: 184) from the Rex protein in HTLV-1; the sequence MSRRRKANPTKLSENAKKLAKEVEN (SEQ ID NO: 185) from the EGL-13 protein of *Caenorhabditis elegans*; and the sequences KTRRRPRRSQRKRPPT (SEQ ID NO: 186), RRKKRRPRRKKRR (SEQ ID NO: 187), PKKKSRKPKKKSRK (SEQ ID NO: 188), HKKKHPDASVNFSEFSK (SEQ ID NO: 189), QRPGPYDRPQRPGPYDRP (SEQ ID NO: 190), LSPSLSPLLSPSLSPL (SEQ ID NO: 191), RGKGGKGLGKGGAKRHRK (SEQ ID NO: 192), PKRGRGRPKRGRGR (SEQ ID NO: 193), PKKKRKVPPPPAAKRVKLD (SEQ ID NO: 183) and PKKKRKVPPPPKKKRKV (SEQ ID NO: 194). In general, NLS (or multiple NLSs) are of sufficient strength to drive accumulation of a reference or CasX variant fusion protein in the nucleus of a eukaryotic cell. Detection of accumulation in the nucleus may be performed by any suitable technique. For example, a detectable marker may be fused to a reference or CasX variant fusion protein such that location within a cell may be visualized. Cell nuclei may also be isolated from cells, the contents of which may then be analyzed by any suitable process for detecting protein, such as immunohistochemistry, Western blot, or enzyme activity assay. Accumulation in the nucleus may also be determined.

In some cases, a reference or CasX variant fusion protein includes a "Protein Transduction Domain" or PTD (also known as a CPP-cell penetrating peptide), which refers to a protein, polynucleotide, carbohydrate, or organic or inorganic compound that facilitates traversing a lipid bilayer, micelle, cell membrane, organelle membrane, or vesicle membrane. A PTD attached to another molecule, which can range from a small polar molecule to a large macromolecule and/or a nanoparticle, facilitates the molecule traversing a membrane, for example going from an extracellular space to an intracellular space, or from the cytosol to within an organelle. In some embodiments, a PTD is covalently linked to the amino terminus of a reference or CasX variant fusion protein. In some embodiments, a PTD is covalently linked to the carboxyl terminus of a reference or CasX variant fusion protein. In some cases, the PTD is inserted internally in the sequence of a reference or CasX variant fusion protein at a suitable insertion site. In some cases, a reference or CasX variant fusion protein includes (is conjugated to, is fused to) one or more PTDs (e.g., two or more, three or more, four or more PTDs). In some cases, a PTD includes one or more nuclear localization signals (NLS). Examples of PTDs include but are not limited to peptide transduction domain of HIV TAT comprising YGRKKRRQRRR (SEQ ID NO: 195), RKKRRQRR (SEQ ID NO: 196); YARAAARQARA (SEQ ID NO: 197); THRLPRRRRRR (SEQ ID NO: 198); and GGRRARRRRRR (SEQ ID NO: 199); a polyarginine sequence comprising a number of arginines sufficient to direct entry into a cell (e.g., 3, 4, 5, 6, 7, 8, 9, 10, or 10-50 arginines (SEQ ID NO: 200)); a VP22 domain (Zender et al. (2002) Cancer Gene Ther. 9(6):489-96); an *Drosophila* Antennapedia protein transduction domain (Noguchi et al. (2003) Diabetes 52(7): 1732-1737); a truncated human calcitonin peptide (Trehin et al. (2004) Pharm. Research 21:1248-1256); polylysine (Wender et al. (2000) Proc. Natl. Acad. Sci. USA 97: 13003-13008); RRQRRTSKLMKR (SEQ ID NO: 201); Transportan GWTLNSAGYLLGKINLKALAALAKKIL (SEQ ID NO: 202); KALAWEAKLAKALAKALAKHLAKALAKALKCEA (SEQ ID NO: 203); and RQIKIWFQNRRMKWKK (SEQ ID NO: 204). In some embodiments, the PTD is an activatable CPP (ACPP) (Aguilera et al. (2009) Integr Biol (Camb) June; 1(5-6): 371-381). ACPPs comprise a polycationic CPP (e.g., Arg9 or "R9") connected via a cleavable linker to a matching polyanion (e.g., Glu9 or "E9"), which reduces the net charge to nearly zero and thereby inhibits adhesion and uptake into cells. Upon cleavage of the linker, the polyanion is released, locally unmasking the polyarginine and its inherent adhesiveness, thus "activating" the ACPP to traverse the membrane.

In some embodiments, a reference or CasX variant fusion protein can include a CasX protein that is linked to an internally inserted heterologous amino acid or heterologous polypeptide (a heterologous amino acid sequence) via a linker polypeptide (e.g., one or more linker polypeptides). In some embodiments, a reference or CasX variant fusion protein can be linked at the C-terminal and/or N-terminal end to a heterologous polypeptide (fusion partner) via a linker polypeptide (e.g., one or more linker polypeptides) The linker polypeptide may have any of a variety of amino acid sequences. Proteins can be joined by a spacer peptide, generally of a flexible nature, although other chemical linkages are not excluded. Suitable linkers include polypeptides of between 4 amino acids and 40 amino acids in length, or between 4 amino acids and 25 amino acids in length. These linkers are generally produced by using synthetic, linker-encoding oligonucleotides to couple the proteins. Peptide linkers with a degree of flexibility can be used. The linking peptides may have virtually any amino acid sequence, bearing in mind that the preferred linkers will have a sequence that results in a generally flexible peptide. The use of small amino acids, such as glycine and alanine, are of use in creating a flexible peptide. The creation of such sequences is routine to those of skill in the art. A variety of different linkers are commercially available and are considered suitable for use. Example linker polypeptides include glycine polymers (G)n, glycine-serine polymer (including, for example, (GS)n, GSGGSn (SEQ ID NO: 205), GGSGGSn (SEQ ID NO: 206), and GGGSn (SEQ ID NO: 207), where n is an integer of at least one), glycine-alanine polymers, alanine-serine polymers, glycine-proline polymers, proline polymers and proline-alanine polymers. Example linkers can comprise amino acid sequences including, but not limited to, GGSG (SEQ ID NO: 208), GGSGG (SEQ ID NO: 209), GSGSG (SEQ ID NO: 210), GSGGG (SEQ ID NO: 211), GGGSG (SEQ ID NO: 212), GSSSG (SEQ ID NO: 213), GPGP (SEQ ID NO: 214), GGP, PPP, PPAPPA (SEQ ID NO: 215), PPPGPPP (SEQ ID NO: 216) and the like. The ordinarily skilled artisan will recognize that design of a peptide conjugated to any elements described above can include linkers that are all or partially flexible, such that the linker can include a flexible linker as well as one or more portions that confer less flexible structure.

V. CasX:gNA Systems and Methods for Modification of Nucleic Acids Encoding for Proteins Involved in Antigen Processing, Presentation, Recognition and/or Response and their Regulatory Regions The CasX proteins, guide nucleic acids, and variants thereof provided herein are useful for various applications, including as therapeutics, diagnostics, and for research. To effect the methods of the disclosure for gene editing, provided herein are programmable CasX:gNA systems. The programmable nature of the CasX:gNA system provided herein allows for the precise targeting to achieve the desired effect (nicking, cleaving, repairing, etc.) at one or more regions of predetermined interest in the target nucleic acid sequence of the gene encoding the protein of interest. In some embodiments, the CasX:gNA systems provided herein comprise a CasX variant of Table 4, 7, 8, 9, or 11 or a variant having at least 50%, at least 60%, at least 70%, at least 80%, or at least 90%, or at least 95%, or at least 99% sequence identity to a sequence of Table 4, and a gNA (e.g., a gNA comprising a scaffold variant of Table 2, or a variant having at least 50%, at least 60%, at least 70%, at least 80%, or at least 90%, or at least 95%, or at least 99% sequence identity to a sequence of Table 2) or one or more polynucleotides encoding a CasX variant protein and a gNA, wherein the targeting sequence of the gNA is complementary to, and therefore is capable of hybridizing with a target nucleic acid sequence encoding the target protein, its regulatory element, or both, or a sequence complementary thereto. In other cases, the CasX:gNA system can comprise a reference CasX or a reference gNA. In some cases, the CasX:gNA system further comprises a donor template nucleic acid.

A variety of strategies and methods can be employed to modify a target nucleic acid sequence encoding a cell surface marker protein, a transmembrane protein, or intracellular or extracellular protein and/or to introduce a protein involved in antigen processing, antigen presentation, antigen recognition, and/or antigen response into a cell using the CasX:gNA systems provided herein. As used herein "modifying" includes but is not limited to cleaving, nicking, editing, deleting, knocking in, knocking out, repairing/correcting, and the like. The term "knock-out" refers to the elimination of a gene or the expression of a gene. For example, a gene can be knocked out by either a deletion or an addition of a nucleotide sequence that leads to a disruption of the reading frame. As another example, a gene may be knocked-out by replacing a part of the gene with an irrelevant sequence or one or more substituted bases. The term "knock-down" as used herein refers to reduction in the expression of a gene or its gene product(s). As a result of a gene knock-down, the protein activity or function may be attenuated or the protein levels may be reduced or eliminated. In such embodiments, gNAs having targeting sequences specific for a portion of the gene encoding the protein involved in antigen processing, antigen presentation, antigen recognition, and/or antigen response or its regulatory element, or the complement of the sequence, may be utilized. Depending on the CasX protein and gNA utilized, the event may be a cleavage event, allowing for knock-down/knock-out of expression. In some embodiments gene expression for the protein may be disrupted or eliminated by introducing random insertions or deletions (indels), for example by utilizing the imprecise non-homologous DNA end joining (NHEJ) repair pathway. In such embodiments, the targeted region of the protein involved in antigen processing, antigen presentation, antigen recognition, and/or antigen response includes coding sequences (exons) of the gene, wherein inserting or deleting nucleotides can generate a frame shift mutation. This approach can also be used in other non-coding regions such as introns, or regulatory elements to disturb expression of the target gene.

In some embodiments, the method of the disclosure provides CasX protein and one or more gNA that generate site-specific double strand breaks (DSBs) or single strand breaks (SSBs) (e.g., when the CasX protein is a nickase that can cleave only one strand of a target nucleic acid) within double-stranded DNA (dsDNA) target nucleic acids, which can then be repaired either by non-homologous end joining (NHEJ), homology-directed repair (HDR), homology-independent targeted integration (HITI), micro-homology mediated end joining (MMEJ), single strand annealing (SSA) or base excision repair (BER), resulting in modification of the target nucleic acid sequence. In some embodiments, it may be desirable to utilize one or a pair (or 3 or 4) of gNAs, each having a targeting sequence specific for a different region of the protein involved in antigen processing, antigen presentation, antigen recognition, and/or antigen response allele, followed by introduction of a donor template comprising a polynucleotide sequence that will be inserted at the break site.

In one embodiment, the disclosure provides for a method of modifying a target nucleic acid sequence of a gene in a population of cells, wherein the gene encodes a protein involved in antigen processing, antigen presentation, antigen recognition, and/or antigen response, comprising introducing into each cell of the population: a) the CasX:gNA system of any one of the embodiments described herein; b) a nucleic acid that encodes the CasX:gNA system of any one of the embodiments described herein; c) a vector comprising the nucleic acid of (b), above; d) a VLP comprising the CasX:gNA system of any one of the embodiments described herein; or e) combinations of two or more of (a) to (d), wherein the target nucleic acid sequence of the cells is modified by the CasX protein. In one embodiment, the CasX:gNA system is introduced into the cells as an RNP. In some embodiments of the method, the cells are selected from the group consisting of rodent cells, mouse cells, rat cells, and non-human primate cells. In other embodiments of the method, the cells are human cells. In other embodiments of the method, the cells are selected from the group consisting of progenitor cells, hematopoietic stem cells, and pluripotent stem cells. In other embodiments of the method, the cells are induced pluripotent stem cells. In other embodiments of the method, the cells are immune cells selected from the group consisting of T cells, tumor infiltrating lymphocytes, NK cells, B cells, monocytes, macrophages, or dendritic cells. In a particular embodiment, the T cells are selected from the group consisting of CD4+ T cells, CD8+ T cells, gamma-delta T cells, or a combination thereof. Where a T cell is the cell to be modified, mixtures of CD4+ and CD8+ T cells are often selected in the engineering of CAR-T cells, likely because the CD4 T cells provide growth factors and other signals to maintain function and survival of the infused CTLs (Barrett, D M, et al. Chimeric antigen receptor (CAR) and T cell receptor (TCR) Modified T cells Enter Main Street and Wall Street. J Immunol. 195(3): 755-761(2015)). In some embodiments, the cell is autologous with respect to a subject to be administered said cell. In other embodiments of the method, the cell is allogeneic with respect to a subject to be administered said cell.

In some embodiments of the method of modifying a target nucleic acid sequence of a gene in a population of cells, the modifying comprises introducing one or more single-stranded breaks in the target nucleic acid sequence of the cells of the population. In other embodiments of the method, the modifying comprises introducing one or more double-stranded breaks in the target nucleic acid sequence of the cells of the population. In other embodiments of the method, the modifying comprises introducing an insertion, deletion, substitution, duplication, or inversion of one or more nucleotides in the target nucleic acid sequence of the cells of the population, resulting in a knock-down or knock-out of the gene in the cells of the population encoding one or more of the proteins involved in antigen processing, antigen presentation, antigen recognition, and/or antigen response. In some embodiments, the targeted protein is selected from beta-2-microglobulin (B2M), T cell receptor alpha chain constant region (TRAC), ICP47 polypeptide, class II major histocompatibility complex transactivator (CIITA), T cell receptor beta constant 1 (TRBC1), T cell receptor beta constant 2 (TRBC2), human leukocyte antigen A (HLA-A), human leukocyte antigen B (HLA-B), TGFβ Receptor 2 (TGFβRII), programmed cell death 1 (PD-1), cytokine inducible SH2 (CISH), lymphocyte activating 3 (LAG-3), T cell immunoreceptor with Ig and ITIM domains (TIGIT), adenosine A2a receptor (ADORA2A), killer cell lectin like receptor C1 (NKG2A), cytotoxic T-lymphocyte-associated protein 4 (CTLA-4), T-cell immunoglobulin and mucin domain 3 (TIM-3), and 2B4 (CD244). In one exemplary embodiment, the cell surface marker protein is B2M and the targeting sequence of the gNA comprises a sequence selected from the sequences of Table 3A. In another exemplary embodiment, the cell surface marker protein is TRAC and the targeting sequence of the gNA comprises a sequence selected from the sequences of Table 3B. In another exemplary embodiment, the intracellular protein is CIITA and the targeting sequence of the gNA comprises a sequence selected from the sequences of Table 3C. In another embodiment of the method, the genes to be modified are at least two of the proteins selected from the group consisting of B2M, TRAC, and CIITA. In one embodiment of the foregoing, the cells of the population have been modified such that expression of the one or more proteins is reduced by at least about 50%, at least about 60%, at least about 70%, at least about 80%, at least about 90%, or at least about 95% in comparison to a cell that has not been modified. In another embodiment of the foregoing, the cells of the population have been modified such that at least about 50%, at least about 60%, at least about 70%, at least about 80%, at least about 90%, or at least about 95% of the cells do not express a detectable level of the one or more proteins in comparison to a cell that has not been modified. In another embodiment of the method, the cells have been modified such that at least 70%, at least 75%, at least 80%, at least 85%, at least 90%, or at least 95% of the modified cells do not express a detectable level of MHC Class I molecules. In another embodiment of the method, the cells have been modified such that at least 70%, at least 75%, at least 80%, at least 85%, at least 90%, or at least 95% of the modified cells do not express a detectable level of wild-type T cell receptor.

In some embodiments, the method comprises insertion of the donor template into the break site(s) of the target nucleic acid sequence of the cells of the population. Depending on whether the system is used to knock-down/knock-out or to knock-in a protein involved in antigen processing, antigen presentation, antigen recognition, and/or antigen response, the donor template can be a short single-stranded or double-stranded oligonucleotide, or a long single-stranded or double-stranded oligonucleotide encoding the gene for the protein involved in antigen processing, antigen presentation, antigen recognition, and/or antigen response. For knock-down/knock-outs, the donor template sequence is typically not identical to the genomic sequence that it replaces and may contain one or more single base changes, insertions, deletions, inversions or rearrangements with respect to the genomic sequence, provided that there is sufficient homology with the target sequence to support homology-directed repair, which can result in a frame-shift or other mutation such that the target protein is not expressed or is expressed at a lower level. In certain embodiments, for knock-down/knock-out modifications, the donor template sequence will have at least about 60%, 70%, 80%, 90%, 95%, 98%, 99%, or 99.9% sequence identity to the target genomic sequence with which recombination is desired. In some embodiments, the donor template sequence comprises a non-homologous sequence flanked by two regions of homology ("homologous arms"), such that homology-directed repair between the target DNA region and the two flanking sequences results in insertion of the non-homologous sequence at the target region. The upstream and downstream sequences share sequence similarity with either side of the site of integration in the target DNA, facilitating insertion of the sequence. In some embodiments, the homologous region of a donor template sequence will have at least 50% sequence identity to the target genomic sequence with which recombination is desired. The donor template sequence may comprise certain sequence differences as compared to the genomic sequence, e.g., restriction sites, nucleotide polymorphisms, selectable markers (e.g., drug resistance genes, fluorescent proteins, enzymes etc.), etc., which may be used to assess for successful insertion of the donor nucleic acid at the cleavage site or in some cases may be used for other purposes (e.g., to signify expression at the targeted genomic locus). Alternatively, these sequence differences may include flanking recombination sequences such as FLPs, loxP sequences, or the like, that can be activated at a later time for removal of the marker sequence. In some embodiments, the donor template comprises at least about 10, at least about 50, at least about 100, or at least about 200, or at least about 300, or at least about 400, or at least about 500, or at least about 600, or at least about 700, or at least about 800, or at least about 900, or at least about 1000, or at least about 10,000, or at least 15,000 nucleotides of a target gene. In other embodiments the donor template comprises at least about 20 to about 10,000 nucleotides, or at least about 200 to about 8000 nucleotides, or at least about 400 to about 6000 nucleotides, or at least about 600 to about 4000 nucleotides, or at least about 1000 to about 2000 nucleotides of a target gene. In other embodiments, the disclosure provides a method to alter a target sequence of a cell using a CasX:gNA system and a donor template comprising a deletion, insertion, or mutation of 20 or fewer nucleotides, 10 or fewer nucleotides, 5 or fewer nucleotides, 4 or fewer nucleotides, 3 or fewer nucleotides, 2 nucleotides, or a single nucleotide in an encoding nucleic acid of the gene wherein the insertion of the donor template results in a cell wherein the expression of the target protein is reduced by at least about 50%, at least about 60%, at least about 70%, at least about 80%, or at least about 90%, or at least about 95% in comparison to a cell that has not been modified. In some embodiments, the donor template comprises a single stranded DNA sequence. In other embodiments, the donor template comprises a single stranded RNA template. In other embodiments, the donor template comprises a double stranded DNA sequence.

In other cases, an exogenous donor template is inserted between the ends generated by CasX cleavage by homology-independent targeted integration (HITI) mechanisms. The exogenous sequence inserted by HITI can be any length, for example, a relatively short sequence of between 1 and 50 nucleotides in length, or a longer sequence of about 50-1000 nucleotides in length. The lack of homology can be, for example, having no more than 20-50% sequence identity and/or lacking in specific hybridization at low stringency. In other cases, the lack of homology can further include a criterion of having no more than 5, 6, 7, 8, or 9 bp identity. The donor template insertion can be mediated by homology-directed repair (HDR) or homology-independent targeted integration (HITI). In some cases, the insertion of the donor template results in a knock-down or knock-out of the gene in the cells of the population encoding the one or more proteins involved in antigen processing, antigen presentation, antigen recognition, and/or antigen response. In some cases, the cells of the population have been modified such that expression of the one or more proteins is reduced by at least about 50%, at least about 60%, at least about 70%, at least about 80%, at least about 90%, or at least about 95% in comparison to a cell that has not been modified. In other cases, the cells of the population have been modified such that the cells do not express a detectable level of the one or more proteins. In a particular embodiment, the one or more proteins are selected from the group consisting of B2M, TRAC, and CIITA. In one embodiment, the method is conducted ex vivo on the population of cells. In another embodiment, the method is conducted in vivo in a subject.

In some embodiments of the method of modifying a target nucleic acid sequence of a gene in a population of cells, the modifying further comprises insertion of a polynucleotide encoding a chimeric antigen receptor (CAR), described more fully below, resulting in expression of a detectable level of the CAR in the modified cells of the population. Exemplary CARs, and methods for engineering and introducing such receptors into cells, include those described, for example, in international patent application publication numbers WO2013126726, WO2012129514, WO2014031687, WO2013166321, WO2013071154, WO2013123061 U.S. patent application publication numbers US2002131960, US2013287748, US20130149337, US 20190136230, U.S. Pat. Nos. 6,451,995, 7,446,190, 8,252,592, 8,339,645, 8,398,282, 7,446,179, 6,410,319, 7,070,995, 7,265,209, 7,354,762, 7,446,191, 8,324,353, and 8,479,118, incorporated by reference herein. The polynucleotide can be introduced into the cells to be modified by a vector as described herein, or as a plasmid using conventional methods known in the art; e.g. electroporation or microinjection.

In some embodiments of the method of modifying a target nucleic acid sequence of a gene in a population of cells, the modifying further comprises insertion of a polynucleotide encoding a fusion protein comprising a subunit of a TCR linked to an antigen binding domain capable of re-targeting the TCR (referred to here as an engineered T cell receptor, or engineered TCR) to a desired protein involved in antigen processing, antigen presentation, antigen recognition, and/or antigen response. The engineering of the T cell results in expression of a detectable level of the engineered TCR in the modified cells of the population, resulting in cells with a TCR for a second defined specificity that have utility in the treatment of a disease, like cancer or autoimmune diseases. The one or more subunits of the TCR may comprise any of TCR alpha, TCR beta, CD3-delta, CD3-epsilon, CD-gamma or CD3-zeta. Thus, the engineered TCR comprises a fusion protein comprising at least a portion of a TCR extracellular domain or transmembrane domain, and an antigen binding domain wherein the TCR subunit and the antigen binding domain are operatively linked. In some embodiments, the engineered TCR comprises a fusion protein comprising at least a portion of a TCR extracellular domain or transmembrane domain, a TCR intracellular domain comprising a stimulatory domain, and an antigen binding domain wherein the TCR subunit and the antigen domain are operatively linked. Besides the ability of the modified population of T cells expressing a CAR or a second TCR to recognize and destroy respective target cells in vitro/ex vivo, the modified population of cells have utility in the treatment of subjects having a disease such as cancer or an autoimmune disease.

In some embodiments, the CAR or engineered TCR has an antigen binding domain having specific binding affinity for a disease antigen, optionally a tumor cell antigen. In the foregoing, the tumor cell antigen can be selected from the group consisting of cluster of differentiation 19 (CD19), cluster of differentiation 3 (CD3), CD3d molecule (CD3D), CD3g molecule (CD3G), CD3e molecule (CD3E), CD247 molecule (CD247, or CD3Z), CD8a molecule (CD8), CD7 molecule (CD7), membrane metalloendopeptidase (CD10), membrane spanning 4-domains A1 (CD20), CD22 molecule (CD22), TNF receptor superfamily member 8 (CD30), C-type lectin domain family 12 member A (CLL1), CD33 molecule (CD33), CD34 molecule (CD34), CD38 molecule (CD38), integrin subunit alpha 2b (CD41), CD44 molecule (Indian blood group) (CD44), CD47 molecule (CD47), integrin alpha 6 (CD49f), neural cell adhesion molecule 1 (CD56), CD70 molecule (CD70), CD74 molecule (CD74), CD99 molecule (Xg blood group) (CD99), interleukin 3 receptor subunit alpha (CD123), prominin 1 (CD133), syndecan 1 (CD138), carbonix anhydrase IX (CAIX), CC chemokine receptor 4 (CCR4), ADAM metallopeptidase domain 12 (ADAM12), adhesion G protein-coupled receptor E2 (ADGRE2), alkaline phosphatase placental-like 2 (ALPPL2), alpha 4 Integrin, angiopoietin-2 (ANG2), B-cell maturation antigen (BCMA), CD44V6, carcinoembryonic antigen (CEA), CEAC, CEA cell adhesion molecule 5 (CEACAM5), Claudin 6 (CLDN6), CLDN18, C-type lectin domain family 12 member A (CLEC12A), mesenchymal-epithelial transition factor (cMET), cytotoxic T-lymphocyte-associated protein 4 (CTLA4), epidermal growth factor receptor 1 (EGF1R), epidermal growth factor receptor variant III (EGFRvIII), epithelial glycoprotein 2 (EGP-2), epithelial cell adhesion molecule (EGP-40 or EpCAM), EPH receptor A2 (EphA2), ectonucleotide pyrophosphatase/phosphodiesterase 3 (ENPP3), erb-b2 receptor tyrosine kinase 2 (ERBB2), erb-b2 receptor tyrosine kinase 3 (ERBB3), erb-b2 receptor tyrosine kinase 4 (ERBB4), folate binding protein (FBP), fetal nicotinic acetylcholine receptor (AChR), folate receptor alpha (Fralpha or FOLR1), G protein-coupled receptor 143 (GPR143), glutamate metabotropic receptor 8 (GRM8), glypican-3 (GPC3), ganglioside GD2, ganglioside GD3, human epidermal growth factor receptor 1 (HER1), human epidermal growth factor receptor 2 (HER2), human epidermal growth factor receptor 3 (HER3), Integrin B7, intercellular cell-adhesion molecule-1 (ICAM-1), human telomerase reverse transcriptase (hTERT), Interleukin-13 receptor $\alpha 2$ (IL-13R-a2), K-light chain, Kinase insert domain receptor (KDR), Lewis-Y (LeY), chondromodulin-1 (LECT1), L1 cell adhesion molecule (LiCAM), Lysophosphatidic acid receptor 3 (LPAR3), melanoma-associated antigen 1 (MAGE-A1), mesothelin (MSLN), mucin 1 (MUC1), mucin 16, cell surface associated (MUC16), melanoma-associated antigen 3 (MAGEA3), tumor protein p53 (p53), Melanoma Antigen Recognized by T cells 1 (MART1), glycoprotein 100 (GP100), Proteinase3 (PR1), ephrin-A receptor 2 (EphA2), Natural killer group 2D ligand (NKG2D ligand), New York esophageal squamous cell carcinoma 1 (NY-ESO-1), oncofetal antigen (h5T4), prostate-specific membrane antigen (PSMA), programmed death ligand 1 (PDL-1), receptor tyrosine kinase-like orphan receptor 1 (ROR1), trophoblast glycoprotein (TPBG), tumor-associated glycoprotein 72 (TAG-72), tumor-associated calcium signal transducer 2 (TROP-2), tyrosinase, survivin, vascular endothelial growth factor receptor 2 (VEGF-R2), Wilms tumor-1 (WT-1), leukocyte immunoglobulin-like receptor B2 (LILRB2), Preferentially Expressed Antigen In Melanoma (PRAME), T cell receptor beta constant 1 (TRBC1), TRBC2, and (T-cell immunoglobulin mucin-3) TIM-3. In one embodiment, the CAR or engineered TCR comprises an antigen binding domain selected from the group consisting of linear antibody, single domain antibody (sdAb), and single-chain variable fragment (scFv). In another embodiment, the CAR further comprises at least one intracellular signaling domain, wherein the at least one intracellular signaling domain comprises one or more intracellular signaling domains isolated or derived from CD247 molecule (CD3-zeta), CD27 molecule (CD27), CD28 molecule (CD28), TNF receptor superfamily member 9 (4-1BB), inducible T cell costimulator (ICOS), or TNF receptor superfamily member 4 (OX40). In another embodiment, the CAR further comprises an extracellular hinge domain or spacer. In one embodiment, the extracellular hinge domain is an immunoglobulin like domain, wherein the hinge domain is isolated or derived from IgG1, IgG2, or IgG4. In another embodiment, the hinge domain is isolated or derived from CD8a molecule (CD8) or CD28. In another embodiment, the CAR further comprises a transmembrane domain. The transmembrane domain can be isolated or derived from the group consisting of CD3-zeta, CD4, CD8, and CD28.

In some embodiments, the antigen binding domain of the CAR or engineered TCR is selected from the group consisting of linear antibody, single domain antibody (sdAb), and single-chain variable fragment (scFv). In a particular embodiment, the antigen binding domain is an scFv. In some embodiments, the scFv comprises a heavy chain variable domain (VH) and a light chain variable domain (VL) with specific binding affinity to the tumor cell antigen or target cell marker. Typically, the VH comprises a CDR-H1 region, a CDR-H2 region, a CDR-H3 region with interspersed framework regions (FR) connecting each CDR, and the VL comprises a CDR-L1 region, a CDR-L2 region, and a CDR-L3 region with its interspersed FR. In some embodiments, antigen binding domain exhibits an affinity with an equilibrium binding constant for a tumor cell antigen of between or between about $10^{-5}$ and $10^{-12}$ M and all individual values and ranges therein; such binding affinity being "specific". In other embodiments, the scFv comprises heavy chain complementarity determining regions (CDRs) and light chain CDRs identical to a reference antibody. In some cases, the reference antibody is a humanized antibody. Humanized antibodies refer to forms of non-human (e.g., murine) antibodies that are specific chimeric immunoglobulins, immunoglobulin chains, or antigen-binding fragments thereof that contain minimal sequence derived from non-human immunoglobulin. For the most part, humanized antibodies are human immunoglobulins in which residues from a CDR of the recipient antibody are replaced by residues from a CDR of a non-human species, such as mouse, rat, or rabbit having the desired specificity, affinity, and capacity. In some instances, Fv framework region (FR) residues are replaced by corresponding non-human residues. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. In some embodiments of the method, the reference antibody utilized to provide the antigen binding domain of the CAR comprises VH and VL and/or heavy chain and light chain CDRs selected from the group consisting of the sequences set forth in Table 5. It will be understood that the VH and VL sequences of Table 5 comprise a CDR-H1 region, a CDR-H2 region, a CDR-H3 region, a CDR-L1 region, a CDR-L2 region, and a CDR-H3 region (indicated by the underlined sequences of Table 5), and that the antigen binding domains of the CAR and/or engineered TCR embodiments can be constructed with these CDRs utilizing alternative framework regions than those of the corresponding VH and VL, yet still retain specific binding affinity to the target cell marker. In some cases, the CDRs or the VL and VH can have one or more amino acid substitutions, deletions, or insertions so long as specific binding affinity to the target cell marker is retained. In the foregoing embodiments, a nucleic acid encoding the CDRs or the VH and VL of the scFv as a component of the encoded CAR or TCR is utilized to modify the population of cells.

TABLE 5

Reference Antibody Sequences

| Trade Name | Antibody Name | Target Cell Marker | VH Sequence | VL Sequence |
|---|---|---|---|---|
| | huOKT3 | CD3 | QVQLVQSGGGVVQPGR<br>SLRLSCKAS**GYTFTRYT**<br>**MH**WVRQAPGKGLEWIG<br>**YINPSRGYTNYNQKVKD**<br>RFTISRDNSKNTAFLQM<br>DSLRPEDTGVYFCAR**YY**<br>**DDHYCLDY**WGQGTPVT<br>VSS<br>(SEQ ID NO: 217) | DIQMTQSPSSLSASVG<br>DRVTITC**SASSSVSYM**<br>**N**WYQQTPGKAPKRWI<br>Y**DTSKLAS**GVPSRFSG<br>SGSGTDYTFTISSLQPE<br>DIATYYC**QQWSSNPFT**<br>FGQGTKLQITR<br>(SEQ ID NO: 218) |
| | huUCHT 1 | CD3 | EVQLVESGGGLVQPGG<br>SLRLSCAAS**GYSFTGYT**<br>**MN**WVRQAPGKGLEWVA<br>**LINPYKGVST**YNQKFKD<br>RFTISVDKSKNTAYLQMN<br>SLRAEDTAVYYCAR**SGY**<br>**YGDSDWYFDV**WGQGTL<br>VTVSS<br>(SEQ ID NO: 219) | DIQMTQSPSSLSASVG<br>DRVTITC**RASQDIRNYL**<br>**N**WYQQKPGKAPKLLIY<br>**YTSRLES**GVPSRFSGS<br>GSGTDYTLTISSLQPED<br>FATYYC**QQGNTLPWT**F<br>GQGTKVEIK<br>(SEQ ID NO: 220) |
| | hu12F6 | CD3 | QVQLVQSGGGVVQPGR<br>SLRLSCKAS**GYTFTSYT**<br>**MH**WVRQAPGKGLEWIG<br>**YINPSSGYTKYNQKFKD**<br>RFTISADKSKSTAFLQMD<br>SLRPEDTGVYFCAR**WQ**<br>**DYDVYFDY**WGQGTPVT<br>VSS<br>(SEQ ID NO: 221) | DIQMTQSPSSLSASVG<br>DRVTMTC**RASSSVSY**<br>**MH**WYQQTPGKAPKPW<br>IY**ATSNLAS**GVPSRFS<br>GSGSGTDYTLTISSLQP<br>EDIATYYC**QQWSSNPP**<br>TFGQGTKLQITR<br>(SEQ ID NO: 222) |
| | mOKT3 | CD3 | QVQLQQSGAELARPGAS<br>VKMSCKAS**GYTFTRYTM**<br>**YI**WVKQRPGQGLEWIG**H**<br>**NPSRGYTNYNQKFKD**KA<br>TLTTDKSSSTAYMQLSSL<br>TSEDSAVYYCAR**YYDDH**<br>**YCLDY**WGQGTTLTVSS<br>(SEQ ID NO: 223) | QIVLTQSPAIMSASPGE<br>KVTMTC**SASSSVSYMN**<br>WYQQKSGTSPKRWIY<br>**DTSKLAS**GVPAHFRGS<br>GSGTSYSLTISGMEAE<br>DAATYYC**QQWSSNPF**<br>**T**FGSGTKLEINR<br>(SEQ ID NO: 224) |
| | blinatu-momab | CD3 | DIKLQQSGAELARPGAS<br>VKMSCKTS**GYTFTRYTM**<br>**H**WVKQRPGQGLEWIG**YI**<br>**NPSRGYTNYNQKFKD**KA<br>TLTTDKSSSTAYMQLSSL<br>TSEDSAVYYCAR**YYDDH**<br>**YCLDY**WGQGTTLTVSS<br>(SEQ ID NO: 225) | DIQLTQSPAIMSASPGE<br>KVTMTC**RASSSVSYMN**<br>WYQQKSGTSPKRWIY<br>**DTSKVAS**GVPYRFSGS<br>GSGTSYSLTISSMEAE<br>DAATYYC**QQWSSNPL**<br>**T**FGAGTKLELK<br>(SEQ ID NO: 226) |
| | Solito-mab | CD3 | DVQLVQSGAEVKKPGAS<br>VKVSCKAS**GYTFTRYTM**<br>**H**WVRQAPGQGLEWIG**YI**<br>**NPSRGYTNYADSVKG**RF<br>TITTDKSTSTAYMELSSL<br>RSEDTATYYCAR**YYDDH**<br>**YCLDY**WGQGTTVTVSS<br>(SEQ ID NO: 227) | DIVLTQSPATLSLSPGE<br>RATLSC**RASQSVSYMN**<br>WYQQKPGKAPKRWIY<br>**DTSKVAS** GVPARFSGS<br>GSGTDYSLTINSLEAED<br>AATYYC**QQWSSNPLT**F<br>GGGTKVEIK<br>(SEQ ID NO: 228) |
| | | CD3 | EVQLVESGGGLVQPGG<br>SLKLSCAASGFTFNKYA<br>MNWVRQAPGKGLEWVA<br>RIRSKYNNYATYYADSVK<br>DRFTISRDDSKNTAYLQ<br>MNNLKTEDTAVYYCVRH<br>GNFGNSYISYWAYWGQ<br>GTLVTVSS<br>(SEQ ID NO: 229) | QTVVTQEPSLTVSPGG<br>TVTLTCGSSTGAVTSG<br>YYPNWVQQKPGQAPR<br>GLIGGTKFLAPGTPARF<br>SGSLLGGKAALTLSGV<br>QPEDEAEYYCALWYSN<br>RWVFGGGTKLTVL<br>(SEQ ID NO: 230) |
| | | CD3 | EVQLVESGGGLVQPGG<br>SLRLSCAASGFTFNTYA<br>MNWVRQAPGKGLEWVG<br>RIRSKYNNYATYYADSVK | QAVVTQEPSLTVSPGG<br>TVTLTCGSSTGAVTTS<br>NYANWVQQKPGQAPR<br>GLIGGTNKRAPGVPAR |

TABLE 5-continued

Reference Antibody Sequences

| Trade Name | Antibody Name | Target Cell Marker | VH Sequence | VL Sequence |
|---|---|---|---|---|
| | | | GRFTISRDDSKNTLYLQ<br>MNSLRAEDTAVYYCVRH<br>GNFGNSYVSWFAYWGQ<br>GTLVTVSS<br>(SEQ ID NO: 231) | FSGSLLGGKAALTLSG<br>AQPEDEAEYYCALWYS<br>NLWVFGGGTKLTVL<br>(SEQ ID NO: 232) |
| | | CD3 | EVQLLESGGGLVQPGGS<br>LKLSCAASGFTFNTYAM<br>NWVRQAPGKGLEWVAR<br>IRSKYNNYATYYADSVKD<br>RFTISRDDSKNTAYLQM<br>NNLKTEDTAVYYCVRHG<br>NFGNSYVSWFAYWGQG<br>TLVTVSS<br>(SEQ ID NO: 233) | ELVVTQEPSLTVSPGG<br>TVTLTCRSSTGAVTTS<br>NYANWVQQKPGQAPR<br>GLIGGTNKRAPGTPAR<br>FSGSLLGGKAALTLSG<br>VQPEDEAEYYCALWYS<br>NLWVFGGGTKLTVL<br>(SEQ ID NO: 234) |
| | | CD3 | EVKLLESGGGLVQPKGS<br>LKLSCAASGFTFNTYAM<br>NWVRQAPGKGLEWVAR<br>IRSKYNNYATYYADSVKD<br>RFTISRDDSQSILYLQMN<br>NLKTEDTAMYYCVRHGN<br>FGNSYVSWFAYWGQGT<br>LVTVSS<br>(SEQ ID NO: 235) | QAVVTQESALTTSPGE<br>TVTLTCRSSTGAVTTS<br>NYANWVQEKPDHLFT<br>GLIGGTNKRAPGVPAR<br>FSGSLIGDKAALTITGA<br>QTEDEAIYFCALWYSN<br>LWVFGGGTKLTVL<br>(SEQ ID NO: 236) |
| Tysabri ™ | natali-<br>zumab | Alpha 4<br>Integrin | QVQLVQSGAEVKKPGAS<br>VKVSCKASGFNIK**DTYIH**<br>WVRQAPGQRLEWMG**RI**<br>**DPANGYTKYDPKFQG**R<br>VTITADTSASTAYMELSS<br>LRSEDTAVYYCAR**EGYY**<br>**GNYGVYAMDY**WGQGTL<br>VTVSS<br>(SEQ ID NO: 237) | DIQMTQSPSSLSASVG<br>DRVTITC**KTSQDINKYM**<br>**A**WYQQTPGKAPRLLIH<br>**YTSALQ**PGIPSRFSGS<br>GSGRDYTFTISSLQPE<br>DIATYYC**LQYDNLWT**F<br>GQGTKVEIK<br>(SEQ ID NO: 238) |
| REGN<br>910 | nesva-<br>cumab | Ang2 | EVQLVESGGGLVQPGG<br>SLRLSCAASG**GFTFSSYDI**<br>**H**WVRQATGKGLEWVSAI<br>**GPAGDTYYPGSV**KGRFT<br>ISRENAKNSLYLQMNSLR<br>AGDTAVYYCAR**GLITFG**<br>**GLIAPFD**YWGQGTLVTV<br>SS<br>(SEQ ID NO: 239) | EIVLTQSPGTLSLSPGE<br>RATLSCRA**SQSVSSTY**<br>**LA**WYQQKPGQAPRLLI<br>Y**GASSRAT**GIPDRFSG<br>SGSGTDFTLTISRLEPE<br>DFAVYYC**QHYDNSQ**TF<br>GQGTKVEIK<br>(SEQ ID NO: 240) |
| hMFE2<br>3 | | CEA | QVKLEQSGAEVVKPGAS<br>VKLSCKAS**GFNIKDS**YM<br>HWLRQGPGQRLEWIGW<br>**IDPENGD**TEYAPKFQGK<br>ATFTTDTSANTAYLGLSS<br>LRPEDTAVYYCNEG**TPT**<br>**GPYYFD**YWGQGTLVTVS<br>S<br>(SEQ ID NO: 241) | ENVLTQSPSSMSASVG<br>DRVNIACSA**SSSVS**YM<br>HWFQQKPGKSPKLWIY<br>STSN**LAS**GVPSRFSGS<br>GSGTDYSLTISSMQPE<br>DAATYYCQQ**RSSYYPL**T<br>FGGGTKLEIK<br>(SEQ ID NO: 242) |
| M5A<br>(human-<br>ized<br>T84.66) | | CEA | EVQLVESGGGLVQPGG<br>SLRLSCAASGFNIK**DTYM**<br>**H**WVRQAPGKGLEVVVA**R**<br>**IDPANGNSKYADSVKG**R<br>FTISADTSKNTAYLQMNS<br>LRAEDTAVYYCAP**FGYY**<br>**VSDYAMAY**WGQGTLVT<br>VSS<br>(SEQ ID NO: 243) | DIQLTQSPSSLSASVGD<br>RVTITC**RAGESVDIFGV**<br>**GFLH**WYQQKPGKAPK<br>LLIY**RASNLES**GVPSRF<br>SGSGSRTDFTLTISSLQ<br>PEDFATYYC**QQTNEDP**<br>**YT**FGQGTKVEIK<br>(SEQ ID NO: 244) |
| M5B<br>(human-<br>ized<br>T84.66) | | CEA | EVQLVESGGGLVQPGG<br>SLRLSCAASGFNIK**DTYM**<br>HWVRQAPGKGLEVVVA**R**<br>**IDPANGNSKYVPKFQG**R<br>ATISADTSKNTAYLQMNS | DIQLTQSPSSLSASVGD<br>RVTITC**RAGESVDIFGV**<br>**GFLH**WYQQKPGKAPK<br>LLIY**RASNLES**GVPSRF<br>SGSGSRTDFTLTISSLQ |

TABLE 5-continued

| Reference Antibody Sequences | | | | |
|---|---|---|---|---|
| Trade Name | Antibody Name | Target Cell Marker | VH Sequence | VL Sequence |
| | | | LRAEDTAVYYCAP**FGYYVSDYAMAY**WGQGTLVTVSS (SEQ ID NO: 245) | PEDFATYYC**QQTNEDPYT**FGQGTKVEIK (SEQ ID NO: 246) |
| CEA-Cide | Labetu-zumab (MN-14) | CEACAM 5 | EVQLVESGGGVVQPGRSLRLSCSASGFDFT**TYWMS**WVRQAPGKGLEWIG**EIHPDSSTINYAPSLKD**RFTISRDNAKNTLFLQMDSLRPEDTGVYFCAS**LYFGFPWFAY**WGQGTPVTVSS (SEQ ID NO: 247) | DIQLTQSPSSLSASVGDRVTITC**KASQDVGTSVA**WYQQKPGKAPKLLIY**WTSTRHT**GVPSRFSGSGSGTDFTFTISSLQPEDIATYYC**QQYSLYRS**FGQGTKVEIK (SEQ ID NO: 248) |
| CEA-Scan | arcitu-momab | CEACAM 5 | EVKLVESGGGLVQPGGSLRLSCATS**GFTFTDYYMN**WVRQPPGKALEWLG**FIGNKANGYTTEYSAS**VKGRFTISRDKSQSILYLQMNTLRAEDSA**TYYCTRDR**GLRFYFDYWGQGTTLTVSS (SEQ ID NO: 249) | QTVLSQSPAILSASPGEKVTMTC**RASSSVTYIHW**YQQKPGSSPKSWIYA**TSNLASG**VPARFSGSGSGTSYSLTISRVEAEDAATYYC**QHWSSKPPT**FGGGTKLEIKR (SEQ ID NO: 250) |
| MT110 | | CEACAM 5 | EVQLVESGGGLVQPGRSLRLSCAASGFTVS**SYWMH**WVRQAPGKGLEVVVG**FIRNKANGGTTEYAASVKG**RFTISRDDSKNTLYLQMNSLRAEDTAVYYCAR**DRGLRFYFDY**WGQGTTVTVSS (SEQ ID NO: 251) | QAVLTQPASLSASPGASASLTC**TLRRGINVGAYSIY**WYQQKPGSPPQYLLR**YKSDSDKQQGS**GVSSRFSASKDASANAGILLISGLQSEDEADYYC**MIWHSGASAV**FGGGTKLTVL (SEQ ID NO: 252) |
| MT103 | blinatu-momab | CD19 | QVQLQQSGAELVRPGSSVKISCKASGYAFS**SYWMN**WVKQRPGQGLEWIG**QIWPGDGDTNYNGKFKG**KATLTADESSSTAYMQLSSLASEDSAVYFCAR**RETTTVGRYYYAMDY**WGQGTTVTVSS (SEQ ID NO: 253) | DIQLTQSPASLAVSLGQRATISC**KASQSVDYDGDSY**LNWYQQIPGQPPKLLI**YDASNLVS**GIPPRFSGSGSGTDFTLNIHPVEKVDAATYHC**QQSTEDPWT**FGGGTKLEIK (SEQ ID NO: 254) |
| Arzerra | ofatu-mumab | CD20 | EVQLVESGGGLVQPGRSLRLSCAASGFTFN**DYAMH**WVRQAPGKGLEWVS**TISWNSGSIGYADSVKG**RFTISRDNAKKSLYLQMNSLRAEDTALYYCAK**DIQYGNYYYGMDV**WGQGTTVTVSS (SEQ ID NO: 255) | EIVLTQSPATLSLSPGERATLSC**RASQSVSSYLA**WYQQKPGQAPRLLIY**DASNRAT**GIPARFSGSGSGTDFTLTISSLEPEDFAVYYC**QQRSNWPIT**FGQGTRLEIK (SEQ ID NO: 256) |
| Bexxar ™ | tositu-momab | CD20 | QAYLQQSGAELVRPGASVKMSCKASGYTFT**SYNMH**WVKQTPRQGLEWIG**AIYPGNGDTSYNQKFKG**KATLTVDKSSSTAYMQLSSLTSEDSAVYFCAR**VVYYSNSYWYFDV**WGTGTTVTVSG (SEQ ID NO: 257) | QIVLSQSPAILSASPGEKVTMTC**RASSSVSYMH**WYQQKPGSSPKPWIY**APSNLAS**GVPARFSGSGSGTSYSLTISRVEAEDAATYYC**QQWSFNPPT**FGAGTKLELK (SEQ ID NO: 258) |
| GAZYVA | Obinutu-zumab | CD20 | QVQLVQSGAEVKKPGSSVKVSCKASGYAFS**YSWIN**WVRQAPGQGLEWMG**RIFPGDGDTDYNGKFKG**RVTITADKSTSTAYMELSSLRSEDTAVYYCAR**NVFDGYWLVY**WGQGTLVTVSS (SEQ ID NO: 259) | DIVMTQTPLSLPVTPGEPASISC**RSSKSLLHSNGITYLY**WYLQKPGQSPQLLIY**QMSNLVS**GVPDRFSGSGSGTDFTLKISRVEAEDVGVYYC**AQNLELPYT**FGGGTKVEIK (SEQ ID NO: 260) |

TABLE 5-continued

Reference Antibody Sequences

| Trade Name | Antibody Name | Target Cell Marker | VH Sequence | VL Sequence |
|---|---|---|---|---|
| | Ocrelizumab/ 2H7 v16 | CD20 | EVQLVESGGGLVQPGGSLRLSCAAS**GYTFTSYN**MHWVRQAPGKGLEWVGA**IYPGNGDT**SYNQKFKGRFTISVDKSKNTLYLQMNSLRAEDTAVYYCAR**VVYYSNSYWYFDV**WGQGTLVTVSS (SEQ ID NO: 261) | DIQMTQSPSSLSASVGDRVTITC**RASSSVSYMH**WYQQKPGKAPKPLIY**APSNLAS**GVPSRFSGSGSGTDFTLTISSLQPEDFATYYC**QQWSFNPPT**FGQGTKVEIK (SEQ ID NO: 262) |
| Rituxan ™ | rituximab | CD20 | QVQLQQPGAELVKPGASVKMSCKAS**GYTFTSYN**MHWVKQTPGRGLEWIGAI**YPGNGDT**SYNQKFKGKATLTADKSSSTAYMQLSSLTSEDSAVYYC**ARSTYYGGDWYFNV**WGAGTTVTVSA (SEQ ID NO: 263) | QIVLSQSPAILSASPGEKVTMTCRAS**SSVSY**IHWFQQKPGSSPKPWIY**ATS**NLASGVPVRFSGSGSGTSYSLTISRVEAEDAATYYC**QQWTSNPPT**FGGGTKLEIK (SEQ ID NO: 264) |
| Zevalin ™ | ibritumomab tieuxetan | CD20 | QAYLQQSGAELVRPGASVKMSCKAS**GYTFTSYN**MHWVKQTPRQGLEWIG**AIYPGNGDTSYNQKF**KGKATLTVDKSSSTAYMQLSSLTSEDSAVYFCAR**VVYYSNSYWYFDV**WGTGTTVTVSA (SEQ ID NO: 265) | QIVLSQSPAILSASPGEKVTMTC**RASSSVSYMH**WYQQKPGSSPKPWIY**APSNLAS**GVPARFSGSGSGTSYSLTISRVEAEDAATYYC**QQWSFNPPT**FGAGTKLELK (SEQ ID NO: 266) |
| Mylotarg | Gemtuzumab (hP67.6) | CD33 | QLVQSGAEVKKPGSSVKVSCKAS**GYTITDSNIH**WVRQAPGQSLEWIG**YIYPYNGGTDYNQKFKN**RATLTVDNPTNTAYMELSSLRSEDTDFYYCVN**GNPWLAY**WGQGTLVTVSS (SEQ ID NO: 267) | DIQLTQSPSTLSASVGDRVTITC**RASESLDNYGIRFLT**WFQQKPGKAPKLLMY**AASNQGS**GVPSRFSGSGSGTEFTLTISSLQPDDFATYYC**QQTKEVPWS**FGQGTKVEVK (SEQ ID NO: 268) |
| Daratumumab | | CD38 | EVQLLESGGGLVQPGGSLRLSCAVS**GFTFNSFA**MSWVRQAPGKGLEWVSA**ISGSGGGT**YYADSVKGRFTISRDNSKNTLYLQMNSLRAEDTAVYFC**AKDKILWFGEPVFDY**WGQGTLVTVSS (SEQ ID NO: 269) | EIVLTQSPATLSLSPGERATLSCRAS**QSVSSY**LAWYQQKPGQAPRLLIY**DAS**NRATGIPARFSGSGSGTDFTLTISSLEPEDFAVYYC**QQRSNWPPT**FGQGTKVEIK (SEQ ID NO: 270) |
| | 1F6 | CD70 | QIQLVQSGPEVKKPGETVKISCKAS**GYTFTNYGMN**WVKQAPGKGLKVVMG**WINTYTGEPTYADAFKG**RFAFSLETSASTAYLQINNLKNEDTATYFCAR**DYGDYGMDY**WGQGTSVTVSS (SEQ ID NO: 271) | DIVLTQSPASLAVSLGQRATISC**RASKSVSTSGYSFMH**WYQQKPGQPPKLLIY**LASNLES**GVPARFSGSGSGTDFTLNIHPVEEEDAATYYC**QHSREVPWT**FGGGTKLEIK (SEQ ID NO: 272) |
| | 2F2 | CD70 | QVQLQQSGTELMTPGASVTMSCKTS**GYTFSTYWIE**WVKQRPGHGLEWIG**EI**I**LGPSGYTDYNEKFKA**KATFTADTSSNTAYMQLSSLASEDSAVYYCAR**WDRLYAMDY**WGGGTSVTVSS (SEQ ID NO: 273) | DIVLTQSPASLTVSLGQKTTISC**RASKSVSTSGYSFMH**WYQLKPGQSPKLLIY**LASDLPS**GVPARFSGSGSGTDFTLKIHPVEEEDAATYYC**QHSREIDYT**FGGGTKLEIT (SEQ ID NO: 274) |
| | 2H5 | CD70 | QVQLVESGGGVVQPGRSLRLSCAASGFTFS**SYIMH**WVRQAPGKGLEWVA**VISYDGRNKYYADSVKG**R | EIVLTQSPATLSLSPGERATLSC**RASQSVSSYLA**WYQQKPGQAPRLLI**YDASNRA**TGIPARFSGS |

TABLE 5-continued

| Reference Antibody Sequences | | | | |
|---|---|---|---|---|
| Trade Name | Antibody Name | Target Cell Marker | VH Sequence | VL Sequence |
| | | | FTISRDNSKNTLYLQMNS<br>LRAED<br>TAVYYCAR**DTDGYDFDY**<br>WGQGTLVTVSS<br>(SEQ ID NO: 275) | GSGTDFTLTISSLEPED<br>FAVYYC**QQ**<br>**RTNWPLT**FGGGTKVEI<br>K<br>(SEQ ID NO: 276) |
| | 10B4 | CD70 | QIQLVESGGGVVQPGRS<br>LRLSCAASGFTFG**YYAM**<br>**H**WVRQAPGKGLEWVA**VI**<br>**SYDGSIKYYADSVKG**RF<br>TISRDNSKNTLYLQMNSL<br>RAED<br>TAVYYCAR**EGPYSNYLD**<br>**Y**WGQGTLVTVSS<br>(SEQ ID NO: 277) | AIQLTQSPSSLSASVGD<br>RVTITC**RASQGISSALA**<br>WYQQKPGKAPKFLIY**D**<br>**ASSLES**GVPSRFSGSG<br>SGTDFTLTISSLQPEDF<br>ATYYC**QQ**<br>**FNSYPFT**FGPGTKVDIK<br>(SEQ ID NO: 278) |
| | 8B5 | CD70 | QVQLVESGGGVVQPGR<br>SLRLSCATSGFTFS**DYG**<br>**MH**WVRQAPGKGLEWVA<br>**VIWYDGSNKYYADSVKG**<br>RFTISRDNSKKTLSLQMN<br>SLRAED<br>TAVYYCAR**DSIMVRGDY**<br>WGQGTLVTVSS<br>(SEQ ID NO: 279) | DIQMTQSPSSLSASVG<br>DRVTITC**RASQGISSW**<br>**LA**WYQQKPEKAPKSLI<br>Y**AASSLQS**GVPSRFSG<br>SGSGTDFTLTISSLQPE<br>DFATYYC**QQ**<br>**YNSYPLT**FGGGTKVEIK<br>(SEQ ID NO: 280) |
| | 18E7 | CD70 | QVQLVESGGGVVQPGR<br>SLRLSCAASGFTFS**DHG**<br>**MH**WVRQAPGKGLEWVA<br>**VIWYDGSNKYYADSVKG**<br>RFTISRDNSKNTLYLQMN<br>SLRAED<br>TAVYYCAR**DSIMVRGDY**<br>WGQGTLVTVSS<br>(SEQ ID NO: 281) | DIQMTQSPSSLSASVG<br>DRVTITC**RASQGISSW**<br>**LA**WYQQKPEKAPKSLI<br>Y**AASSLQS**GVPSRFSG<br>SGSGTDFTLTISSLQPE<br>DFATYYC**QQ**<br>**YNSYPLT**FGGGTKVEIK<br>(SEQ ID NO: 282) |
| | 69A7 | CD70 | QVQLQESGPGLVKPSET<br>LSLTCTVSGGSVS**SDYY**<br>**YWS**WIRQPPGKGLEWL<br>G**YIYYSGSTNYNPSLKS**<br>RVTISVDTSKNQFSLKLR<br>SVTTA<br>DTAVYYCAR**GDGDYGG**<br>**NCF**DYWGQGTLVTVSS<br>(SEQ ID NO: 283) | EIVLTQSPATLSLSPGE<br>RATLSC**RASQSVSSYL**<br>**A**WYQQKPGQAPRLLIF<br>**DASNRAT**GIPARFSGS<br>GSGTDFTLTISSLEPED<br>FAVYYC**QQ**<br>**RSNWPLT**FGGGTKVEI<br>K<br>(SEQ ID NO: 284) |
| CE-355621 | | cMET | QVQLVQSGAEVKKPGAS<br>VKVSCKASGYTFT**SYGF**<br>**S**WVRQAPGQGLEWMG<br>**WISASNGNTYYAQKLQG**<br>RVTMTTDTSTSTAYMEL<br>RSLRSDDTAVYYCAR**VY**<br>**ADYADY**WGQGTLVTVS<br>S<br>(SEQ ID NO: 285) | DIQMTQSPSSVSASVG<br>DRVTITC**RASQGINTW**<br>**LA**WYQQKPGKAPKLLI<br>Y**AASSLKS**GVPSRFSG<br>SGSGTDFTLTISSLQPE<br>DFATYYC**QQANSFPLT**<br>FGGGTKVEIK<br>(SEQ ID NO: 286) |
| LY2875358 | emibetuzumab | cMET | QVQLVQSGAEVKKPGAS<br>VKVSCKAS**GYTFTDYY**M<br>HWVRQAPGQGLEWMG<br>R**VNPNRRGTT**YNQKFEG<br>RVTMTTDTSTSTAYMEL<br>RSLRSDDTAVYYC**ARAN**<br>**WLDY**WGQGTTVTVSS<br>(SEQ ID NO: 287) | DIQMTQSPSSLSASVG<br>DRVTITCSVS**SSVSSIY**<br>LHWYQQKPGKAPKLLI<br>Y**STS**NLASGVPSRFSG<br>SGSGTDFTLTISSLQPE<br>DFATYYC**QVYSGYPLT**<br>FGGGTKVEIK<br>(SEQ ID NO: 288) |
| MetMAb | onartuzumab | cMET | EVQLVESGGGLVQPGG<br>SLRLSCAASGYTFT**SYW**<br>**LH**WVRQAPGKGLEWVG<br>**MIDPSNSDTRFNPNFKD**<br>RFTISADTSKNTAYLQMN<br>SLRAEDTAVYYC**ATYRS**<br>**YVTPLDY**WGQGTLVTVS<br>S<br>(SEQ ID NO: 289) | DIQMTQSPSSLSASVG<br>DRVTITC**KSSQSLLYTS**<br>**SQKNYLA**WYQQKPGK<br>APKLLIY**WASTRES**GV<br>PSRFSGSGSGTDFTLTI<br>SSLQPEDFATYYC**QQY**<br>**YAYPWT**FGQGTKVEIK<br>(SEQ ID NO: 290) |

TABLE 5-continued

Reference Antibody Sequences

| Trade Name | Antibody Name | Target Cell Marker | VH Sequence | VL Sequence |
|---|---|---|---|---|
| | tremeli-mumab (CP-675206, or 11.2.1) | CTLA4 | QVQLVESGGGVVQPGR SLRLSCAAS**GFTFSSYG** **MH**WVRQAPGKGLEWVA **VIWYDGSNKYYADSV**KG RFTISRDNSKNTLYLQMN SLRAEDTAVYYCAR**DPR** **GATLYYYYYGMDV**WGQ GTTVTVSS (SEQ ID NO: 291) | DIQMTQSPSSLSASVG DRVTITC**RASQSINSYL** **D**WYQQKPGKAPKLLIY **AASSLQS**GVPSRFSGS GSGTDFTLTISSLQPED FATYYC**QQYYSTPFT**F GPGTKVEIK (SEQ ID NO: 292) |
| Yervoy | Ipili-mumab 10D1 | CTLA4 | QVQLVESGGGVVQPGR SLRLSCAASGFTFS**SYT** **MH**WVRQAPGKGLEWVT **FISYDGNNKYYADSVKG** RFTISRDNSKNTLYLQMN SLRAEDTAIYYCAR**TGW** **LGPFDY**WGQGTLVTVSS (SEQ ID NO: 293) | EIVLTQSPGTLSLSPGE RATLSC**RASQSVGSSY** **LA**WYQQKPGQAPRLLI Y**GAFSRAT**GIPDRFSG SGSGTDFTLTISRLEPE DFAVYYC**QQYGSSPW** **T**FGQGTKVEIK (SEQ ID NO: 294) |
| AGS16 F | H16-7.8 | ENPP3 | QVQLQESGPGLVKPSQT LSLTCTVSGGSIS**SGGYY** WSWIRQHPGKGLEWIG**II** **YYSGSTYYNPSLKS**RVTI SVDTSKNQFSLKLNSVT AADTAVFYCAR**VAIVTTI** **PGGMDV**WGQGTTVTVS S (SEQ ID NO: 295) | EIVLTQSPDFQSVTPKE KVTITC**RASQSIGISLH** WYQQKPDQSPKLLIK**Y** **ASQSFS**GVPSRFSGSG SGTDFTLTINSLEAEDA ATYYC**HQSRSFPWT**FG QGTKVEIK (SEQ ID NO: 296) |
| MT110 | solit-omab | EpCAM | EVQLLEQSGAELVRPGT SVKISCKASGYAFT**NYW** **LG**WVKQRPGHGLEWIG **DIFPGSGNIHYNEKFKG**K ATLTADKSSSTAYMQLS SLTFEDSAVYFCAR**LRN** **WDEPMDY**WGQGTTVTV SS (SEQ ID NO: 297) | ELVMTQSPSSLTVTAG EKVTMSC**KSSQSLLNS** **GNQKNYLT**WYQQKPG QPPKLLIY**WASTRES**G VPDRFTGSGSGTDFTL TISSVQAEDLAVYYC**Q** **NDYSYPLT**FGAGTKLEI K (SEQ ID NO: 298) |
| MT201 | Adecatu-mumab | EpCAM | EVQLLESGGGVVQPGRS LRLSCAASGFTFS**SYGM** **H**WVRQAPGKGLEWVA**VI** **SYDGSNKYYADSVKG**R FTISRDNSKNTLYLQMNS LRAEDTAVYYCAK**DMG** **WGSGWRPYYYYGMDV** WGQGTTVTVSS (SEQ ID NO: 299) | ELQMTQSPSSLSASVG DRVTITC**RTSQSISSYL** **N**WYQQKPGQPPKLLIY **WASTRES**GVPDRFSG SGSGTDFTLTISSLQPE DSATYYC**QQSYDIPYT** FGQGTKLEIK (SEQ ID NO: 300) |
| Panore x | Edrecol-omab Mab CO17-1A | EpCAM | QVQLQQSGAELVRPGTS VKVSCKAS**GYAFTNYL**IE WVKQRPGQGLEWIGV**IN** **PGSGGT**NYNEKFKGKAT LTADKSSSTAYMQLSSLT SDDSAVYFC**ARDGPWF** **AY**WGQGTLVTVSA (SEQ ID NO: 301) | NIVMTQSPKSMSMSVG ERVTLTCKAS**ENVVTY** VSWYQQKPEQSPKLLI Y**GAS**NRYTGVPDRFTG SGSATDFTLTISSVQAE DLADYHC**GQGYSYPYT** FGGGTKLEIK (SEQ ID NO: 302) |
| | tucotu-zumab | EpCAM | QIQLVQSGPELKKPGET VKISCKAS**GYTFTNYGM** **N**WVRQAPGKGLKVVMG **WINTYTGEPTYAD**DFKG RFVFSLETSASTAFLQLN NLRSEDTATYFCVRFI**SK** **GDY**YWGQGTSVTVSS (SEQ ID NO: 303) | QILLTQSPAIMSASPGE KVTMTC**SASSSVS**YML WYQQKPGSSPKPWIF **DTSNLAS**GFPARFSGS GSGTSYSLIISSMEAED AATYYC**HQRSGYPYT**F GGGTKLEIK (SEQ ID NO: 304) |
| UBS-54 | | EpCAM | VQLQQSDAELVKPGASV KISCKAS**GYTFTDHAIH**W VKQNPEQGLEWIG**YFSP** | DIVMTQSPDSLAVSLG ERATINC**KSSQSVLYS** **SNNKNYLA**WYQQKPG |

TABLE 5-continued

| Reference Antibody Sequences | | | | |
|---|---|---|---|---|
| Trade Name | Antibody Name | Target Cell Marker | VH Sequence | VL Sequence |
| | | | **GNDDFKYNE**RFKGKATL<br>TADKSSSTAYVQLNSLTS<br>EDSAVYFCTR**SLNMAY**<br>WGQGTSVTVSS<br>(SEQ ID NO: 305) | QPPKLLIY**WASTRES**G<br>VPDRFSGSGSGTDFTL<br>TISSLQAEDVAVYYC**Q**<br>**QYYSYPLT**FGGGTKVK<br>ES<br>(SEQ ID NO: 306) |
| 3622W 94 | 323/A3 | EpCAM | EVQLVQSGPEVKKPGAS<br>VKVSCKAS**GYTFTNYGM**<br>**N**WVRQAPGQGLEWMG<br>**WINTYTGEPTYGE**DFKG<br>RFAFSLDTSASTAYMELS<br>SLRSEDTAVYFCARFG**N**<br>**YVDY**WGQGSLVTVSS<br>(SEQ ID NO: 307) | DIVMTQSPLSLPVTPGE<br>PASISC**RSSINKKGSNG**<br>**ITY**LYWYLQKPGQSPQ<br>LLIYQMSNLASGVPDRF<br>**SGSGS**GTDFTLKISRVE<br>AEDVGVYYC**AQNLEIP**<br>**RT**FGQGTKVEIK<br>(SEQ ID NO: 308) |
| 4D5M OCBv2 | | EpCAM | EVQLVQSGPGLVQPGG<br>SVRISCAASGYTFT**NYG**<br>**MN**WVKQAPGKGLEWM<br>G**WINTYTGESTYADSFK**<br>**G**RFTFSLDTSASAAYLQI<br>NSLRAEDTAVYYCAR**FAI**<br>**KGD**YWGQGTLLTVSS<br>(SEQ ID NO: 309) | DIQMTQSPSSLSASVG<br>DRVTITC**RSTKSLLHSN**<br>**GITYLY**WYQQKPGKAP<br>KLLIY**QMSNLAS**GVPS<br>RFSSSGSGTDFTLTISS<br>LQPEDFATYYC**AQNLEI**<br>**PRT**FGQGTKVEIK<br>(SEQ ID NO: 310) |
| 4D5M OCB | | EpCAM | EVQLVQSGPGLVQPGG<br>SVRISCAASGYTFT**NYG**<br>**MN**WVKQAPGKGLEWM<br>G**WINTYTGESTYADSFK**<br>**G**RFTFSLDTSASAAYLQI<br>NSLRAEDTAVYYCAR**FAI**<br>**KGDY**WGQGTLLTVSS<br>(SEQ ID NO: 311) | DIQMTQSPSSLSASVG<br>DRVTITC**RSTKSLLHSN**<br>**GITYLY**WYQQKPGKAP<br>KLLIY**QMSNLAS**GVPS<br>RFSSSGSGTDFTLTISS<br>LQPEDFATYYC**AQNLEI**<br>**PRT**FGQGTKVELK<br>(SEQ ID NO: 312) |
| MEDI-547 | 1C1 | EphA2 | EVQLLESGGGLVQPGGS<br>LRLSCAASGFTFS**HYMM**<br>**A**WVRQAPGKGLEWVS**R**<br>**IGPSGGPTHYADSVKG**R<br>FTISRDNSKNTLYLQMNS<br>LRAEDTAVYYCAGYDSG<br>**YDYVAVAGPAEYFQH**W<br>GQGTLVTVSS<br>(SEQ ID NO: 313) | DIQMTQSPSSLSASVG<br>DRVTITCR**RASQSISTWL**<br>**A**WYQQKPGKAPKLLIY<br>**KASNLHT**GVPSRFSGS<br>GSGTEFSLTISGLQPDD<br>FATYYC**QQYNSYSRT**F<br>GQGTKVEIK<br>(SEQ ID NO: 314) |
| MORA b-003 | farletu-zumab | FOLR1 | EVQLVESGGGVVQPGR<br>SLRLSCSAS**GFTFSGYG**<br>LSWVRQAPGKGLEWVA<br>M**ISSGGSYT**YYADSVKG<br>RFAISRDNAKNTLFLQMD<br>SLRPEDTGVYFC**ARHGD**<br>**DPAWF**AYWGQGTPVTV<br>SS<br>(SEQ ID NO: 315) | DIQLTQSPSSLSASVGD<br>RVTITCSVS**SSISSNN**L<br>HWYQQKPGKAPKPWI<br>Y**GTS**NLASGVPSRFSG<br>SGSGTDYTFTISSLQPE<br>DIATYYC**QQWSSYPYM**<br>**YT**FGQGTKVEIK<br>(SEQ ID NO: 316) |
| M9346 A | huMOV1 9 (vLCv1.0 0) | FOLR1 | QVQLVQSGAEVVKPGAS<br>VKISCKASGYTFT**GYFM**<br>**N**WVKQSPGQSLEWIG**RI**<br>**HPYDGDTFYNQKFQG**K<br>ATLTVDKSSNTAHMELLS<br>LTSEDFAVYYCTR**YDGS**<br>**RAMDY**WGQGTTVTVSS<br>(SEQ ID NO: 317) | DIVLTQSPLSLAVSLGQ<br>PAIISC**KASQSVSFAGT**<br>**SLMH**WYHQKPGQQPR<br>LLIY**RASNLEA**GVPDRF<br>SGSGSKTDFTLNISPVE<br>AEDAATYYC**QQSREYP**<br>**YT**FGGGTKLEIK<br>(SEQ ID NO: 318) |
| M9346 A | huMOV1 9 (vLCv1.6 0) | FOLR1 | QVQLVQSGAEVVKPGAS<br>VKISCKASGYTFT**GYFM**<br>**N**WVKQSPGQSLEWIG**RI**<br>**HPYDGDTFYNQKFQG**K<br>ATLTVDKSSNTAHMELLS<br>LTSEDFAVYYCTR**YDGS**<br>**RAMD**WGQGTTVTVSS<br>(SEQ ID NO: 319) | DIVLTQSPLSLAVSLGQ<br>PAIISC**KASQSVSFAGT**<br>**SLMH**WYHQKPGQQPR<br>LLIY**RASNLEA**GVPDRF<br>SGSGSKTDFTLTISPVE<br>AEDAATYYC**QQSREYP**<br>**YT**FGGGTKLEIK<br>(SEQ ID NO: 320) |

TABLE 5-continued

Reference Antibody Sequences

| Trade Name | Antibody Name | Target Cell Marker | VH Sequence | VL Sequence |
|---|---|---|---|---|
| 26B3.F2 | | FOLR1 | GPELVKPGASVKISCKASDYSFT**GYFMN**WVMQSHGKSLEWIG**RIFPYNGDTFYNQKFKG**RATLTVDKSSSTAHMELRSLASEDSAVYFCAR**GTHYFDY**WGQGTTLTVSS (SEQ ID NO: 321) | PASLSASVGETVTITC**RTSENIFSYLA**WYQQKQGISPQLLVY**NAKTLAE**GVPSRFSGSGSGTQFSLKINSLQPEDFGSYYC**QHHYAFPWT**FGGGSKLEIK (SEQ ID NO: 322) |
| RG7686 | GC33 | GPC3 | QVQLVQSGAEVKKPGASVKVSCKASGYTFT**DYEMH**WVRQAPGQGLEWMG**ALDPKTGDTAYSQKFKG**RVTLTADKSTSTAYMELSSLTSEDTAVYYCTR**FYSYTY**WGQGTLVTVSS (SEQ ID NO: 323) | DVVMTQSPLSLPVTPGEPASISC**RSSQSLVHSNGNTYLH**WYLQKPGQSPQLLIY**KVSNRFS**GVPDRFSGSGSGTDFTLKISRVEAEDVGVYYC**SQNTHVPPT**FGQGTKLEIK (SEQ ID NO: 324) |
| | 4A6 | GPC3 | EVQLVQSGAEVKKPGESLKISCKGSGYSFT**SYWIA**WVRQMPGKGLEWMG**IIFPGDSDTRYSPSFQG**QVTISADRSIRTAYLQWSSLKASDTALYYCAR**TREGYFDY**WGQGTLVTVSS (SEQ ID NO: 325) | EIVLTQSPGTLSLSPGERATLSC**RACQSVSSSYLA**WYQQKPGQAPRLLIY**GASSRAT**GIPDRFSGSGSGTDFTLTISRLEPEDFAVYYC**QQYGSSPT**FGGGTKVEIK (SEQ ID NO: 326) |
| | 11E7 | GPC3 | EVQLVQSGAEVKKPGESLKISCKGSGYSFT**NYWIA**WVRQMPGKGLEWMG**IIYPGDSDTRYSPSFQG**QVTISADKSIRTAYLQWSSLKASDTAMYYCAR**TREGYFDY**WGQGTLVTVSS (SEQ ID NO: 327) | EIVLTQSPGTLSLSPGERATLSC**RASQSVSSSYLA**WYQQKPGQAPRLLIY**GASSRAT**GIPDRFSGSGSGTDFTLTISRLEPEDFAVYYC**QQYGSSPT**FGGGTKVEIK (SEQ ID NO: 328) |
| | 16D10 | GPC3 | EVQLVQSGADVTKPGESLKISCKVSGYRFT**NYWIG**WMRQMSGKGLEWMG**IIYPGDSDTRYSPSFQG**HVTISADKSINTAYLRWSSLKASDTAIYYCAR**TREGFFDY**WGQGTPVTVSS (SEQ ID NO: 329) | EILLTQSPGTLSLSPGERATLSC**RASQSVSSSYLA**WYQQKPGQAPRLLIY**GASSRAT**GIPDRFSGSGSGTDFTLTISRLEPEDFAVYYC**QQYGSSPT**FGQGTKVEIK (SEQ ID NO: 330) |
| AMG-595 | | EGFR | QVQLVESGGGVVQSGRSLRLSCAAS**GFTFRNYGMH**WVRQAPGKGLEW**VAVIWYDGSDKYYADSVRG**RFTISRDNSKNTLYLQMNSLRAEDTAVYYCARDGY**DILTGNPRDFDY**WGQGTLVTVSS (SEQ ID NO: 331) | DTVMTQTPLSSHVTLGQPASISC**RSSQSLVHSDGNTYLS**WLQQRPGQPPRLLIY**RISRRFS**GVPDRFSGSGAGTDFTLEISRVEAEDVGVYYC**MQSTHVPRT**FGQGTKVEIK (SEQ ID NO: 332) |
| Erubitux ™ | cetuximab | EGFR | QVQLKQSGPGLVQPSQSLSITCTVS**GFSLTNYG**VHWVRQSPGKGLEWLGV**IWSGGNT**DYNTPFTSRLSINKDNSKSQVFFKMNSLQSNDTAIYYC**ARALTYYDYEFAY**WGQGTLVTVSA (SEQ ID NO: 333) | DILLTQSPVILSVSPGERVSFSCRAS**QSIGTN**IHWYQQRTNGSPRLLIK**YAS**ESISGIPSRFSGSGSGTDFTLSINSVESEDIADYYC**QQNNNWPTT**FGAGTKLELK (SEQ ID NO: 334) |
| GA201 | Imgatuzumab | EGFR | QVQLVQSGAEVKKPGSSVKVSCKASGFTFT**DYKIH**WVRQAPGQGLEWMG**YFNPNSGYSTYAQKFQG**RVTITADKSTSTAYMELSS | DIQMTQSPSSLSASVGDRVTITC**RASQGINNYLN**WYQQKPGKAPKRLIY**NTNNLQT**GVPSRFSGSGSGTEFTLTISSLQPED |

TABLE 5-continued

Reference Antibody Sequences

| Trade Name | Antibody Name | Target Cell Marker | VH Sequence | VL Sequence |
|---|---|---|---|---|
| | | | LRSEDTAVYYCAR**LSPGGYYVMDA**WGQGTTVTVSS (SEQ ID NO: 335) | FATYYC**LQHNSFPT**FGQGTKLEIK (SEQ ID NO: 336) |
| Humax | zalutu-mumab | EGFR | QVQLVESGGGVVQPGRSLRLSCAASGFTFS**TYGMH**WVRQAPGKGLEWVA**VIWDDGSYKYYGDSVKG**RFTISRDNSKNTLYLQMNSLRAEDTAVYYCAR**DGITMVRGVMKDYFDY**WGQGTLVTVSS (SEQ ID NO: 337) | AIQLTQSPSSLSASVGDRVTITC**RASQDISSALV**WYQQKPGKAPKLLIY**DASSLES**GVPSRFSGSESGTDFTLTISSLQPEDFATYYC**QQFNSYPLT**FGGGTKVEIK (SEQ ID NO: 338) |
| IMC-11F8 | necitu-mumab | EGFR | QVQLQESGPGLVKPSQTLSLTCTVSGGSIS**SGDYYWS**WIRQPPGKGLEWIG**YIYYSGSTDYNPSLKS**RVTMSVDTSKNQFSLKVNSVTAADTAVYYCAR**VSIFGVGTFDY**WGQGTLVTVSS (SEQ ID NO: 339) | EIVMTQSPATLSLSPGERATLSC**RASQSVSSYLA**WYQQKPGQAPRLLIY**DASNRAT**GIPARFSGSGSGTDFTLTISSLEPEDFAVYYC**HQYGSTPLT**FGGGTKAEIK (SEQ ID NO: 340) |
| MM-151 | P1X | EGFR | QVQLVQSGAEVKKPGSSVKVSCKASGGTFS**SYAIS**WVRQAPGQGLEWMG**SIIPIFGTVNYAQKFQG**RVTITADESTSTAYMELSSLRSEDTAVYYCAR**DPSVNLYWYFDL**WGRGTLVTVSS (SEQ ID NO: 341) | DIQMTQSPSTLSASVGDRVTITC**RASQSISSWWA**WYQQKPGKAPKLLIY**DASSLES**GVPSRFSGSGSGTEFTLTISSLQPDDFATYYC**QQYHAHPTT**FGGGTKVEIK (SEQ ID NO: 342) |
| MM-151 | P2X | EGFR | QVQLVQSGAEVKKPGSSVKVSCKASGGTFG**SYAIS**WVRQAPGQGLEWMG**SIIPIFGAANPAQKSQG**RVTITADESTSTAYMELSSLRSEDTAVYYCAK**MGRGKVAFDI**WGQGTMVTVSS (SEQ ID NO: 343) | DIVMTQSPDSLAVSLGERATINC**KSSQSVLYSPNNKNYLA**WYQQKPGQPPKLLIY**WASTRES**GVPDRFSGSGSGTDFTLTISSLQAEDVAVYYC**QQYYGSPIT**FGGGTKVEIK (SEQ ID NO: 344) |
| MM-151 | P3X | EGFR | QVQLVQSGAEVKKPGASVKVSCKASGYAFT**SYGIN**WVRQAPGQGLEWMG**WISAYNGNTYYAQKLRG**RVTMTTDTSTSTAYMELRSLRSDDTAVYYCAR**DLGGYGSGSVPFDP**WGQGTLVTVSS (SEQ ID NO: 345) | EIVMTQSPATLSVSPGERATLSC**RASQSVSSNLA**WYQQKPGQAPRLLIY**GASTRAT**GIPARFSGSGSGTEFTLTISSLQSEDFAVYYC**QDYRTWPRRV**FGGGTKVEIK (SEQ ID NO: 346) |
| TheraCIM | nimotu-zumab | EGFR | QVQLQQSGAEVKKPGSSVKVSCKASGYTFT**NYYIY**WVRQAPGQGLEWIG**GINPTSGGSNFNEKFKT**RVTITADESSTTAYMELSSLRSEDTAFYFCTR**QGLWFDSDRGFDF**WGQGTTVTVSS (SEQ ID NO: 347) | DIQMTQSPSSLSASVGDRVTITC**RSSQNIVHSNGNTYLD**WYQQTPGKAPKLLIY**KVSNRFS**GVPSRFSGSGSGTDFTFTISSLQPEDIATYYC**FQYSHVPWT**FGQGTKLQIT (SEQ ID NO: 348) |
| Vecti-bix ™ | panitu-mimab | EGFR | QVQLQESGPGLVKPSETLSLTCTVS**GGSVSSGDYY**WTWIRQSPGKGLEWIGH**IYYSGNT**NYNPSLKSRLTISIDTSKTQFSLKLSSVTAADTAIYYC**VRDRVTGAFDI**WGQGTMVTVSS (SEQ ID NO: 349) | DIQMTQSPSSLSASVGDRVTITCQAS**QDISNY**LNWYQQKPGKAPKLLIY**DAS**NLETGVPSRFSGSGSGTDFTFTISSLQPEDIATYFC**QHFDHLPLA**FGGGTKVEIK (SEQ ID NO: 350) |

TABLE 5-continued

Reference Antibody Sequences

| Trade Name | Antibody Name | Target Cell Marker | VH Sequence | VL Sequence |
| --- | --- | --- | --- | --- |
| 07D06 | | EGFR | QIQLVQSGPELKKPGETVKISCKAS**GYTFTEYP**IHWVKQAPGKGFKVVMGM**IYTDIGKP**TYAEEFKGRFAFSLETSASTAYLQINNLKNEDTATYFC**VRDRYDSLFDY**WGQGTTLTVSS (SEQ ID NO: 351) | DVVMTQTPLSLPVSLGDQASISCRSS**QSLVHSNGNTY**LHWYLQKPGQSPKLLIY**KVSNR**FSGVPDRFSGSGSGTDFTLKISRVEAEDLGVYFC**SQSTHVPWT**FGGGTKLEIK (SEQ ID NO: 352) |
| 12D03 | | EGFR | EMQLVESGGGFVKPGGSLKLSCAASGFAFS**HYDMS**WVRQTPKQRLEWVA**YIASGGDITYYADTVKG**RFTISRDNAQNTLYLQMSSLKSEDTAMFYCSR**SSYGNNGDALDF**WGQGTSVTVSS (SEQ ID NO: 353) | DVVMTQTPLSLPVSLGDQASISC**RSSQSLVHSNGNTYLH**WYLQKPGQSPKLLIY**KVSNRFS**GVPDRFSGSGSGTDFTLKISRVEAEDLGVYFC**SQSTHVLT**FGSGTKLEIK (SEQ ID NO: 354) |
| | C1 | HER2 | QVQLVESGGGLVQPGGSLRLSCAASGFTFS**SYAMG**WVRQAPGKGLEWVS**SISGSSRYIYYADSVKG**RFTISRDNSKNTLYLQMNSLRAEDTAVYYCAK**MDASGSYFNE**WGQGTLVTVSS (SEQ ID NO: 355) | QSPSFLSAFVGDRITITC**RASPGIRNYLA**WYQQKPGKAPKLLIY**AASTLQS**GVPSRFSGSGSGTDFTLTISSLQPEDFATYYC**QQYNSYPLS**FGGGTKVEIK (SEQ ID NO: 356) |
| Erbicin | | HER2 | QVQLLQSAAEVKKPGESLKISCKGSGYSFT**SYWIG**WVRQMPGKGLEWMG**IIYPGDSDTRYSPSFQG**QVTISADKSISTAYLQWSSLKASDTAVYYCAR**WRDSPL**WGQGTLVTVSS (SEQ ID NO: 357) | QAVVTQEPSFSVSPGGTVTLTC**GLSSGSVSTSYYPS**WYQQTPGQAPRTLIY**STNTRSS**GVPDRFSGSILGNKAALTITGAQADDESDYYC**VLYMGSGQYV**FGGGTKLTVL (SEQ ID NO: 358) |
| Hercep-tin | trastu-zumab | HER2 | EVQLVESGGGLVQPGGSLRLSCAAS**GFNIKDTY**IHWVRQAPGKGLEWVAR**IYPTNGYT**RYADSVKGRFTISADTSKNTAYLQMNSLRAEDTAVYYC**SRWGGDGFYAMDY**WGQGTLVTVSS (SEQ ID NO: 359) | DIQMTQSPSSLSASVGDRVTITCRAS**QDVNTA**VAWYQQKPGKAPKLLIY**SAS**FLYSGVPSRFSGSRSGTDFTLTISSLQPEDFATYYC**QQHYTTPPT**FGQGTKVEIK (SEQ ID NO: 360) |
| MAGH 22 | margetu-ximab | HER2 | QVQLQQSGPELVKPGASLKLSCTAS**GFNIKDTY**IHWVKQRPEQGLEWIGR**IYPTNGYT**RYDPKFQDKATITADTSSNTAYLQVSRLTSEDTAVYYC**SRWGGDGFYAMDY**WGQGASVTVSS (SEQ ID NO: 361) | DIVMTQSHKFMSTSVGDRVSITCKAS**QDVNTA**VAWYQQKPGHSPKLLIY**SAS**FRYTGVPDRFTGSRSGTDFTFTISSVQAEDLAVYYC**QQHYTTPPT**FGGGTKVEIK (SEQ ID NO: 362) |
| MM-302 | F5 | HER2 | QVQLVESGGGLVQPGGSLRLSCAASGFTFR**SYAMS**WVRQAPGKGLEWVS**AISGRGDNTYYADSVKG**RFTISRDNSKNTLYLQMNSLRAEDTAVYYC**AKMTSNAFAFDY**WGQGTLVTVSS (SEQ ID NO: 363) | QSVLTQPPSVSGAPGQRVTISC**TGSSSNIGAGYGVH**WYQQLPGTAPKLLIY**GNTNRPS**GVPDRFSGFKSGTSASLAITGLQAEDEADYYC**QFYDSSLSGWV**FGGGTKLTVL (SEQ ID NO: 364) |
| Perjeta | pertu-zumab | HER2 | EVQLVESGGGLVQPGGSLRLSCAAS**GFTFTDYT**MDWVRQAPGKGLEWVAD**VNPNSGGS**IYNQRFKGRFTLSVDRSKNTLYLQMNSLRAEDTAVYYC**ARNL** | DIQMTQSPSSLSASVGDRVTITCKASQ**DVSIG**VAWYQQKPGKAPKLLIY**SAS**YRYTGVPSRFSGSGSGTDFTLTISSLQPEDFATYYC**QQYYIYPYT**FG |

TABLE 5-continued

Reference Antibody Sequences

| Trade Name | Antibody Name | Target Cell Marker | VH Sequence | VL Sequence |
|---|---|---|---|---|
| | | | **GPSFYFDY**WGQGTLVTVSS (SEQ ID NO: 365) | QGTKVEIK (SEQ ID NO: 366) |
| MM-121/SAR256212 | | HER3 | EVQLLESGGGLVQPGGSLRLSCAASGFTFS**HYVMA**WVRQAPGKGLEWVS**SISSSGGWTLYADSVKG**RFTISRDNSKNTLYLQMNSLRAEDTAVYYCTR**GLKMATIFDY**WGQGTLVTVSS (SEQ ID NO: 367) | QSALTQPASVSGSPGQSITISC**TGTSSDVGSYNVVS**WYQQHPGKAPKLIIY**EVSQRPS**GVSNRFSGSKSGNTASLTISGLQTEDEADYYC**CSYAGSSIFVI**FGGGTKVTVL (SEQ ID NO: 368) |
| MEHD 7945A | Duligo-tumab | EGFR/HER3 | EVQLVESGGGLVQPGGSLRLSCAASGFTL**GDWIH**WVRQAPGKGLEWVG**EISAAGGYTDYADSVKG**RFTISADTSKNTAYLQMNSLRAEDTAVYYCAR**ESRVSFEAAMDY**WGQGTLVTVSS (SEQ ID NO: 369) | DIQMTQSPSSLSASVGDRVTITC**RASQNIATDVA**WYQQKPGKAPKLLIY**SASFLYS**GVPSRFSGSGSGTDFTLTISSLQPEDFATYYC**QQSEPEPYT**FGQGTKVEIK (SEQ ID NO: 370) |
| MM-111 | | HER2/3 | QVQLQESGGGLVKPGGSLRLSCAASGFTFS**SYWMS**WVRQAPGKGLEWVA**NINRDGSASYYVDSVKG**RFTISRDDAKNSLYLQMNSLRAEDTAVYYCAR**DRGVGYFDL**WGRGTLVTVSS (SEQ ID NO: 371) | QSALTQPASVSGSPGQSITISC**TGTSSDVGGYNFVS**WYQQHPGKAPKLMIY**DVSDRPS**GVSDRFSGSKSGNTASLIISGLQADDEADYYC**SSYGSSSTHVI**FGGGTKVTVL (SEQ ID NO: 372) |
| MM-111 | | HER2/3 | QVQLVQSGAEVKKPGESLKISCKGSGYSFT**SYWIA**WVRQMPGKGLEYMG**LIYPGDSDTKYSPSFQG**QVTISVDKSVSTAYLQWSSLKPSDSAVYFCAR**HDVGYCTDRTCAKWPEWLGV**WGQGTLVTVSS (SEQ ID NO: 373) | QSVLTQPPSVSAAPGQKVTISC**SGSSSNIGNNYVS**WYQQLPGTAPKLLIY**DHTNRPA**GVPDRFSGSKSGTSASLAISGFRSEDEADYYC**ASWDYTLSGWV**FGGGTKLTVL (SEQ ID NO: 374) |
| | Hu3S193 | Lewis-Y | EVQLVESGGGVVQPGRSLRLSCSTSGFTFS**DYYMY**WVRQAPGKGLEWVA**YMSNVGAITDYPDTVKG**RFTISRDNSKNTLFLQMDSLRPEDTGVYFCAR**GTRDGSWFAY**WGQGTPVTVSS (SEQ ID NO: 375) | DIQMTQSPSSLSASVGDRVTITC**RSSQRIVHSNGNTYLE**WYQQTPGKAPKLLIY**KVSNRFS**GVPSRFSGSGSGTDFTFTISSLQPEDIATYYC**FQGSHVPFT**FGQGTKLQIT (SEQ ID NO: 376) |
| BAY 94-9343 | anetu-mab ravtan-sine | Meso-thelin | QVELVQSGAEVKKPGESLKISCKGS**GYSFTSYW**IGWVRQAPGKGLEWMGI**IDPGDSRT**RYSPSFQGQVTISADKSISTAYLQWSSLKASDTAMYYC**ARGQLYGGTYMDG**WGQGTLVTVSS (SEQ ID NO: 377) | DIALTQPASVSGSPGQSITISCTGT**SSDIGGYNS**VSWYQQHPGKAPKLMIY**GVN**NRPSGVSNRFSGSKSGNTASLTISGLQAEDEADYYC**SSYDIESATPV**FGGGTKLTVL (SEQ ID NO: 378) |
| | SS1 | Meso-thelin | QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSS (SEQ ID NO: 379) | DIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEIK (SEQ ID NO: 380) |
| | | Meso-thelin | QVYLVESGGGVVQPGRSLRLSCAASGITFS**IYGMH**WVRQAPGKGLEWVA**VI** | EIVLTQSPATLSLSPGERATLSC**RASQSVSSYLA**WYQQKPGQAPRLLIY |

TABLE 5-continued

Reference Antibody Sequences

| Trade Name | Antibody Name | Target Cell Marker | VH Sequence | VL Sequence |
| --- | --- | --- | --- | --- |
| | | | **WYDGSHEYYADSVKG**RFTISRDNSKNTLYLLMNSLRAEDTAVYYCARDG**DGDYYDSGSPLDY**WGQGTLVTVSS (SEQ ID NO: 381) | **DASNRAT**GIPARFSGSGSGTDFTLTISSLEPEDFAVYYC**QQRSNWPLT**FGGGTKVEIK (SEQ ID NO: 382) |
| | | Mesothelin | QVHLVESGGGVVQPGRSLRLSCVASGITF**RIYGM**HWVRQAPGKGLEWVA**VLWYDGSHEYYADSVKG**RFTISRDNSKNTLYLQMNSLRAEDTAIYYCAR**DGDYYDSGSPLDY**WGQGTLVTVSS (SEQ ID NO: 383) | EIVLTQSPATLSLSPGERATLSC**RASQSVSSYLA**WYQQKPGQAPRLLIY**DASNRAT**GIPARFSGSGSGTDFTLTISSLEPEDFAVYYC**QQRSNWPLT**FGGGTKVEIK (SEQ ID NO: 384) |
| | | Mesothelin | EVHLVESGGGLVQPGGSLRLSCAASGFTFS**RYWMS**WVRQAQGKGLEWVA**SIKQAGSEKTYVDSVKG**RFTISRDNAKNSLSLQMNSLRAEDTAVYYCAR**EGAYYYDSASYYPYYYYYSMDV**WGQGTTVTVSS (SEQ ID NO: 385) | EIVLTQSPGTLSLSPGERATLSC**RASQSVSSSYLA**WYQQKPGQAPRLLIY**GASSRAT**GIPDRFSGSGSGTDFTLTISRLEPEDFAVYYC**QQYGSSQYT**FGQGTKLEIK (SEQ ID NO: 386) |
| MORAb-009 | amatuximab | Mesothelin | QVQLQQSGPELEKPGASVKISCKASGYSFT**GYTMN**WVKQSHGKSLEWIG**LITPYNGASSYNQKFRG**KATLTVDKSSSTAYMDLLSLTSEDSAVYFCAR**GGYDGRGFDY**WGSGTPVTVSS (SEQ ID NO: 387) | DIELTQSPAIMSASPGEKVTMTC**SASSSVSYMH**WYQQKSGTSPKRWIY**DTSKLAS**GVPGRFSGSGSGNSYSLTISSVEAEDDATYYC**QQWSKHPLT**FGSGTKVEIK (SEQ ID NO: 388) |
| hPAM4 | | MUC-1 | EVQLQESGPELVKPGASVKMSCKASGYTFP**SYVLH**WVKQKPGQGLEWIG**YINPYNDGTQYNEKFKG**KATLTSDKSSSTAYMELSRLTSEDSAVYYCAR**GFGGSYGFAY**WGQGTLITVSA (SEQ ID NO: 389) | DIVMTQSPAIMSASPGEKVTMTC**SASSSVSSSYLY**WYQQKPGSSPKLWIY**STSNLAS**GVPARFSGSGSGTSYSLTISSMEAEDAASYFC**HQWNRYPYT**FGGGTKLEIK (SEQ ID NO: 390) |
| hPAM4-Cide | clivatuzumab | MUC1 | QVQLQQSGAEVKKFGASVKVSCEASGYTFP**SYVLH**WVKQAPGQGLEWIG**YINPYNDGTQTNKKFKG**KATLTRDTSINTAYMELSRLRSDDTAVYYCAR**GFGGSYGFAY**NGQGTLVTVSS (SEQ ID NO: 391) | DIQLTQSPSSLSASVGDRVTMTC**SASSSVSSSYLY**WYQQKPGKAPKLWIY**STSNLAS**GVPARFSGSGSGTDFTLTISSLQPEDSASYFC**HQWNRYPYT**FGGGTRLEIK (SEQ ID NO: 392) |
| SAR566658 | huDS6v1.01 | MUC1 | QAQLQVSGAEVVKPGASVKMSCKASGYTFT**SYNMH**WVKQTPGQGLEWIG**YIYPGNGATNYNQKFQG**KATLTADTSSSTAYMQISSLTSEDSAVYFCAR**GDSVPFAY**WGQGTLVTVSA (SEQ ID NO: 393) | EIVLTQSPATMSASPGERVTITC**SAHSSVSFMH**WFQQKPGTSPKLWIY**STSSLAS**GVPARFGGSGSGTSYSLTISSMEAEDAATYYC**QQRSSFPLT**FGAGTKLELK (SEQ ID NO: 394) |
| Theragyn | Pemtumomab muHMFG1 | MUC1 | QVQLQQSGAELMKPGASVKISCKATGYTFS**AYWIE**WVKQRPGHGLEWIG**EILPGSNNSRYNEKFKG**KATFTADTSSNTAYMQLSSLTSEDSAVYYCSR**SYDFAWFAY**WGQGTPVTVSA (SEQ ID NO: 395) | DIVMSQSPSSLAVSVGEKVTMSC**KSSQSLLYSSNQKIYLA**WYQQKPGQSPKWYW**ASTRES**GVPDRFTGGGSGTDFTLTISSVKAEDLAVYYC**QQYYRYPRT**FGGGTKLEIK (SEQ ID NO: 396) |

TABLE 5-continued

Reference Antibody Sequences

| Trade Name | Antibody Name | Target Cell Marker | VH Sequence | VL Sequence |
|---|---|---|---|---|
| Therex | Sontu-zumab huHMFG 1 AS1402 R1150 | MUC1 | QVQLVQSGAEVKKPGASVKVSCKASGYTFSAYWIEWVRQAPGKGLEWVGEILPGSNNSRYNEKFKGRVTVTRDTSTNTAYMELSSLRSEDTAVYYCARSYDFAWFAYWGQGTLVTVSS (SEQ ID NO: 397) | DIQMTQSPSSLSASVGDRVTITCKSSQSLLYSSNQKIYLAWYQQKPGKAPKLLIYWASTRESGVPSRFSGSGSGTDFTFTISSLQPEDIATYYCQQYYRYPRTFGQGTKVEIK (SEQ ID NO: 398) |
| MDX-1105 or BMS-936559 | PD-L1 | | QVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSS (SEQ ID NO: 399) | EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK (SEQ ID NO: 400) |
| MEDI-4736 | durval-umab | PD-L1 | EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSS (SEQ ID NO: 401) | EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIK (SEQ ID NO: 402) |
| MPDL 3280A | atezoli-zumab | PD-L1 | EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSS (SEQ ID NO: 403) | DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK (SEQ ID NO: 404) |
| MSB00 10718C | avelu-mab | PD-L1 | EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSS (SEQ ID NO: 405) | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL (SEQ ID NO: 406) |
| MLN5 91 | | PSMA | EVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSS (SEQ ID NO: 407) | DIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIK (SEQ ID NO: 408) |
| MT112 | pasotux-izumab | PSMA | QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSS (SEQ ID NO: 409) | DIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIK (SEQ ID NO: 410) |
| | | ROR1 | QEQLVESGGRLVTPGGSLTLSCKASGFDFSAYYMSWVRQAPGKGLEWIATIYPSSGKTYYATWVNGR | ELVLTQSPSVSAALGSPAKITCTLSSAHKTDTIDWYQQLQGEAPRYLMQVQSDGSYTKRPGVP |

TABLE 5-continued

Reference Antibody Sequences

| Trade Name | Antibody Name | Target Cell Marker | VH Sequence | VL Sequence |
|---|---|---|---|---|
| | | | FTISSDNAQNTVDLQMN<br>SLTAAD<br>RATYFCARDSYADDGAL<br>FNIWGPGTLVTISS<br>(SEQ ID NO: 411) | DRFSGSSSGADRYLIIP<br>SVQADDEADY<br>YC**GADYIGGYV**FGGGT<br>QLTVTG<br>(SEQ ID NO: 412) |
| | | ROR1 | EVKLVESGGGLVKPGGS<br>LKLSCAASGFTFS**SYAM**<br>**S**WVRQIPEKRLEVVVA**SI**<br>**SRGGTTYYPDSVKG**RFT<br>ISRDNVRNILYLQMSSLR<br>SEDT<br>AMYYCGR**YDYDGYYAM**<br>**DY**WGQGTSVTVSS<br>(SEQ ID NO: 413) | DIKMTQSPSSMYASLG<br>ERVTITC**KASPDINSYL**<br>**S**WFQQKPGKSPKTLIY<br>**RANRLVD**GVPSRFSG<br>GGSGQDYSLTINSLEY<br>EDMGIYYC**LQ**<br>**YDEFPYT**FGGGTKLEM<br>K<br>(SEQ ID NO: 414) |
| | | ROR1 | QSLEESGGRLVTPGTPL<br>TLTCTVSGIDLN**SHWMS**<br>EVRQAPGKGLEWIG**IIA**<br>**ASGSTYYANWAKG**RFTI<br>SKTSTTVDLRIASPTTED<br>TATY<br>FCAR**DYGDYRLVTFN**W<br>GPGTLVTVSS<br>(SEQ ID NO: 415) | ELVMTQTPSSVSAAVG<br>GTVTINC**QASQSIGSYL**<br>**A**WYQQKPGQPPKLLIY<br>**YASNLAS**GVPSRFSGS<br>GSGTEYTLTISGVQRE<br>DAATYYC**LG**<br>**SLSNSDNV**FGGGTELE<br>IL<br>(SEQ ID NO: 416) |
| | | ROR1 | QSVKESEGDLVTPAGNL<br>TLTCTASGSDIN**DYPIS**W<br>VRQAPGKGLEWIG**FINS**<br>**GGSTWYASWVKG**RFTIS<br>RTSTTVDLKMTSLTTDDT<br>ATY<br>FCAR**GYSTYYCDFNI**WG<br>PGTLVTISS<br>(SEQ ID NO: 417) | ELVMTQTPSSTSGAVG<br>GTVTINC**QASQSIDSNL**<br>**A**WFQQKPGQPPTLLIY<br>**RASNLAS**GVPSRFSGS<br>RSGTEYTLTISGVQRE<br>DAATYYC**LG**<br>**GVGNVSYRTS**FGGGT<br>EVVVK<br>(SEQ ID NO: 418) |
| CC49 (Human-ized) | | TAG-72 | QVQLVQSGAEVVKPGAS<br>VKISCKASGYTFT**DHAIH**<br>WVKQNPGQRLEWIG**YF**<br>**SPGNDDFKYNERFKG**KA<br>TLTADTSASTAYVELSSL<br>RSEDTAVYFCTR**SLNMA**<br>**Y**WGQGTLVTVSS<br>(SEQ ID NO: 419) | DIVMSQSPDSLAVSLG<br>ERVTLNCKSS**QSLLYS**<br>**GNQKNYLA**WYQQKPG<br>QSPKLLIY**WASARES**G<br>VPDRFSGSGSGTDFTL<br>TISSVQAEDVAVYYC**Q**<br>**QYYSYPLT**FGAGTKLE<br>LK<br>(SEQ ID NO: 420) |
| | Murine A1 | TPBG/ 5T4 | QIQLVQSGPELKKPGETVK<br>ISCKAS**GYTFTNFGMN**WVK<br>QGPGEGLKWMG**WINTNTGE**<br>P**PRYAEEFKG**RXAFSLETTA<br>STAYLQINNLKNEDTATYF<br>CAR**DWDGAYFFDY**WGQGTT<br>LTVSS<br>(SEQ ID NO: 421) | S IVMTQTPKFLLVSAGDR<br>VTITC**KASQSVSNDVA**WY<br>QQKPGQSPKLLIN**FATNR**<br>**YT**GVPNRFTGSGYGTDFT<br>FTISTVQAEDLALYFC**QQ**<br>**DYSSPWT**FGGGTKLEIK<br>(SEQ ID NO: 422) |
| | Murine A2 | TPBG/ 5T4 | QVQLQQSRPELVKPGASVK<br>MSCKAS**GYTFTDYVIS**WVK<br>QRTGQGLEWIG**EIYPGSNS**<br>**IYYNEKFKG**RATLTA<br>DKSSSTAYMQLSSLTSEDS<br>AVYFCAM**GGNYGFDY**WGQG<br>TTLTVSS<br>(SEQ ID NO: 423) | SVIMSRGQIVLTQSPAIM<br>SASLGERVTLTC**TASSSV**<br>**NSNYLH**WYQQKPGSSPKL<br>WIY**STSNLAS**GVPARFSG<br>SGSGTSYSLTISSMEAED<br>AATYYC**HQYHRSPLT**FGA<br>GTKLELK<br>(SEQ ID NO: 424) |
| | Murine A3 | TPBG/ 5T4 | EVQLVESGGGLVQPKGSLK<br>LSCAAS**GFTFNTYAMN**WVR<br>QAPGKGLEWVA**RIRSKSNN**<br>**YATYYADSVKD**RFTISRDD<br>SQSMLYLQMNNLKTEDTAM<br>YXCVR**QWDYDVRAMNY**WGQ<br>GTSVTVSS<br>(SEQ ID NO: 425) | DIVMTQSHIFMSTSVGDR<br>VSITC**KASQDVDTAVA**WY<br>QQKPGQSPKLLIY**WASTR**<br>**LT**GVPDRFTGSGSGTDFT<br>LTISNVQSEDLADYFC**QQ**<br>**YSSYPYT**FGGGTKLEIK<br>(SEQ ID NO: 426) |

TABLE 5-continued

Reference Antibody Sequences

| Trade Name | Antibody Name | Target Cell Marker | VH Sequence | VL Sequence |
|---|---|---|---|---|
| IMMU-132 | hRS-7 | TROP-2 | QVQLQQSGSELKKPGASVKVSCKASGYTFTNYGMNWVKQAPGQGLKWMGWINTYTGEPTYTDDFKGRFAFSLDTSVSTAYLQISSLKADDTAVYFCARGGFGSSYWYFDVWGQGSLVTVSS (SEQ ID NO: 427) | DIQLTQSPSSLSASVGDRVSITCKASQDVSIAVAWYQQKPGKAPKLLIYSASYRYTGVPDRFSGSGSGTDFTLTISSLQPEDFAVYYCQQHYITPLTFGAGTKVEIK (SEQ ID NO:428) |
| IMC-18F1 | icrucu-mab | VEGFR1 | QAQVVESGGGVVQSGRSLRLSCAASGFAFSSYGMHWVRQAPGKGLEWVAVIWYDGSNKYYADSVRGRFTISRDNSENTLYLQMNSLRAEDTAVYYCARDHYGSGVHHYFYYGLDVWGQGTTVTVSS (SEQ ID NO: 429) | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK (SEQ ID NO: 430) |
| Cyramza | ramucir-umab | VEGFR2 | EVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVTDAFDIWGQGTMVTVSSA (SEQ ID NO: 431) | DIQMTQSPSSVSASIGDRVTITCRASQGIDNWLGWYQQKPGKAPKLLIYDASNLDTGVPSRFSGSGSGTYFTLTISSLQAEDFAVYFCQQAKAFPPTFGGGTKVDIK (SEQ ID NO: 432) |
| g165D FM-PEG | alacizum abpegol | VEGFR2 | EVQLVESGGGLVQPGGSLRLSCAASGFTFSSYGMSWVRQAPGKGLEWVATITSGGSYTYYVDSVKGRFTISRDNAKNTLYLQMNSLRAEDTAVYYCVRIGEDALDYWGQGTLVTVSS (SEQ ID NO: 433) | DIQMTQSPSSLSASVGDRVTITCRASQDIAGSLNWLQQKPGKAIKRLIYATSSLDSGVPKRFSGSRSGSDYTLTISSLQPEDFATYYCLQYGSFPPTFGQGTKVEIK (SEQ ID NO: 434) |
| Imclon e6.64 | | VEGFR2 | KVQLQQSGTELVKPGASVKVSCKASGYIFTEYIIHWVKQRSGQGLEWIGWLYPESNIIKYNEKFKDKATLTADKSSSTVYMELSRLTSEDSAVYFCTRHDGTNFDYWGQGTTLTVSSA (SEQ ID NO: 435) | DIVLTQSPASLAVSLGQRATISCRASESVDSYGNSFMHWYQQKPGQPPKLLIYRASNLESGIPARFSGSGSRTDFTLTINPVEADDVATYYCQQSNEDPLTFGAGTKLELK (SEQ ID NO: 436) |

*underlined sequences, if present, are CDRs within the VL and VH

In some embodiments, the CAR and/or engineered TCR of the disclosure comprises an antigen binding domain comprising a VH and a VL, and the VH and VL are selected from the group consisting of SEQ ID NO: 217 and SEQ ID NO: 218, SEQ ID NO: 219 and SEQ ID NO: 220, SEQ ID NO: 221 and SEQ ID NO: 222, SEQ ID NO: 223 and SEQ ID NO: 224, SEQ ID NO: 225 and SEQ ID NO: 226, SEQ ID NO: 227 and SEQ ID NO: 228, SEQ ID NO: 229 and SEQ ID NO: 230, SEQ ID NO: 231 and SEQ ID NO: 232, SEQ ID NO: 233 and SEQ ID NO: 234, SEQ ID NO: 235 and SEQ ID NO: 236, SEQ ID NO: 237 and SEQ ID NO: 238, SEQ ID NO: 239 and SEQ ID NO: 240, SEQ ID NO: 241 and SEQ ID NO: 242, SEQ ID NO: 243 and SEQ ID NO: 244, SEQ ID NO: 245 and SEQ ID NO: 246, SEQ ID NO: 247 and SEQ ID NO: 248, SEQ ID NO: 249 and SEQ ID NO: 250, SEQ ID NO: 251 and SEQ ID NO: 252, SEQ ID NO: 253 and SEQ ID NO: 254, SEQ ID NO: 255 and SEQ ID NO: 256, SEQ ID NO: 257 and SEQ ID NO: 258, SEQ ID NO: 259 and SEQ ID NO: 260, SEQ ID NO: 261 and SEQ ID NO: 262, SEQ ID NO: 263 and SEQ ID NO: 264, SEQ ID NO: 265 and SEQ ID NO: 266, SEQ ID NO: 267 and SEQ ID NO: 268, SEQ ID NO: 269 and SEQ ID NO: 270, SEQ ID NO: 271 and SEQ ID NO: 272, SEQ ID NO: 273 and SEQ ID NO: 274, SEQ ID NO: 275 and SEQ ID NO: 276, SEQ ID NO: 277 and SEQ ID NO: 278, SEQ ID NO: 279 and SEQ ID NO: 280, SEQ ID NO: 281 and SEQ ID NO: 282, SEQ ID NO: 283 and SEQ ID NO: 284, SEQ ID NO: 285 and SEQ ID NO: 286, SEQ ID NO: 287 and SEQ ID NO: 288, SEQ ID NO: 289 and SEQ ID NO: 290, SEQ ID NO: 291 and SEQ ID NO: 292, SEQ ID NO: 293 and SEQ ID NO: 294, SEQ ID NO: 295 and SEQ ID NO: 296, SEQ ID NO: 297 and SEQ ID NO: 298, SEQ ID NO: 299 and SEQ ID NO: 300, SEQ ID NO: 301 and SEQ ID NO: 302, SEQ ID NO: 303 and SEQ ID NO: 304, SEQ ID NO: 305 and SEQ ID NO: 306, SEQ ID NO: 307 and SEQ ID NO: 308, SEQ ID NO: 309 and SEQ ID NO: 310, SEQ ID NO: 311 and SEQ ID NO: 312, SEQ ID NO: 313 and SEQ ID NO: 314, SEQ ID NO: 315 and SEQ ID NO:

316, SEQ ID NO: 317 and SEQ ID NO: 318, SEQ ID NO: 319 and SEQ ID NO: 320, SEQ ID NO: 321 and SEQ ID NO: 322, SEQ ID NO: 323 and SEQ ID NO: 324, SEQ ID NO: 325 and SEQ ID NO: 326, SEQ ID NO: 327 and SEQ ID NO: 328, SEQ ID NO: 329 and SEQ ID NO: 330, SEQ ID NO: 331 and SEQ ID NO: 332, SEQ ID NO: 333 and SEQ ID NO: 334, SEQ ID NO: 335 and SEQ ID NO: 336, SEQ ID NO: 337 and SEQ ID NO: 338, SEQ ID NO: 339 and SEQ ID NO: 340, SEQ ID NO: 341 and SEQ ID NO: 342, SEQ ID NO: 343 and SEQ ID NO: 344, SEQ ID NO: 345 and SEQ ID NO: 346, SEQ ID NO: 347 and SEQ ID NO: 348, SEQ ID NO: 349 and SEQ ID NO: 350, SEQ ID NO: 351 and SEQ ID NO: 352, SEQ ID NO: 353 and SEQ ID NO: 354, SEQ ID NO: 355 and SEQ ID NO: 356, SEQ ID NO: 357 and SEQ ID NO: 358, SEQ ID NO: 359 and SEQ ID NO: 360, SEQ ID NO: 361 and SEQ ID NO: 362, SEQ ID NO: 363 and SEQ ID NO: 364, SEQ ID NO: 365 and SEQ ID NO: 366, SEQ ID NO: 367 and SEQ ID NO: 368, SEQ ID NO: 369 and SEQ ID NO: 370, SEQ ID NO: 371 and SEQ ID NO: 372, SEQ ID NO: 373 and SEQ ID NO: 374, SEQ ID NO: 375 and SEQ ID NO: 376, SEQ ID NO: 377 and SEQ ID NO: 378, SEQ ID NO: 379 and SEQ ID NO: 380, SEQ ID NO: 381 and SEQ ID NO: 382, SEQ ID NO: 383 and SEQ ID NO: 384, SEQ ID NO: 385 and SEQ ID NO: 386, SEQ ID NO: 387 and SEQ ID NO: 388, SEQ ID NO: 389 and SEQ ID NO: 390, SEQ ID NO: 391 and SEQ ID NO: 392, SEQ ID NO: 393 and SEQ ID NO: 394, SEQ ID NO: 395 and SEQ ID NO: 396, SEQ ID NO: 397 and SEQ ID NO: 398, SEQ ID NO: 399 and SEQ ID NO: 400, SEQ ID NO: 401 and SEQ ID NO: 402, SEQ ID NO: 403 and SEQ ID NO: 404, SEQ ID NO: 405 and SEQ ID NO: 406, SEQ ID NO: 407 and SEQ ID NO: 408, SEQ ID NO: 409 and SEQ ID NO: 410, SEQ ID NO: 411 and SEQ ID NO: 412, SEQ ID NO: 413 and SEQ ID NO: 414, SEQ ID NO: 415 and SEQ ID NO: 416, SEQ ID NO: 417 and SEQ ID NO: 418, SEQ ID NO: 419 and SEQ ID NO: 420, SEQ ID NO: 421 and SEQ ID NO:422, SEQ ID NO: 423 and SEQ ID NO: 424, SEQ ID NO: 425 and SEQ ID NO: 426, SEQ ID NO: 427 and SEQ ID NO: 418, SEQ ID NO: 419 and SEQ ID NO: 430, SEQ ID NO: 431 and SEQ ID NO: 432. SEQ ID NO: 433 and SEQ ID NO: 434, SEQ ID NO: 435 and SEQ ID NO: 436, or sequences having at least 90%, at least 95% or at least 99% identity thereto.

In some embodiments, the cells of the population have been modified such that at least 70%, at least 75%, at least 80%, at least 85%, at least 90%, or at least 95% of the modified cells express a detectable level of the chimeric antigen receptor (CAR) or engineered TCR. In one embodiment, the method of modifying a target nucleic acid sequence of a gene in a population of cells is conducted ex vivo on the population of cells. In another embodiment, the method is conducted in vivo in a subject, wherein the subject is selected from the group consisting of a rodent, a mouse, a rat, a non-human primate, and a human.

Thus, the CasX:gNA systems and methods described herein can be used, in combination with conventional molecular biology methods, to modify populations of cells (examples of which are described more fully, below) to produce a cell having an allogeneic CAR- or TCR-engineered T cell function that, for example, reduces or eliminates undesirable immunogenicity (such as a host versus graft response or a graft versus host response), and enhances survival, proliferation and/or efficacy by altering the gene of a component of the major histocompatibility complex, e.g., an HLA protein, e.g., HLA-A, HLA-B, HLA-C or B2M (encoded by the B2M gene), or a protein that regulates expression of one or more components of the major histocompatibility complex, eliminates proteins that are a part of the T-cell receptor, such as TRAC, represses expression of transcriptional coactivators that regulates y-interferon-activated transcription of Major Histocompatibility Complex (MHC) class I and II genes, such as CIITA, or allows the modified cells to escape the immunosuppressive effects of a factor, such as TGFβ. By reducing a mismatch in the HLA protein, reducing or eliminating the wild-type T cell receptor or other component of the modified cell in comparison to those of the recipient subject, it reduces or eliminates the potential for host vs. graft disease (GVHD) by eliminating host T cell receptor recognition of and response to mismatched (e.g., allogeneic) graft tissue (see, e.g., Takahiro Kamiya, T. et al. A novel method to generate T-cell receptor-deficient chimeric antigen receptor T cells. Blood Advances 2:517 (2018)). This approach, therefore, could be used to generate immune cells with an improved therapeutic index for immuno-oncologic applications in a subject with a disease such as cancer, autoimmune diseases and transplant rejection.

VI. Polynucleotides and Vectors

In another aspect, the present disclosure relates to polynucleotides of the CasX:gNA systems encoding the CasX proteins and the polynucleotides of the gNAs (e.g., the gDNAs and gRNAs) of any of the embodiments described herein. In a further aspect, the disclosure provides donor template polynucleotides for use in modifying the target proteins in the modified cells. In yet a further aspect, the disclosure relates to vectors comprising polynucleotides encoding the CasX proteins and the gNAs described herein, as well as the donor templates and polynucleotides encoding the CAR of the embodiments. In yet a further aspect, the disclosure relates to vectors comprising polynucleotides encoding fusion proteins of the engineered TCR of the embodiments.

In some embodiments, the disclosure provides polynucleotide sequences encoding the reference CasX of SEQ ID NOS:1-3. In other embodiments, the disclosure provides polynucleotide sequences encoding the CasX variants of any of the embodiments described herein. In some embodiments, the disclosure provides an isolated polynucleotide sequence encoding a CasX variant polypeptide sequence set forth in Table 4, or a sequence having at least about 50%, at least about 60%, at least about 70%, at least about 80%, at least about 90%, at least about 95%, at least about 96%, at least about 97%, at least about 98%, or at least about 99% sequence identity thereto. In some embodiments, the disclosure provides an isolated polynucleotide sequence encoding a gNA sequence of any of the embodiments described herein. In some embodiments, the polynucleotide encodes a gNA scaffold sequence set forth in Table 1 or Table 2, or a sequence having at least about 50%, at least about 60%, at least about 70%, at least about 80%, at least about 90%, at least about 95%, at least about 96%, at least about 97%, at least about 98%, at least about 99% sequence identity thereto. In some embodiments, the polynucleotide encodes a gNA scaffold sequence selected from the group consisting of SEQ ID NOS:2101-2280, or a sequence having at least about 50%, at least about 60%, at least about 70%, at least about 80%, at least about 90%, at least about 95%, at least about 96%, at least about 97%, at least about 98%, at least about 99% sequence identity thereto. In other embodiments, the disclosure provides targeting sequence polynucleotides of Tables 3A 3B, or 3C, or a sequences having at least about 65%, at least about 75%, at least about 85%, or at least about 95% identity thereto, as well as DNA encoding the targeting sequences. In some embodiments, the polynucleotide encoding the scaffold sequence further comprises the sequence encoding the targeting sequence such that a gNA capable of binding the CasX and the target sequence can be expressed as a sgNA or dgNA. In other embodiments, the disclosure provides an isolated polynucleotide sequence encoding a gNA sequence that hybridizes with the target gene encoding a protein involved in antigen processing, antigen presentation, antigen recognition, and/or antigen response. In some cases, the polynucleotide sequence encodes a gNA sequence that hybridizes with a target gene exon. In other cases, the polynucleotide sequence encodes a gNA sequence that hybridizes with a target gene intron. In other cases, the polynucleotide sequence encodes a gNA sequence that hybridizes with a target gene intron-exon junction. In other cases, the polynucleotide sequence encodes a gNA sequence that hybridizes with an intergenic region of the target gene. In other cases, the polynucleotide sequence encodes a gNA sequence that hybridizes with a regulatory element of the target gene. In some cases, the cell surface marker regulatory element is 5' of the gene. In other cases, the regulatory element is 3' of the cell surface marker gene. In other cases, the regulatory element comprises the 5' UTR of the target gene. In still other cases, the regulatory element comprises the 3'UTR of the target gene.

In other embodiments, the disclosure provides donor template nucleic acids wherein the donor template comprises a nucleotide sequence having homology but not complete identity to a target sequence of the target nucleic acid for which gene editing is intended. For knock-down/knock-outs, the donor template sequence is typically not identical to the genomic sequence that it replaces and may contain one or more single base changes, insertions, deletions, inversions or rearrangements with respect to the genomic sequence, provided that there is sufficient homology with the target sequence to support homology-directed repair, or the donor template has homologous arms, whereupon insertion can result in a frame-shift or other mutation such that the target protein is not expressed or is expressed at a lower level. In certain embodiments, for knock-down/knock-out modifications, the donor template sequence will have at least about 60%, 70%, 80%, 90%, 95%, 98%, 99%, or 99.9% sequence identity to the target genomic sequence with which recombination is desired. In some embodiments, the target sequence has a sequence that hybridizes with the protein target gene and is inserted at the break sites introduced by the CasX, effecting a modification of the gene sequence. In some cases, the target sequence has a sequence that hybridizes with a target gene exon. In other cases, the target sequence has a sequence that hybridizes with a target gene intron. In other cases, the target sequence has a sequence that hybridizes with a target gene intron-exon junction. In other cases, the target sequence has a sequence that hybridizes with an intergenic region of the target gene. In still other cases, the target sequence has a sequence that hybridizes with a regulatory element of the target gene. In the foregoing embodiments, the donor template can range in size from 10-15,000 nucleotides, 50-10,000 nucleotides, or 100-1000 nucleotides. In some embodiments, the donor template is a single-stranded DNA template. In other embodiments, the donor template is a single stranded RNA template. In other embodiments, the donor template is a double-stranded DNA template.

In other embodiments, the disclosure provides polynucleotides encoding a chimeric antigen receptor (CAR), engineered TCR, or one or more subunits of an engineered TCR with a binding domain specific for a disease antigen, optionally a tumor cell antigen, that is to be introduced into the target cells of the population for expression of the CAR or engineered TCR. In the foregoing, the tumor cell antigen is selected from the group consisting of Cluster of Differentiation 19 (CD19), CD3, CD8, CD7, CD10, CD20, CD22, CD30, CLL1, CD33, CD34, CD38, CD41, CD44, CD47, CD49f, CD56, CD70, CD74, CD99, CD123, CD133, CD138, carbonix anhydrase IX (CAIX), CC chemokine receptor 4 (CCR4), ADAM metallopeptidase domain 12 (ADAM12), adhesion G protein-coupled receptor E2 (ADGRE2), alkaline phosphatase placental-like 2 (ALPPL2), alpha 4 Integrin, angiopoietin-2 (ANG2), B-cell maturation antigen (BCMA), CD44V6, carcinoembryonic antigen (CEA), CEAC, CEACAM5, Claudin 6 (CLDN6), CLDN18, C-type lectin domain family 12 member A (CLEC12A), mesenchymal-epithelial transition factor (cMET), cytotoxic T-lymphocyte-associated protein 4 (CTLA4), epidermal growth factor receptor 1 (EGF1R), EGFR-VIII, epithelial glycoprotein 2 (EGP-2), EGP-40, EphA2, ENPP3, epithelial cell adhesion molecule (Ep-CAM), erb-B2,3,4, folate binding protein (FBP), fetal acetylcholine receptor, folate receptor-a, folate receptor 1 (FOLR1), G protein-coupled receptor 143 (GPR143), glutamate metabotropic receptor 8 (GRM8), glypican-3 (GPC3), ganglioside GD2, ganglioside GD3, human epidermal growth factor receptor 1 (HER1), human epidermal growth factor receptor 2 (HER2), HER3, Integrin B7, intercellular cell-adhesion molecule-1 (ICAM-1), human telomerase reverse transcriptase (hTERT), Interleukin-13 receptor a2 (IL-13R-a2), K-light chain, Kinase insert domain receptor (KDR), Lewis-Y (LeY), chondromodulin-1 (LECT1), L1 cell adhesion molecule, Lysophosphatidic acid receptor 3 (LPAR3), melanoma-associated antigen 1 (MAGE-A1), mesothelin, mucin 1 (MUC1), MUC16, melanoma-associated antigen 3 (MAGEA3), tumor protein p53 (p53), Melanoma Antigen Recognized by T cells 1 (MART1), glycoprotein 100 (GP100), Proteinase3 (PR1), ephrin-A receptor 2 (EphA2), Natural killer group 2D ligand (NKG2D ligand), New York esophageal squamous cell carcinoma 1 (NY-ESO-1), oncofetal antigen (h5T4), prostate-specific membrane antigen (PSMA), programmed death ligand 1 (PDL-1), receptor tyrosine kinase-like orphan receptor 1 (ROR1), trophoblast glycoprotein (TPBG), tumor-associated glycoprotein 72 (TAG-72), tumor-associated calcium signal transducer 2 (TROP-2), tyrosinase, survivin, vascular endothelial growth factor receptor 2 (VEGF-R2), Wilms tumor-1 (WT-1), leukocyte immunoglobulin-like receptor B2 (LILRB2), Preferentially Expressed Antigen In Melanoma (PRAME), T cell receptor beta constant 1 (TRBC1), TRBC2, and (T-cell immunoglobulin mucin-3) TIM-3. In some embodiments, the CAR or engineered TCR comprises an antigen binding domain selected from the group consisting of linear antibody, single domain antibody (sdAb), and single-chain variable fragment (scFv). In a particular embodiment, the antigen binding domain is a scFv. Exemplary CDR and VL and VH sequences suitable for use in the scFv of the embodiments are described herein, including the sequences of Table 5. In one embodiment, the VH, VL, and/or the CDRs of the scFv have one or more amino acid modifications relative to the sequences of Table 5, wherein the scFv retains binding affinity to the tumor antigen, and wherein the modification is selected from the group consisting of a substitution, deletion, and insertion.

In those embodiments comprising a CAR, the CAR can further comprise one or more intracellular signaling domains, wherein the at least one intracellular signaling domain comprises at least one intracellular signaling domain isolated or derived from CD247 molecule (CD3-zeta), CD27 molecule (CD27), CD28 molecule (CD28), TNF receptor superfamily member 9 (4-11B), inducible T cell costimulator (ICOS), or TNF receptor superfamily member 4 (OX40). In another embodiment, the at least one intracellular signaling domain comprises: a) a CD3-zeta intracellular signaling domain; b) a CD3-zeta intracellular signaling domain and a 4-1BB or CD28 intracellular signaling domain; c) a CD-zeta intracellular signaling domain, a 4-1BB intracellular signaling domain, and a CD28 intracellular signaling domain; or d) a CD-zeta intracellular signaling domain, a CD28 intracellular signaling domain, a 4-1BB intracellular signaling domain, and a CD27 or OX40 intracellular signaling domain. In another embodiment, the CAR further comprises an extracellular hinge domain, wherein the hinge domain is an immunoglobulin like domain or wherein the hinge domain is isolated or derived from IgG1, IgG2, or IgG4, or wherein the hinge domain is isolated or derived from CD8a molecule (CD8) or CD28. In another embodiment, the CAR further comprises a transmembrane domain, wherein the transmembrane domain is isolated or derived from the group consisting of CD3-zeta, CD4, CD8, and CD28.

In those embodiments comprising an engineered T cell receptor (TCR), the TCR can further comprise one or more subunits selected from the group consisting of TCR alpha, TCR beta, CD3-delta, CD3-epsilon, CD-gamma or CD3-zeta. In some embodiments, the TCR further comprises an intracellular domain comprising a stimulatory domain from an intracellular signaling domain, wherein the antigen binding domain of the TCR is operably linked to the one or more subunits.

In some embodiments, the disclosure further provides polynucleotides encoding inducible expression cassettes coding for immune stimulatory cytokines selected from the group consisting of IL-7, IL-12, IL-15, and IL-18, wherein the polynucleotides are to be introduced into the modified target cells of the population expressing CAR, wherein expression of the cytokines render the modified cells resistant to the immunosuppressive tumor environment when administered to a subject. The polynucleotides encoding the CAR with the foregoing components can be introduced into the cells by several conventional methods, described below.

In some embodiments, the disclosure relates to methods to produce polynucleotide sequences encoding the reference CasX, the CasX variants, or the gNA of any of the embodiments described herein, including variants thereof, or sequences complementary to the target sequences, as well as methods to express the proteins expressed or RNA transcribed by the polynucleotide sequences. In general, the methods include producing a polynucleotide sequence coding for the reference CasX, the CasX variants, or the gNA of any of the embodiments described herein and incorporating the encoding gene into an expression vector appropriate for a host cell. For production of the encoded reference CasX, the CasX variants, or the gNA of any of the embodiments described herein, the method includes transforming an appropriate host cell with an expression vector comprising the encoding polynucleotide, and culturing the host cell under conditions causing or permitting the resulting reference CasX, the CasX variants, or the gNA of any of the embodiments described herein to be expressed or transcribed in the transformed host cell, thereby producing the reference CasX, the CasX variants, or the gNA, which is recovered by methods described herein or by standard purification methods known in the art. Standard recombinant techniques in molecular biology are used to make the polynucleotides and expression vectors of the present disclosure.

In accordance with the disclosure, polynucleotide sequences that encode the reference CasX, the CasX variants, the gNA, the CAR or the expression cassettes for the immune stimulatory cytokines of any of the embodiments described herein are used to generate recombinant DNA molecules that direct the expression in appropriate host cells. Several cloning strategies are suitable for performing the present disclosure, many of which are used to generate a construct that comprises a gene coding for a composition of the present disclosure, or its complement. In some embodiments, the cloning strategy is used to create a gene that encodes a construct that comprises nucleotides encoding the reference CasX, the CasX variants, or the gNA that is used to transform a host cell for expression of the composition.

In one approach, a construct is first prepared containing the DNA sequence encoding a reference CasX, a CasX variant, or a gNA. Exemplary methods for the preparation of such constructs are described in the Examples. The construct is then used to create an expression vector suitable for transforming a host cell, such as a prokaryotic or eukaryotic host cell for the expression and recovery of the polypeptide construct. Where desired, the host cell is an *E. coli*. In other embodiments, the host cell is selected from BHK cells, HEK293 cells, HEK293T cells, NS0 cells, SP2/0 cells, YO myeloma cells, P3X63 mouse myeloma cells, PER cells, PER.C6 cells, hybridoma cells, NIH3T3 cells, COS, HeLa, CHO, or yeast cells. Exemplary methods for the creation of expression vectors, the transformation of host cells and the expression and recovery of reference CasX, the CasX variants, or the gNA are described in the Examples.

The gene or genes encoding for the reference CasX, the CasX variants, the gNA constructs, the CAR, the one or more fusion polypeptides comprising a TCR subunit, or the immune stimulatory cytokines can be made in one or more steps, either fully synthetically or by synthesis combined with enzymatic processes, such as restriction enzyme-mediated cloning, PCR and overlap extension, including methods more fully described in the Examples. The methods disclosed herein can be used, for example, to ligate sequences of polynucleotides encoding the various components (e.g., CasX and gNA) genes of a desired sequence. Genes encoding polypeptide compositions are assembled from oligonucleotides using standard techniques of gene synthesis.

In some embodiments, the nucleotide sequence encoding a CasX protein, CAR, engineered TCR, or one or more subunits of the engineered TCR is codon optimized. This type of optimization can entail a mutation of an encoding nucleotide sequence to mimic the codon preferences of the intended host organism or cell while encoding the same CasX protein, CAR or TCR. Thus, the codons can be changed, but the encoded protein remains unchanged. For example, if the intended target cell of the CasX protein was a human cell, a human codon-optimized CasX-encoding nucleotide sequence could be used. As another non-limiting example, if the intended host cell were a mouse cell, then a mouse codon-optimized CasX-encoding nucleotide sequence could be generated. As another non-limiting example, if the intended host cell were a plant cell, then a plant codon-optimized CasX protein variant-encoding nucleotide sequence could be generated. As another non-limiting example, if the intended host cell were an insect cell, then an insect codon-optimized CasX protein-encoding nucleotide sequence could be generated. The gene design can be performed using algorithms that optimize codon usage and amino acid composition appropriate for the host cell utilized in the production of the reference CasX, the CasX variants, or the gNA. In one method of the disclosure, a library of polynucleotides encoding the components of the constructs is created and then assembled, as described above. The resulting genes are then assembled and the resulting genes used to transform a host cell and produce and recover the reference CasX, the CasX variants, or the gNA compositions for evaluation of its properties, as described herein.

In some embodiments, a nucleotide sequence encoding a gNA is operably linked to a control element, e.g., a transcriptional control element, such as a promoter. In some embodiments, a nucleotide sequence encoding a CasX protein is operably linked to a control element, e.g., a transcriptional control element, such as a promoter. In some embodiments, a nucleotide sequence encoding a CAR is operably linked to a control element, e.g., a transcriptional control element, such as a promoter.

The transcriptional control element can be a promoter. In some cases, the promoter is a constitutively active promoter. In some cases, the promoter is a regulatable promoter. In some cases, the promoter is an inducible promoter. In some cases, the promoter is a tissue-specific promoter. In some cases, the promoter is a cell type-specific promoter. In some cases, the transcriptional control element (e.g., the promoter) is functional in a targeted cell type or targeted cell population. For example, in some cases, the transcriptional control element can be functional in eukaryotic cells, e.g., neurons, spinal motor neurons, oligodendrocytes, or glial cells.

Non-limiting examples of eukaryotic promoters (promoters functional in a eukaryotic cell) include EF1alpha, EF1alpha core promoter, those from cytomegalovirus (CMV) immediate early, herpes simplex virus (HSV) thymidine kinase, early and late SV40, long terminal repeats (LTRs) from retrovirus, and mouse metallothionein-I. Further non-limiting examples of eukaryotic promoters include the CMV promoter full-length promoter, the minimal CMV promoter, the chicken β-actin promoter, the hPGK promoter, the HSV TK promoter, the Mini-TK promoter, the human synapsin I promoter which confers neuron-specific expression, the Mecp2 promoter for selective expression in neurons, the minimal IL-2 promoter, the Rous sarcoma virus enhancer/promoter (single), the spleen focus-forming virus long terminal repeat (LTR) promoter, the SV40 promoter, the SV40 enhancer and early promoter, the TBG promoter: promoter from the human thyroxine-binding globulin gene (Liver specific), the PGK promoter, the human ubiquitin C promoter, the UCOE promoter (Promoter of HNRPA2B1-CBX3), the Histone H2 promoter, the Histone H3 promoter, the Ulal small nuclear RNA promoter (226 nt), the U1b2 small nuclear RNA promoter (246 nt) 26, the TTR minimal enhancer/promoter, the b-kinesin promoter, the human eIF4A1 promoter, the ROSA26 promoter and the glyceraldehyde 3-phosphate dehydrogenase (GAPDH) promoter.

Selection of the appropriate vector and promoter is well within the level of ordinary skill in the art, as it related to controlling expression, e.g., for modifying a protein involved in antigen processing, antigen presentation, antigen recognition, and/or antigen response and/or its regulatory element. The expression vector may also contain a ribosome binding site for translation initiation and a transcription terminator. The expression vector may also include appropriate sequences for amplifying expression. The expression vector may also include nucleotide sequences encoding protein tags (e.g., 6×His tag, hemagglutinin tag, fluorescent protein, etc.) that can be fused to the CasX protein, thus resulting in a chimeric CasX protein that are used for purification or detection.

In some embodiments, a nucleotide sequence encoding each of a gNA variant or a CasX protein, a CAR, or an expression cassette for the immune stimulatory cytokines is operably linked to an inducible promoter, a constitutively active promoter, a spatially restricted promoter (i.e., transcriptional control element, enhancer, tissue specific promoter, cell type specific promoter, etc.), or a temporally restricted promoter. In other embodiments, individual nucleotide sequences encoding the gNA, the CasX, the CAR, or an expression cassette for the immune stimulatory cytokines are linked to one of the foregoing categories of promoters, which are then introduced into the cells to be modified by conventional methods, described below.

In certain embodiments, suitable promoters can be derived from viruses and can therefore be referred to as viral promoters, or they can be derived from any organism, including prokaryotic or eukaryotic organisms. Suitable promoters can be used to drive expression by any RNA polymerase (e.g., pol I, pol II, pol III). Exemplary promoters include, but are not limited to the SV40 early promoter, mouse mammary tumor virus long terminal repeat (LTR) promoter; adenovirus major late promoter (Ad MLP); a herpes simplex virus (HSV) promoter, a cytomegalovirus (CMV) promoter such as the CMV immediate early promoter region (CMVIE), a rous sarcoma virus (RSV) promoter, a human U6 small nuclear promoter (U6), an enhanced U6 promoter, a human HI promoter (HI), a POL1 promoter, a 7SK promoter, tRNA promoters and the like.

In some embodiments, one or more nucleotide sequences encoding a CasX and gNA and, optionally, comprising a donor template or a polynucleic acid encoding a CAR, are each operably linked to (under the control of) a promoter operable in a eukaryotic cell. Examples of inducible promoters may include, but are not limited to, T7 RNA polymerase promoter, T3 RNA polymerase promoter, isopropyl-beta-D-thiogalactopyranoside (IPTG)-regulated promoter, lactose induced promoter, heat shock promoter, tetracycline-regulated promoter, steroid-regulated promoter, metal-regulated promoter, estrogen receptor-regulated promoter, etc. Inducible promoters can therefore, in some embodiments, be regulated by molecules including, but not limited to, doxycycline; estrogen and/or an estrogen analog; IPTG; etc.

In certain embodiments, inducible promoters suitable for use may include any inducible promoter described herein or known to one of ordinary skill in the art. Examples of inducible promoters include, without limitation, chemically/biochemically-regulated and physically-regulated promoters such as alcohol-regulated promoters, tetracycline-regulated promoters (e.g., anhydrotetracycline (aTc)-responsive promoters and other tetracycline-responsive promoter systems, which include a tetracycline repressor protein (tetR), a tetracycline operator sequence (tetO) and a tetracycline transactivator fusion protein (tTA), steroid-regulated promoters (e.g., promoters based on the rat glucocorticoid receptor, human estrogen receptor, moth ecdysone receptors, and promoters from the steroid/retinoid/thyroid receptor superfamily), metal-regulated promoters (e.g., promoters derived from metallothionein (proteins that bind and sequester metal ions) genes from yeast, mouse and human), pathogenesis-regulated promoters (e.g., induced by salicylic acid, ethylene or benzothiadiazole (BTH)), temperature/heat-inducible promoters (e.g., heat shock promoters), and light-regulated promoters (e.g., light responsive promoters from plant cells).

In some cases, the promoter is a spatially restricted promoter (i.e., cell type specific promoter, tissue specific promoter, etc.) such that in a multi-cellular organism, the promoter is active (i.e., "ON") in a subset of specific cells. Spatially restricted promoters may also be referred to as enhancers, transcriptional control elements, control sequences, etc. Any convenient spatially restricted promoter may be used as long as the promoter is functional in the targeted host cell (e.g., eukaryotic cell; prokaryotic cell).

In some cases, the promoter is a reversible promoter. Suitable reversible promoters, including reversible inducible promoters are known in the art. Such reversible promoters may be isolated and derived from many organisms, e.g., eukaryotes and prokaryotes. Modification of reversible promoters derived from a first organism for use in a second organism, e.g., a first prokaryote and a second a eukaryote, a first eukaryote and a second a prokaryote, etc., is well known in the art. Such reversible promoters, and systems based on such reversible promoters but also comprising additional control proteins, include, but are not limited to, alcohol regulated promoters (e.g., alcohol dehydrogenase I (alcA) gene promoter, promoters responsive to alcohol transactivator proteins (AlcR, etc.), tetracycline regulated promoters, (e.g., promoter systems including Tet Activators, TetON, TetOFF, etc.), steroid regulated promoters (e.g., rat glucocorticoid receptor promoter systems, human estrogen receptor promoter systems, retinoid promoter systems, thyroid promoter systems, ecdysone promoter systems, mifepristone promoter systems, etc.), metal regulated promoters (e.g., metallothionein promoter systems, etc.), pathogenesis-related regulated promoters (e.g., salicylic acid regulated promoters, ethylene regulated promoters, benzothiadiazole regulated promoters, etc.), temperature regulated promoters (e.g., heat shock inducible promoters (e.g., HSP-70, HSP-90, soybean heat shock promoter, etc.), light regulated promoters, synthetic inducible promoters, and the like.

Recombinant expression vectors of the disclosure can also comprise elements that facilitate robust expression of CasX proteins, the gNAs, and the CAR of the disclosure. For example, recombinant expression vectors can include one or more of a polyadenylation signal (PolyA), an intronic sequence or a post-transcriptional regulatory element such as a woodchuck hepatitis post-transcriptional regulatory element (WPRE). Exemplary polyA sequences include hGH poly(A) signal (short), HSV TK poly(A) signal, synthetic polyadenylation signals, SV40 poly(A) signal, β-globin poly (A) signal and the like. A person of ordinary skill in the art will be able to select suitable elements to include in the recombinant expression vectors described herein.

The polynucleotides encoding the reference CasX, the CasX variants, the gNA sequences, and the CAR, engineered TCR, or one or more subunits of the engineered TCR can then be individually cloned into one or more expression vectors. In some embodiments, the present disclosure provides vectors comprising the polynucleotides selected from the group consisting of a retroviral vector, a lentiviral vector, an adenoviral vector, an adeno-associated viral (AAV) vector, a virus-like particle (VLP), a herpes simplex virus (HSV) vector, a plasmid, a minicircle, a nanoplasmid, a DNA vector, and an RNA vector. In some embodiments, the vector is a recombinant expression vector that comprises a nucleotide sequence encoding a CasX protein. In other embodiments, the disclosure provides a recombinant expression vector comprising a nucleotide sequence encoding a CasX protein and a nucleotide sequence encoding a gNA. In some cases, the nucleotide sequence encoding the CasX protein variant and/or the nucleotide sequence encoding the gNA are operably linked to a promoter that is operable in a cell type of choice. In other embodiments, the nucleotide sequence encoding the CasX protein variant and the nucleotide sequence encoding the gNA are provided in separate vectors operably linked to a promoter. In other embodiments, the vector can comprise a donor template or a polynucleotide encoding one or more CAR, engineered TCR, one or more engineered TCR subunits, or a separate vector can be utilized to introduce the donor template or the one or more CAR or engineered TCR subunits into the target cell to be modified.

In some embodiments, provided herein are one or more recombinant expression vectors comprising one or more of: (i) a nucleotide sequence of a donor template nucleic acid where the donor template comprises a nucleotide sequence having homology to a target sequence of a target nucleic acid (e.g., a target genome); (ii) a nucleotide sequence that encodes a gNA that hybridizes to a target sequence of the locus of the targeted genome (e.g., configured as a single or dual guide RNA) operably linked to a promoter that is operable in a target cell such as a eukaryotic cell; (iii) a nucleotide sequence encoding a CasX protein operably linked to a promoter that is operable in a target cell such as a eukaryotic cell; (iv) a nucleotide sequence encoding a CAR operably linked to a promoter that is operable in a target cell such as a eukaryotic cell; and (v) a nucleotide sequence encoding an expression cassette for the immune stimulatory cytokines operably linked to a promoter that is operable in a target cell such as a eukaryotic cell. In some embodiments, the sequences encoding the donor template, the gNA, the CasX protein, the CAR, the engineered TCR or one or more subunits thereof, and the expression cassette are in different recombinant expression vectors, and in other embodiments one or more polynucleotide sequences (for the donor template, CasX, gNA, the CAR, the engineered TCR or one or more subunits thereof, and the expression cassette) are in the same recombinant expression vector. In other cases, the CasX and gNA are delivered to the target cell as an RNP (e.g., by electroporation or chemical means) and the donor template and/or the polynucleotide encoding the CAR, or engineered TCR or one or more subunits thereof, and the expression cassette are delivered by a vector.

The polynucleotide sequence(s) are inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan. Such techniques are well known in the art and well described in the scientific and patent literature. Various vectors are publicly available. The vector may, for example, be in the form of a plasmid, cosmid, viral particle, or phage that may conveniently be subjected to recombinant DNA procedures, and the choice of vector will often depend on the host cell into which it is to be introduced. Thus, the vector may be an autonomously replicating vector, i.e., a vector, which exists as an extrachromosomal entity, the replication of which is independent of chromosomal replication, e.g., a plasmid. Alternatively, the vector may be one which, when introduced into a host cell, is integrated into the host cell genome and replicated together with the chromosome(s) into which it has been integrated. Once introduced into a suitable host cell, expression of the protein involved in antigen processing, antigen presentation, antigen recognition, and/or antigen response can be determined using any nucleic acid or protein assay known in the art. For example, the presence of transcribed mRNA of reference CasX or the CasX variants can be detected and/or quantified by conventional hybridization assays (e.g., Northern blot analysis), amplification procedures (e.g. RT-PCR), SAGE (U.S. Pat. No. 5,695,937), and array-based technologies (see e.g., U.S. Pat. Nos. 5,405,783, 5,412,087 and 5,445,934), using probes complementary to any region of the polynucleotide.

The disclosure provides for the use of plasmid expression vectors containing replication and control sequences that are compatible with and recognized by the host cell and are operably linked to the gene encoding the polypeptide for controlled expression of the polypeptide or transcription of the RNA. Such vector sequences are well known for a variety of bacteria, yeast, and viruses. Useful expression vectors that can be used include, for example, segments of chromosomal, non-chromosomal and synthetic DNA sequences. "Expression vector" refers to a DNA construct containing a DNA sequence that is operably linked to a suitable control sequence capable of effecting the expression of the DNA encoding the polypeptide in a suitable host. The requirements are that the vectors are replicable and viable in the host cell of choice. Low- or high-copy number vectors may be used as desired. The control sequences of the vector include a promoter to effect transcription, an optional operator sequence to control such transcription, a sequence encoding suitable mRNA ribosome binding sites, and sequences that control termination of transcription and translation. The promoter may be any DNA sequence, which shows transcriptional activity in the host cell of choice and may be derived from genes encoding proteins either homologous or heterologous to the host cell.

The polynucleotides and recombinant expression vectors can be delivered to the target host cells by a variety of methods. Such methods include, but are not limited to, viral infection, transfection, lipofection, electroporation, calcium phosphate precipitation, polyethyleneimine (PEI)-mediated transfection, DEAE-dextran mediated transfection, microinjection, liposome-mediated transfection, particle gun technology, nucleofection, direct addition by cell penetrating CasX proteins that are fused to or recruit donor DNA, cell squeezing, calcium phosphate precipitation, direct microinjection, nanoparticle-mediated nucleic acid delivery, and using the commercially available TransMessenger® reagents from Qiagen, Stemfect™ RNA Transfection Kit from Stemgent, and TransIT®-mRNA Transfection Kit from Mirus Bio LLC, Lonza nucleofection, Maxagen electroporation and the like.

A recombinant expression vector sequence can be packaged into a virus or virus-like particle (also referred to herein as a "VLP" or "virion") for subsequent infection and transformation of a cell, ex vivo, in vitro or in vivo. Such VLP or virions will typically include proteins that encapsidate or package the vector genome. Suitable expression vectors may include viral expression vectors based on vaccinia virus; poliovirus; adenovirus; a retroviral vector (e.g., Murine Leukemia Virus), spleen necrosis virus, and vectors derived from retroviruses such as Rous Sarcoma Virus, Harvey Sarcoma Virus, avian leukosis virus, retrovirus, a lentivirus, human immunodeficiency virus, myeloproliferative sarcoma virus, and mammary tumor virus; and the like. In some embodiments, a recombinant expression vector of the present disclosure is a recombinant adeno-associated virus (AAV) vector. In a particular embodiment, a recombinant expression vector of the present disclosure is a recombinant retrovirus vector. In another particular embodiment, a recombinant expression vector of the present disclosure is a recombinant lentivirus vector.

AAV is a small (20 nm), nonpathogenic virus that is useful in treating human diseases in situations that employ a viral vector for delivery to a cell such as a eukaryotic cell, either in vivo or ex vivo for cells to be prepared for administration to a subject. A construct is generated, for example, encoding any of the CasX proteins and gNA embodiments as described herein, and optionally a donor template or a polynucleotide encoding a CAR, and can be flanked with AAV inverted terminal repeat (ITR) sequences, thereby enabling packaging of the AAV vector into an AAV viral particle.

An "AAV" vector may refer to the naturally occurring wild-type virus itself or derivatives thereof. The term covers all subtypes, serotypes and pseudotypes, and both naturally occurring and recombinant forms, except where required otherwise. As used herein, the term "serotype" refers to an AAV which is identified by and distinguished from other AAVs based on capsid protein reactivity with defined antisera, e.g., there are many known serotypes of primate AAVs. In some embodiments, the AAV vector is selected from AAV1, AAV2, AAV3, AAV4, AAV5, AAV6, AAV7, AAV8, AAV9, AAV 10, AAV-Rh74 (Rhesus macaque-derived AAV), and AAVRh10, and modified capsids of these serotypes. For example, serotype AAV-2 is used to refer to an AAV which contains capsid proteins encoded from the cap gene of AAV-2 and a genome containing 5' and 3' ITR sequences from the same AAV-2 serotype. Pseudotyped AAV refers to an AAV that contains capsid proteins from one serotype and a viral genome including 5'-3' ITRs of a second serotype. Pseudotyped rAAV would be expected to have cell surface binding properties of the capsid serotype and genetic properties consistent with the ITR serotype. Pseudotyped recombinant AAV (rAAV) are produced using standard techniques described in the art. As used herein, for example, rAAV1 may be used to refer an AAV having both capsid proteins and 5'-3' ITRs from the same serotype or it may refer to an AAV having capsid proteins from serotype 1 and 5'-3' ITRs from a different AAV serotype, e.g., AAV serotype 2. For each example illustrated herein the description of the vector design and production describes the serotype of the capsid and 5'-3' ITR sequences.

An "AAV virus" or "AAV viral particle" refers to a viral particle composed of at least one AAV capsid protein (preferably by all of the capsid proteins of a wild-type AAV) and an encapsidated polynucleotide. If the particle additionally comprises a heterologous polynucleotide (i.e., a polynucleotide other than a wild-type AAV genome to be delivered to a mammalian cell), it is typically referred to as "rAAV". An exemplary heterologous polynucleotide is a polynucleotide comprising a CasX protein and/or sgNA and, optionally, a donor template of any of the embodiments described herein.

By "adeno-associated virus inverted terminal repeats" or "AAV ITRs" is meant the art recognized regions found at each end of the AAV genome which function together in cis as origins of DNA replication and as packaging signals for the virus. AAV ITRs, together with the AAV rep coding region, provide for the efficient excision and rescue from, and integration of a nucleotide sequence interposed between two flanking ITRs into a mammalian cell genome.

The nucleotide sequences of AAV ITR regions are known. See, for example Kotin, R. M. (1994) Human Gene Therapy 5:793-801; Berns, K. I. "Parvoviridae and their Replication" in Fundamental Virology, $2^{nd}$ Edition, (B. N. Fields and D. M. Knipe, eds.). As used herein, an AAV ITR need not have the wild-type nucleotide sequence depicted, but may be altered, e.g., by the insertion, deletion or substitution of nucleotides. Additionally, the AAV ITR may be derived from any of several AAV serotypes, including without limitation, AAV1, AAV2, AAV3, AAV4, AAV5, AAV6, AAV7, AAV8, AAV9, AAV10, AAV-Rh74, and AAVRh10, and modified capsids of these serotypes. Furthermore, 5' and 3' ITRs which flank a selected nucleotide sequence in an AAV vector need not necessarily be identical or derived from the same AAV serotype or isolate, so long as they function as intended, i.e., to allow for excision and rescue of the sequence of interest from a host cell genome or vector, and to allow integration of the heterologous sequence into the recipient cell genome when AAV Rep gene products are present in the cell. Use of AAV serotypes for integration of heterologous sequences into a host cell is known in the art (see, e.g., WO2018195555A1 and US20180258424A1, incorporated by reference herein.)

By "AAV rep coding region" is meant the region of the AAV genome which encodes the replication proteins Rep 78, Rep 68, Rep 52 and Rep 40. These Rep expression products have been shown to possess many functions, including recognition, binding and nicking of the AAV origin of DNA replication, DNA helicase activity and modulation of transcription from AAV (or other heterologous) promoters. The Rep expression products are collectively required for replicating the AAV genome.

By "AAV cap coding region" is meant the region of the AAV genome which encodes the capsid proteins VP1, VP2, and VP3, or functional homologues thereof. These Cap expression products supply the packaging functions which are collectively required for packaging the viral genome.

In some embodiments, AAV capsids utilized for delivery of the CasX, gNA, and, optionally, donor template nucleotides or polynucleotides encoding the CAR and/or the expression cassette for the cytokines, to a host cell can be derived from any of several AAV serotypes, including without limitation, AAV1, AAV2, AAV3, AAV4, AAV5, AAV6, AAV7, AAV8, AAV9, AAV10, AAV-Rh74 (Rhesus macaque-derived AAV), and AAVRh10, and the AAV ITRs are derived from AAV serotype 2.

In order to produce rAAV viral particles, an AAV expression vector is introduced into a suitable host cell using known techniques, such as by transfection. Packaging cells are typically used to form virus particles; such cells include HEK293 or HEK293T cells (and other cells known in the art), which package adenovirus. A number of transfection techniques are generally known in the art; see, e.g., Sambrook et al. (1989) Molecular Cloning, a laboratory manual, Cold Spring Harbor Laboratories, New York. Particularly suitable transfection methods include calcium phosphate co-precipitation, direct microinjection into cultured cells, electroporation, liposome mediated gene transfer, lipid-mediated transduction, and nucleic acid delivery using high-velocity microprojectiles.

In some embodiments, host cells transfected with the above-described AAV expression vectors are rendered capable of providing AAV helper functions in order to replicate and encapsidate the nucleotide sequences flanked by the AAV ITRs to produce rAAV viral particles. AAV helper functions are generally AAV-derived coding sequences which can be expressed to provide AAV gene products that, in turn, function in trans for productive AAV replication. AAV helper functions are used herein to complement necessary AAV functions that are missing from the AAV expression vectors. Thus, AAV helper functions include one, or both of the major AAV ORFs (open reading frames), encoding the rep and cap coding regions, or functional homologues thereof. Accessory functions can be introduced into and then expressed in host cells using methods known to those of skill in the art. Commonly, accessory functions are provided by infection of the host cells with an unrelated helper virus. In some embodiments, accessory functions are provided using an accessory function vector. Depending on the host/vector system utilized, any of a number of suitable transcription and translation control elements, including constitutive and inducible promoters, transcription enhancer elements, transcription terminators, etc., may be used in the expression vector.

In other embodiments, suitable vectors may include virus-like particles (VLP). Virus-like particles (VLPs) are particles that closely resemble viruses, but do not contain viral genetic material and are therefore non-infectious. In some embodiments, VLPs comprise a polynucleotide encoding a transgene of interest, for example any of the CasX protein and/or a gNA embodiments, and, optionally, donor template polynucleotides or polynucleotides encoding CAR, described herein, packaged with one or more viral structural proteins.

In other embodiments, the disclosure provides VLPs produced in vitro that comprise a CasX:gNA RNP complex and, optionally, a donor template or polynucleotides encoding CAR, engineered TCR, or fusion polypeptides comprising subunits of the engineered TCR. Combinations of structural proteins from different viruses can be used to create VLPs, including components from virus families including Parvoviridae (e.g., adeno-associated virus), Retroviridae (e.g., HIV), Flaviviridae (e.g., Hepatitis C virus), Paramyxoviridae (e.g., Nipah) and bacteriophages (e.g., QP, AP205). In some embodiments, the disclosure provides VLP systems designed using components of retrovirus, including lentiviruses such as HIV, in which individual plasmids comprising polynucleotides encoding the various components are introduced into a packaging cell that, in turn, produce the VLP. In some embodiments, the disclosure provides VLP comprising one or more components of a gag polyprotein selected from the group of matrix protein (MA), nucleocapsid protein (NC), capsid protein (CA), p1-p6 protein, and a protease cleavage site wherein the resulting VLP particle encapsidates a CasX:gNA RNP, and wherein the VLP particle further comprises targeting glycoproteins on the surface that provides tropism to the target cell, wherein upon administration and entry into the target cell, the RNP molecule is free to be transported into the nucleus of the cell. In other embodiments, the disclosure provides VLP comprising one or more components of a gag polyprotein selected from the group of matrix protein (MA), nucleocapsid protein (NC), capsid protein (CA), p1-p6 protein, one or more components of a pol polyprotein, a protease cleavage site, wherein the resulting VLP particle encapsidates a CasX:gNA RNP, and wherein the VLP particle further comprises targeting glycoproteins on the surface that provides tropism to the target cell, wherein upon administration and entry into the target cell, the RNP molecule is free to be transported into the nucleus of the cell. The foregoing offers advantages over other vectors in the art in that viral transduction to dividing and non-dividing cells is efficient and that the VLP delivers potent and short-lived RNP that escape a subject's immune surveillance mechanisms that would otherwise detect a foreign protein. In some embodiments, a system to make VLP in a host cell comprises polynucleotides encoding one or more components selected from i) a gag polyprotein or portions thereof; ii) a CasX protein of any of the embodiments described herein; iii) a protease cleavage site; iv) a protease; v) a guide RNA of any of the embodiments described herein; vi) a pol polyprotein or portions thereof, vii) a pseudotyping glycoprotein or antibody fragment that provides for binding and fusion of the VLP to a target cell; and viii) a CAR or engineered TCR. The envelope protein or glycoprotein can be derived from any enveloped viruses known in the art to confer tropism to VLP, including but not limited to the group consisting of Argentine hemorrhagic fever virus, Australian bat virus, *Autographa californica* multiple nucleopolyhedrovirus, Avian leukosis virus, baboon endogenous virus, Bolivian hemorrhagic fever virus, Boma disease virus, Breda virus, Bunyamwera virus, Chandipura virus, Chikungunya virus, Crimean-Congo hemorrhagic fever virus, Dengue fever virus, Duvenhage virus, Eastern equine encephalitis virus, Ebola hemorrhagic fever virus, Ebola Zaire virus, enteric adenovirus, Ephemerovirus, Epstein-Bar virus (EBV), European bat virus 1, European bat virus 2, Fug Synthetic gP Fusion, Gibbon ape leukemia virus, Hantavirus, Hendra virus, hepatitis A virus, hepatitis B virus, hepatitis C virus, hepatitis D virus, hepatitis E virus, hepatitis G Virus (GB virus C), herpes simplex virus type 1, herpes simplex virus type 2, human cytomegalovirus (HHV5), human foamy virus, human herpesvirus (HHV), human Herpesvirus 7, human herpesvirus type 6, human herpesvirus type 8, human immunodeficiency virus 1 (HIV-1), human metapneumovirus, human T-lymphotro pic virus 1, influenza A, influenza B, influenza C virus, Japanese encephalitis virus, Kaposi's sarcoma-associated herpesvirus (HHV8), Kaysanur Forest disease virus, La Crosse virus, Lagos bat virus, Lassa fever virus, lymphocytic choriomeningitis virus (LCMV), Machupo virus, Marburg hemorrhagic fever virus, measles virus, Middle eastern respiratory syndrome-related coronavirus, Mokola virus, Moloney murine leukemia virus, monkey pox, mouse mammary tumor virus, mumps virus, murine gammaherpesvirus, Newcastle disease virus, Nipah virus, Nipah virus, Norwalk virus, Omsk hemorrhagic fever virus, papilloma virus, parvovirus, pseudorabies virus, Quaranfil virus, rabies virus, RD 114 Endogenous Feline Retrovirus, respiratory syncytial virus (RSV), Rift Valley fever virus, Ross River virus, rRotavirus, Rous sarcoma virus, rubella virus, Sabia-associated hemorrhagic fever virus, SARS-associated coronavirus (SARS-CoV), Sendai virus, Tacaribe virus, Thogotovirus, tick-borne encephalitis causing virus, varicella zoster virus (HHV3), varicella zoster virus (HHV3), variola major virus, variola minor virus, Venezuelan equine encephalitis virus, Venezuelan hemorrhagic fever virus, vesicular stomatitis virus (VSV), VSV-G, Vesiculovirus, West Nile virus, western equine encephalitis virus, and Zika Virus. In some embodiments, the packaging cell used for the production of VLP is selected from the group consisting of HEK293 cells, *Lenti*-X 293T cells, BHK cells, HepG2 cells, Saos-2 cells, HuH7 cells, NS0 cells, SP2/0 cells, YO myeloma cells, A549 cells, P3X63 mouse myeloma cells, PER cells, PER.C6 cells, hybridoma cells, VERO cells, NIH3T3 cells, COS cells, WI38 cells, MRC5 cells, A549 cells, HeLa cells, CHO cells, or HT1080 cells.

VII. Cells

In some embodiments, the present disclosure provides a population of cells that has been modified to knock-down or knock out one or more proteins of the cell involved in antigen processing, antigen presentation, antigen recognition, and/or antigen response. In other embodiments, the present disclosure provides a population of cells that has been modified to knock in one or more chimeric antigen receptor (CAR) or fusion polypeptides comprising subunits of an engineered TCR with binding affinity for a disease antigen. In still other embodiments, the present disclosure provides a population of cells that has been modified to knock in one or more T cell-derived signaling chain polypeptides. In some embodiments, the population of cells comprises all of the foregoing modifications; e.g., the knock-down/knock-out of the one or more proteins of the cell involved in antigen processing, antigen presentation, antigen recognition, and/or antigen response, the knock in of the one or more chimeric antigen receptor (CAR) or fusion polypeptides of an engineered TCR specific for a disease antigen. Such modified cells altered in this manner are useful for immunotherapy applications, for example for ex vivo preparation of cells bearing a CAR, for use in a subject in need thereof.

In some embodiments, the disclosure provides a population of cells comprising a CasX:gNA system comprising a CasX protein and one or more gNA, wherein the gNA comprises a targeting sequence complementary to a target nucleic acid sequence of a gene encoding a protein involved in antigen processing, antigen presentation, antigen recognition, and/or antigen response, wherein the CasX and gNA are designed to modify the gene encoding the protein. In one embodiment of the foregoing, the CasX:gNA system is designed to knock-down/knock-out genes encoding the one or more proteins involved in antigen processing, antigen presentation, antigen recognition, and/or antigen response, resulting in the modified population of cells. In another embodiment of the foregoing, the CasX:gNA system is designed to knock-down/knock-out genes encoding the MHC Class I molecules, resulting in the modified population of cells. In some embodiments, the protein is an immune cell surface marker. In other embodiments, the protein is an intracellular protein. In some embodiments, the CasX and one or more gNA are introduced into the population of cells complexed as an RNP, such that the RNP can then modify the target gene. In other cases, the CasX and the one or more gNA are introduced into the population of cells as encoding polynucleotides using a vector.

In other embodiments, the populations of cells have been modified by either contacting the cell with a CasX protein, one or more gNA comprising a targeting sequence, and a donor template wherein the donor template is inserted into or replaces all or a portion of the target nucleic acid sequence of a cell gene encoding a protein involved in antigen processing, antigen presentation, antigen recognition, and/or antigen response. In the foregoing embodiment, the donor template comprises at least a portion of a target gene, wherein the target gene portion is selected from an exon, an intron, an intron-exon junction, or a regulatory element and the modification of the cell results in a mutation of the wild-type sequence and the knocking-down or knocking-out of the target gene. In some cases, the donor template is a single-stranded DNA template or a single stranded RNA template. In other cases, the donor template is a double-stranded DNA template. In some cases, the cell is contacted with a CasX and a gNA wherein the gNA is a guide RNA (gRNA). In other cases, the cell is contacted with a CasX and a gNA wherein the gNA is a guide DNA (gDNA). In other cases, the cell is contacted with a CasX and a gNA wherein the gNA is a chimera comprising DNA and RNA.

As described herein, in embodiments of any of the combinations, each of said gNA molecules (a combination of the scaffold and targeting sequence, which can be configured as a sgRNA or a dgRNA) can be provided as an RNP complexed with a CasX molecule described herein. An RNP can be introduced into a cell to be modified via any suitable method, including via electroporation, injection, nucleofection, delivery via liposomes, delivery by nanoparticles, or using a protein transduction domain (PTD) conjugated to one or more components of the CasX:gNA. Additional methods of modification of the cells using the CasX:gNA system components include viral infection, transfection, conjugation, protoplast fusion, particle gun technology, calcium phosphate precipitation, direct microinjection, and the like. The choice of method is generally dependent on the type of cell being transformed and the circumstances under which the transformation is taking place; e.g., in vitro, ex vivo, or in vivo. A general discussion of these methods can be found in Ausubel, et al, Short Protocols in Molecular Biology, 3rd ed., Wiley & Sons, 1995.

In exemplary embodiments, the protein involved in antigen processing, antigen presentation, antigen recognition, and/or antigen response is selected from beta-2-microglobulin (B2M), T cell receptor alpha chain constant region (TRAC), class II major histocompatibility complex transactivator (CIITA), ICP47, T cell receptor beta constant 1 (TRBC1), T cell receptor beta constant 2 (TRBC2), human leukocyte antigen A (HLA-A), human leukocyte antigen B (HLA-B), PD-1, CTLA-4, LAG-3, TIM-3, 2B4, TIGIT, CISH, ADORA2A, NKG2A, or TGFβ Receptor 2 (TGFβRII). In other embodiments, the protein is selected from cluster of differentiation 247 (CD247), CD3D, CD3E, CD3G, CD52, human leukocyte antigen C (HLA-C), deoxycytidine kinase (dCK), or FKBP1A. In still other embodiments, the protein to be modified in the cell is selected from one of i) beta-2-microglobulin (B2M), T cell receptor alpha chain constant region (TRAC), class II major histocompatibility complex transactivator (CIITA), ICP47, T cell receptor beta constant 1 (TRBC1), T cell receptor beta constant 2 (TRBC2), TIGIT, CISH ADORA2A, NKG2A, PD-1, CTLA-4, LAG-3, TIM-3, 2B4, human leukocyte antigen A (HLA-A), human leukocyte antigen B (HLA-B), or TGFβ Receptor 2 (TGFβRII) and another selected from one of ii) cluster of differentiation 247 (CD247), CD3D, CD3E, CD3G, CD52, human leukocyte antigen C (HLA-C), deoxycytidine kinase (dCK), or FKBP1A.

In some embodiments, the population of cells includes one or more cells that have reduced or eliminated expression of a component of the T-cell receptor (TCR). In some embodiments, the T-cell receptor is a native T-cell receptor. In some embodiments, the reduced or eliminated expression of a component of the T-cell receptor (TCR) includes reduced or eliminated expression of TRAC. In other embodiments, the reduced or eliminated expression of a component of the T-cell receptor (TCR) includes reduced or eliminated expression of TRBC1. In still other embodiments, the reduced or eliminated expression of a component of the T-cell receptor (TCR) includes reduced or eliminated expression of TRBC2. In still other embodiments, the reduced or eliminated expression of a component of the T-cell receptor (TCR) includes reduced or eliminated expression of CD3G. In yet other embodiments, the reduced or eliminated expression of a component of the T-cell receptor (TCR) includes reduced or eliminated expression of CD3D. In other embodiments, the reduced or eliminated expression of a component of the T-cell receptor (TCR) includes reduced or eliminated expression of CD3E. In some cases, the reduced or eliminated expression of said component of the TCR is the result of introduction of one or more, e.g., one or two, e.g., one gNA molecules described herein specific to the component of the TCR into the cell. For example, the method employing the CasX:gNA system can introduce into the cell an indel, e.g., a frameshift mutation, e.g., as described herein, at or near the target sequence of a targeting domain of a gNA molecule to the TCR. In other cases, the reduced or eliminated expression of said component of the TCR is the result of introduction of the CasX, one or more gNA, and a donor template comprising one or more mutations in comparison to the TCR to be knock-down or knocked-out. In some embodiments, the population of cells includes at least about 50%, e.g., at least about 60%, e.g., at least about 70%, e.g., at least about 80%, e.g., at least about 90% or more cells (as described herein) which exhibit reduced or eliminated expression of a component of the TCR; e.g., TRAC. In embodiments, said reduced or eliminated expression of a component of the TCR is as measured by flow cytometry or other methods know in the art. In other embodiments, at least 70%, at least 75%, at least 80%, at least 85%, at least 90%, or at least 95% of the modified cells do not express a detectable level of wild-type T cell receptor.

In some embodiments, (including either alternatively, or in addition to, the reduced or eliminated expression of a component of the TCR) the cell or the population of cells includes one or more cells that have reduced or eliminated expression of beta-2 microglobulin (B2M). In embodiments, said reduced or eliminated expression of said B2M is the result of introduction of one or more, e.g., one or two, e.g., one gNA molecule described herein targeted to the gene encoding B2M into said cell. In the foregoing embodiment, the targeting sequence of the gNA comprises a sequence selected from the group consisting of sequences set forth in Table 3A, Table 13, and Table 16, or a sequence having at least about 65%, at least about 75%, at least about 85%, or at least about 95% identity thereto. In some embodiments, the modified cell includes an indel, e.g., a frameshift mutation, as described herein, at or near the target sequence of a targeting domain of a gNA molecule to said B2M. In some embodiments, the population of cells includes at least about 50%, e.g., at least about 60%, e.g., at least about 70%, e.g., at least about 80%, e.g., at least about 90% or more cells (as described herein) which exhibit reduced or eliminated expression of B2M. In embodiments, said reduced or eliminated expression of B2M is as measured by flow cytometry or other methods know in the art.

In certain embodiments, (including either alternatively, or in addition to, the reduced or eliminated expression of a component of the TCR and/or B2M) the cell or population of cells includes one or more cells that have reduced or eliminated expression of CIITA. In the foregoing embodiment, the targeting sequence of the gNA comprises a sequence selected from the group consisting of sequences set forth in Table 3C, or a sequence having at least about 65%, at least about 75%, at least about 85%, or at least about 95% identity thereto. In some embodiments, said reduced or eliminated expression of said CIITA is the result of introduction of one or more, e.g., one or two, e.g., one gNA molecule targeted to the gene encoding said CIITA described herein into said cell. In the foregoing, the targeting sequence of the gNA comprises a sequence selected from the group consisting of sequences set forth in Table 3C, or a sequence having at least about 65%, at least about 75%, at least about 85%, or at least about 95% identity thereto. In embodiments, the cell includes an indel, e.g., a frameshift mutation, e.g., as described herein, at or near the target sequence of a targeting domain of a gNA molecule to said CIITA. In embodiments, the population of cells includes at least about 50%, e.g., at least about 60%, e.g., at least about 70%, e.g., at least about 80%, e.g., at least about 90% or more cells (as described herein) which exhibit reduced or eliminated expression of CIITA. In embodiments, said reduced or eliminated expression of CIITA is as measured by flow cytometry or other methods know in the art.

In other embodiments, the disclosure provides populations of cells wherein the cells have been modified such that at least about 50%, at least about 60%, at least about 70%, at least about 80%, at least about 90%, or at least about 95% of the cells do not express a detectable level of at least two of the proteins selected from the group consisting of B2M, TRAC, and CIITA. In still other embodiments, the disclosure provides populations of cells wherein the cells have been modified such that at least about 50%, at least about 60%, at least about 70%, at least about 80%, at least about 90%, or at least about 95% of the cells do not express a detectable level of the proteins B2M, TRAC, and CIITA. In other embodiments, the disclosure provides a population of cells, wherein the cells have been modified such that at least 70%, at least 75%, at least 80%, at least 85%, at least 90%, or at least 95% of the modified cells do not express a detectable level of MHC Class I molecules or a wild-type T-cell receptor. In other embodiments, the disclosure provides populations of cells modified to produce CAR and are further modified such that at least about 50%, at least about 60%, at least about 70%, at least about 80%, at least about 90%, or at least about 95% of the cells comprise an inducible expression cassette coding for one or more immune stimulatory cytokines selected from the group consisting of IL-7, IL-12, IL-15, and IL-18.

In some embodiments, the present disclosure provides populations of cells modified to: i) have reduced or eliminated expression of MHC Class I molecules and/or a wild-type T-cell receptor, and ii) express CAR or engineered TCR. Such cells are capable of specifically binding a tumor antigen of a cell that is a ligand of the CAR or engineered TCR, whereupon such binding, the modified cells are capable of a response selected from: i) becoming activated; ii) inducing proliferation of the modified cell; iii) cytokine secretion by the modified cell; or iv) inducing cytotoxicity of the cell bearing said tumor antigen. For example, a population of cells may have reduced or eliminated expression of wild type TRAC and TRBC1, and express fusion polypeptides comprising the TRAC and/or TRBC1 transmembrane and intracellular domain fused to an antigen binding domain. Activation includes a clonal expansion and differentiation, expression of cytokines, including IFN-γ, TNF-α, or IL-2. The production of cytokines and assessment of cytotoxicity can be determined by standard assays such as ELISA, $^{51}$CR release, flow-cytometry, and other such assays known in the art.

In exemplary embodiments in which it is intended to reduce or eliminate expression in the cell or population of cells of both a component of the T cell receptor, e.g., TRAC, (including embodiments when expression or function of an additional target, e.g., more than one additional target, is also reduced or eliminated), the gNA targeting sequence molecule which targets TRAC is selected from a sequence of Table 3B. For example, the cell exhibits reduced or eliminated expression of a component of the TCR (e.g., TRAC, TRBC1, TRBC2, CD3E, CD3G, and/or CD3D), and reduced or eliminated expression of a target of an immunosuppressant or immune checkpoint protein, e.g., FKBP1A, or proteins selected from the group consisting of PD-1, CISH, CTLA-4, LAG-3, TIM-3, 2B4, TIGIT, ADORA2A, NKG2A, cluster of differentiation 247 (CD247), CD3D, CD3E, CD3G, CD52, human leukocyte antigen C (HLA-C), and deoxycytidine kinase (dCK). As described herein, in embodiments of any of the combinations, each of said gNA molecules (a combination of the scaffold and targeting sequence, which can be configured as, for example, a sgRNA or a dgRNA) can be provided as an RNP with a CasX molecule described herein for the modification of the population of the cells. In other embodiments of any of the combinations, each of said gNA molecules (a combination of the scaffold and targeting sequence, which can be configured as, for example, a sgRNA or a dgRNA) and the CasX can be provided as encoded polynucleotides within a vector for the modification of the population of the cells.

In some embodiments, the population of cells are animal cells, for example, derived from a rodent, rat, mouse, rabbit or dog cell. In some embodiments, the cell is a human cell. In some embodiments, the cell is a non-human primate cell; e.g., a cynomolgus monkey cell. In some embodiments, the cell is a progenitor cell, a hematopoietic stem cell, or a pluripotent stem cell. In one embodiment, the cell is an induced pluripotent stem cell. In some embodiments, the cell is an immune cell. In some embodiments, the cell is an immune effector cell (e.g., a population of cells including one or more immune effector cells), for example, a T cell, NK cell, B cell, a macrophage, or a dendritic cells. T cells include, but are not limited to, regulatory T cells (TREG), gamma-delta T cells, helper T cells and cytotoxic T cells. In some embodiments, the cell is a T cell selected from the group consisting of CD4+ T cells, CD8+ T cells, or a combination thereof. In some embodiments, the population of cells are autologous or allogeneic (genetically mismatched) with respect to a subject to be administered said population of cells.

In some embodiments, the disclosure provides a cell or population of cells that are a CAR or engineered TCR-expressing, and that have been modified to reduce or eliminate one or more proteins involved with antigen processing, presentation, recognition, or response, as described above. In some embodiments, a CAR or engineered TCR cell, as described herein, is modified and/or altered by the methods described herein, ex vivo, by the introduction of a polynucleotide encoding the CAR or engineered TCR, or a vector comprising the polynucleotide. In other embodiments, CAR or engineered TCR cell, as described herein, is modified and/or altered by the methods described herein, in vivo utilizing the CasX:gNA molecules and/or compositions (e.g., compositions comprising CasX, more than one gNA molecule and, optionally, a donor template, as well as a polynucleotide encoding the CAR) that are introduced into a cell as described herein. In the embodiments, the cell has been, is, or will be, modified to express a chimeric antigen receptor (CAR) or engineered TCR, as described herein (for example, the cell includes, or will include, a polynucleotide sequence encoding a CAR, or a fusion protein comprising a subunit of the engineered TCR). In embodiments, the CAR or engineered TCR has specific binding affinity for antigen selected from Cluster of Differentiation 19 (CD19), CD3, CD8, CD7, CD10, CD20, CD22, CD30, CLL1, CD33, CD34, CD38, CD41, CD44, CD47, CD49f, CD56, CD70, CD74, CD99, CD123, CD133, CD138, carbonix anhydrase IX (CAIX), CC chemokine receptor 4 (CCR4), ADAM metallopeptidase domain 12 (ADAM12), adhesion G protein-coupled receptor E2 (ADGRE2), alkaline phosphatase placental-like 2 (ALPPL2), alpha 4 Integrin, angiopoietin-2 (ANG2), B-cell maturation antigen (BCMA), CD44V6, carcinoembryonic antigen (CEA), CEAC, CEACAM5, Claudin 6 (CLDN6), CLDN18, C-type lectin domain family 12 member A (CLEC12A), mesenchymal-epithelial transition factor (cMET), cytotoxic T-lymphocyte-associated protein 4 (CTLA4), epidermal growth factor receptor 1 (EGF1R), EGFR-VIII, epithelial glycoprotein 2 (EGP-2), EGP-40, EphA2, ENPP3, epithelial cell adhesion molecule (EpCAM), erb-B2,3,4, folate binding protein (FBP), fetal acetylcholine receptor, folate receptor-a, folate receptor 1 (FOLR1), G protein-coupled receptor 143 (GPR143), glutamate metabotropic receptor 8 (GRM8), glypican-3 (GPC3), ganglioside GD2, ganglioside GD3, human epidermal growth factor receptor 1 (HER1), human epidermal growth factor receptor 2 (HER2), HER3, Integrin B7, intercellular cell-adhesion molecule-1 (ICAM-1), human telomerase reverse transcriptase (hTERT), Interleukin-13 receptor a2 (IL-13R-a2), K-light chain, Kinase insert domain receptor (KDR), Lewis-Y (LeY), chondromodulin-1 (LECT1), L1 cell adhesion molecule, Lysophosphatidic acid receptor 3 (LPAR3), melanoma-associated antigen 1 (MAGE-A1), mesothelin, mucin 1 (MUC1), MUC16, melanoma-associated antigen 3 (MAGEA3), tumor protein p53 (p53), Melanoma Antigen Recognized by T cells 1 (MARTl), glycoprotein 100 (GP100), Proteinase3 (PR1), ephrin-A receptor 2 (EphA2), Natural killer group 2D ligand (NKG2D ligand), New York esophageal squamous cell carcinoma 1 (NY-ESO-1), oncofetal antigen (h5T4), prostate-specific membrane antigen (PSMA), programmed death ligand 1 (PDL-1), receptor tyrosine kinase-like orphan receptor 1 (ROR1), trophoblast glycoprotein (TPBG), tumor-associated glycoprotein 72 (TAG-72), tumor-associated calcium signal transducer 2 (TROP-2), tyrosinase, survivin, vascular endothelial growth factor receptor 2 (VEGF-R2), Wilms tumor-1 (WT-1), leukocyte immunoglobulin-like receptor B2 (LILRB2), Preferentially Expressed Antigen In Melanoma (PRAME), T cell receptor beta constant 1 (TRBC1), TRBC2, and (T-cell immunoglobulin mucin-3) TIM-3. In the foregoing, the CAR or engineered TCR comprises an antigen binding domain selected from single domain antibody, linear antibody, or single-chain variable fragment (scFv), which can be derived from a reference antibody; e.g., an antibody of Table 5 (having the VL, VH, and/or the CDR sequences of Table 5). In some embodiments, the antigen binding domain exhibits an affinity with an equilibrium binding constant for the target antigen of between or between about $10^{-5}$ and $10^{-12}$ M and all individual values and ranges therein (e.g., $10^{-5}$ M, $10^{-6}$ M, $10^{-7}$ M, $10^{-8}$M, $10^{-9}$M, $10^{-10}$M, $10^{-11}$M, or $10^{-2}$ M); such binding affinity being “specific”. In some embodiments, the CAR or engineered TCR includes an antigen binding domain, a transmembrane domain derived from a polypeptide selected from the group consisting of CD3-zeta, CD4, CD8, and CD28, and an intracellular signaling domain, which can be linked by spacer sequences. In some embodiments, the encoded CAR further comprises one or more T cell-derived signaling chain polypeptides, including, but not limited to of CD3-zeta, CD27, CD28, 4-1BB (41BB), ICOS, or OX40, linked to the CAR antigen binding domain either directly, or by domain hinge and/or a spacer. The hinge domain can be an immunoglobulin-like hinge, or a hinge domain isolated or derived from CD8a molecule (CD8) or CD28. The hinge, spacer, and transmembrane domains connect the antigen binding domain to the activation domains and anchor the CAR in the T-cell membrane. In other embodiments, the CAR or engineered TCR-expressing cell described herein can further comprise a second CAR or engineered TCR, e.g., a second CAR that includes a different antigen binding domain, e.g., to the same target or a different target (e.g., a target other than a cancer associated antigen described herein or a different cancer associated antigen described herein, supra). In some embodiments, the second CAR or engineered includes an antigen binding domain to a target expressed on the same cancer cell type as the cancer associated antigen. In some embodiments, the CAR-expressing cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain. While not wishing to be bound by theory, placement of a costimulatory T cell-derived signaling domain, e.g., CD27, CD28, 4-1BB (41BB), ICOS, or OX40, onto the first CAR, and the primary signaling domain, e.g., CD3 zeta, on the second CAR can limit the CAR activity to cells where both targets are expressed. In some embodiments, the CAR expressing cell comprises a first disease (e.g. cancer) associated antigen CAR that includes an antigen binding domain that binds a target antigen described herein, a transmembrane domain and a costimulatory domain and a second CAR that targets a different target antigen (e.g., an antigen expressed on that same cell type as the first target antigen) and includes an antigen binding domain, a transmembrane domain and a primary signaling domain. In other embodiments, the CAR expressing cell comprises a first CAR that includes an antigen binding domain that binds a target antigen described herein, a transmembrane domain and a primary signaling domain and a second CAR that targets an antigen other than the first target antigen (e.g., an antigen expressed on the same cancer cell type as the first target antigen) and includes an antigen binding domain to the antigen, a transmembrane domain and a costimulatory signaling domain.

In another embodiment, the present disclosure provides populations of CAR or engineered TCR-expressing cells modified with inducible expression cassettes coding for expression of immune stimulatory cytokines such as IL-7, IL-12, IL-15, and/or IL-18, wherein the cytokines improve CAR or engineered TCR cell expansion and persistence while rendering them resistant to the immunosuppressive tumor environment when administered to a subject. In some embodiments, the disclosure provides a population of cells, wherein at least 70%, at least 75%, at least 80%, at least 85%, at least 90%, or at least 95% of the modified cells of the population express a detectable level of the CAR or engineered TCR.

In embodiments, a population of CAR or engineered TCR-expressing cells of the invention in which expression or function of one or more proteins has been reduced or eliminated by the methods described herein, maintains the ability to become activated and to proliferate in response to stimulation, for example, binding of the CAR or engineered TCR to its target antigen. In embodiments, the proliferation occurs ex vivo such that the population of cells can be expanded. In one embodiment, the population of CAR or engineered TCR-expressing cells is expanded by in vitro culture in an appropriate medium under appropriate growth conditions. In other embodiments, the proliferation occurs in vivo. In embodiments, the proliferation occurs both ex vivo and in vivo. In the embodiments, the level of proliferation is substantially the same as the level of proliferation exhibited by the same cell type (e.g., a CAR-expressing cell of the same type) but which has not had expression or function of one or more proteins reduced or eliminated.

The method provides that immune cells; e.g., T cells, TREG cells, gamma-delta T cells, NK cells, B cells, macrophages, or dendritic cells, can be obtained from a unit of blood collected from a subject using any number of techniques known to the skilled artisan. In one exemplary aspect, cells from the circulating blood of an individual are obtained by apheresis. The apheresis product typically contains lymphocytes, including T cells, monocytes, granulocytes, B cells, other nucleated white blood cells, red blood cells, and platelets. In some embodiments, the T cells are CD4+ T cells, CD8+ T cells, or a combination thereof. The cells collected by apheresis may be washed to remove the plasma fraction and, optionally, to place the cells in an appropriate buffer or media for subsequent processing steps. In some embodiments, T cells are isolated from peripheral blood lymphocytes by lysing the red blood cells and depleting the monocytes, for example, by centrifugation through a PERCOLL™ gradient or by counterflow centrifugal elutriation. The method may include the steps of i) introducing the CasX:gNA system components for the editing of the target nucleic acids; ii) introducing a nucleic acid encoding a CAR and/or one or more fusion polypeptides of an engineered TCR of the embodiments to the cells; iii) i) expansion of the cells, and iv) cryopreservation of the cells for subsequent administration to the subject. The procedure for ex vivo expansion of hematopoietic stem and progenitor cells is described in U.S. Pat. No. 5,199,942, incorporated herein by reference, can be applied to the cells of the present invention.

Among the sub-types and subpopulations of T cells and/or of CD4+ and/or of CD8+ T cells are naïve T cells, effector T cells, memory T cells and sub-types thereof, such as stem cell memory T, central memory T, effector memory T, or terminally differentiated effector memory T cells, tumor-infiltrating lymphocytes, immature T cells, mature T cells, helper T cells, cytotoxic T cells, mucosa-associated invariant T cells, naturally occurring and adaptive regulatory T (Treg) cells, helper T cells, such as TH1 cells, TH2 cells, TH3 cells, TH17 cells, TH9 cells, TH22 cells, follicular helper T cells, alpha/beta T cells, and delta/gamma T cells.

The methods described herein can include selection of a specific subpopulation of immune effector cells, e.g., T cells, that are a T regulatory cell-depleted population, CD25+ depleted cells, using, e.g., a negative selection technique, e.g., described herein. Preferably, the population of T regulatory depleted cells contains less than 30%, 25%, 20%, 15%, 10%, 5%, 4%, 3%, 2%, 1% of CD25+ cells. In some embodiments, the method provides that T regulatory cells, e.g., CD25+ T cells, are removed from the population using an anti-CD25 antibody, or fragment thereof, or a CD25-binding ligand, IL-2. In other embodiments, the anti-CD25 antibody is conjugated to a substrate, e.g., a bead, or is otherwise coated on a substrate over which the population of cells is added and washed to effect the separation.

In other embodiments, T cells are isolated from peripheral blood lymphocytes by lysing the red blood cells and depleting the monocytes, for example, by centrifugation through a PERCOLL™ gradient or by counterflow centrifugal elutriation. The cells typically are primary cells, such as those isolated directly from a subject and/or isolated from a subject and frozen.

The methods described herein can further include removing cells from the population which express a disease antigen, e.g., a tumor antigen that does not comprise CD25, e.g., CD19, CD30, CD38, CD123, CD20, CD14 or CD11b, to thereby provide a population of T regulatory depleted, e.g., CD25+ depleted, and tumor antigen depleted cells that are suitable for expression of a CAR described herein. In some embodiments, tumor antigen expressing cells are removed simultaneously with the T regulatory, e.g., CD25+ cells. For example, an anti-CD25 antibody, or fragment thereof, and an anti-tumor antigen antibody, or fragment thereof, can be attached to the same substrate, e.g., a bead, which can be used to remove the cells or an anti-CD25 antibody, or fragment thereof, or the anti-tumor antigen antibody, or fragment thereof, can be attached to separate beads, a mixture of which can be used to remove the cells. In other embodiments, the removal of T regulatory cells, e.g., CD25+ cells, and the removal of the tumor antigen expressing cells is sequential, and can occur, e.g., in either order.

T cells for stimulation can also be frozen after a washing step, and the freeze and subsequent thaw step provides a more uniform product by removing granulocytes and to some extent monocytes in the cell population. After the washing step that removes plasma and platelets, the cells may be suspended in a suitable freezing solution. In certain cases, cryopreserved cells are thawed and washed and allowed to rest for one hour at room temperature prior to activation using the methods of the present disclosure.

In other embodiments, the cells of the disclosure (e.g., the immune cells of the disclosure and/or the CAR-expressing cells of the invention) are induced pluripotent stem cells ("iPSCs") or embryonic stem cells (ESCs), or are T cells generated from (e.g., differentiated from) said iPSC and/or ESC. iPSCs can be generated, for example, by methods known in the art, from peripheral blood T lymphocytes, e.g., peripheral blood T lymphocytes isolated from a healthy volunteer. As well, such cells may be differentiated into T cells by methods known in the art (see e.g., Themeli M. et al., Nat. Biotechnol. 31:928 (2013); doi:10.1038/nbt.2678; and WO2014/165707, the contents of each of which are incorporated herein by reference in their entirety).

In some embodiments, the disclosure provides a population of modified cells for use in methods to provide anti-tumor immunity in a subject (immunotherapy) having a disease associated with cancer or a tumor. In some embodiments, the method comprising administering to the subject a therapeutically effective amount of a population of any of the modified cell embodiments described herein.

In some embodiments, the dose of total cells and/or dose of individual sub-populations of cells is within a range of between at or about $10^4$ and at or about $10^9$ cells/kilograms (kg) body weight, such as between $10^5$ and $10^6$ cells/kg body weight, for example, at or about $1\times10^5$ cells/kg, $1.5\times10^5$ cells/kg, $2\times10^5$ cells/kg, or $1\times10^6$ cells/kg body weight. For example, in some embodiments, the cells are administered at, or within a certain range of error of, between at or about $10^4$ and at or about $10^9$ cells/kilograms (kg) body weight, such as between $10^5$ and $10^6$ cells/kg body weight, for example, at or about $1\times10^5$ cells/kg, $1.5\times10^5$ cells/kg, $2\times10^5$ cells/kg, or $1\times10^6$ cells/kg body weight.

In some embodiments, the administration of the effective amount of the modified cells results in an improvement in a clinical parameter or endpoint associated with the disease in the subject, wherein the clinical parameter or endpoint is selected from one or any combination of the group consisting of tumor shrinkage as a complete, partial or incomplete response; time-to-progression, time to treatment failure, biomarker response; progression-free survival; disease free-survival; time to recurrence; time to metastasis; time of overall survival; improvement of quality of life; and improvement of symptoms.

In some embodiments, the disclosure provides a method of preparing cells for immunotherapy in a subject comprising modifying immune effector cells by reducing or eliminating expression of one or more proteins involved in antigen processing, antigen presentation, antigen recognition, and/or antigen response. In some embodiments, the one or more proteins involved in antigen processing, antigen presentation, antigen recognition, and/or antigen response are selected from beta-2-microglobulin (B2M), T cell receptor alpha chain constant region (TRAC), ICP47 polypeptide, class II major histocompatibility complex transactivator (CIITA), T cell receptor beta constant 1 (TRBC1), T cell receptor beta constant 2 (TRBC2), PD-1, CTLA-4, LAG-3, TIM-3, 2B4, CISH, ADORA2A, TIGIT, NKG2A, human leukocyte antigen A (HLA-A), human leukocyte antigen B (HLA-B), TGFβ Receptor 2 (TGFβRII), cluster of differentiation 247 (CD247), CD3D, CD3E, CD3G, CD52, human leukocyte antigen C (HLA-C), deoxycytidine kinase (dCK), or FKBP1A. In some embodiments, the method comprises contacting the target nucleic acid sequence of the immune effector cell with a CasX:gNA system comprising a CasX protein and a guide nucleic acid (gNA), wherein the gNA comprises a targeting sequence (a) complementary to a target nucleic acid sequence for a gene or a portion of a gene encoding the protein, a regulatory element for the gene, or both, or (b) is complementary to a complement of a target nucleic acid sequence of genes encoding the one or more proteins. In some embodiments, the cell has been modified such that expression of the one or more proteins is reduced by at least about 50%, at least about 60%, at least about 70%, at least about 80%, or at least about 90%, or at least about 95% in comparison to a cell that has not been modified. In other embodiments of the method, the cell has been modified such that the cell does not express a detectable level of the one or more proteins. In an exemplary embodiment of the method, the proteins to be knocked-down or knocked-out are selected from B2M, TRAC, or CIITA. In other embodiments of the method, the cell has been modified such that at least 70%, at least 75%, at least 80%, at least 85%, at least 90%, or at least 95% of the modified cells do not express a detectable level of MHC Class I molecules. In other embodiments of the method, the cell has been modified such that at least 70%, at least 75%, at least 80%, at least 85%, at least 90%, or at least 95% of the modified cells do not express a detectable level of wild-type T cell receptor.

In some embodiments, the disclosure provides a method of preparing cells for immunotherapy in a subject that, in addition to modifying immune effector cells by reducing or eliminating expression of a protein involved in antigen processing, antigen presentation, antigen recognition, and/or antigen response, further comprises modifying the cells by introducing a nucleic acid that encodes a chimeric antigen receptor (CAR) specific for a tumor cell antigen. In some embodiments, the tumor cell antigen ligand of the CAR is selected from Cluster of Differentiation 19 (CD19), CD3, CD8, CD7, CD10, CD20, CD22, CD30, CLL1, CD33, CD34, CD38, CD41, CD44, CD47, CD49f, CD56, CD70, CD74, CD99, CD123, CD133, CD138, carbonix anhydrase IX (CAIX), CC chemokine receptor 4 (CCR4), ADAM metallopeptidase domain 12 (ADAM12), adhesion G protein-coupled receptor E2 (ADGRE2), alkaline phosphatase placental-like 2 (ALPPL2), alpha 4 Integrin, angiopoietin-2 (ANG2), B-cell maturation antigen (BCMA), CD44V6, carcinoembryonic antigen (CEA), CEAC, CEACAM5, Claudin 6 (CLDN6), CLDN18, C-type lectin domain family 12 member A (CLEC12A), mesenchymal-epithelial transition factor (cMET), cytotoxic T-lymphocyte-associated protein 4 (CTLA4), epidermal growth factor receptor 1 (EGF1R), EGFR-VIII, epithelial glycoprotein 2 (EGP-2), EGP-40, EphA2, ENPP3, epithelial cell adhesion molecule (EpCAM), erb-B2,3,4, folate binding protein (FBP), fetal acetylcholine receptor, folate receptor-a, folate receptor 1 (FOLR1), G protein-coupled receptor 143 (GPR143), glutamate metabotropic receptor 8 (GRM8), glypican-3 (GPC3), ganglioside GD2, ganglioside GD3, human epidermal growth factor receptor 1 (HER1), human epidermal growth factor receptor 2 (HER2), HER3, Integrin B7, intercellular cell-adhesion molecule-1 (ICAM-1), human telomerase reverse transcriptase (hTERT), Interleukin-13 receptor a2 (IL-13R-a2), K-light chain, Kinase insert domain receptor (KDR), Lewis-Y (LeY), chondromodulin-1 (LECT1), L1 cell adhesion molecule, Lysophosphatidic acid receptor 3 (LPAR3), melanoma-associated antigen 1 (MAGE-A1), mesothelin, mucin 1 (MUC1), MUC16, melanoma-associated antigen 3 (MAGE-A3), tumor protein p53 (p53), Melanoma Antigen Recognized by T cells 1 (MART1), glycoprotein 100 (GP100), Proteinase3 (PR1), ephrin-A receptor 2 (EphA2), Natural killer group 2D ligand (NKG2D ligand), New York esophageal squamous cell carcinoma 1 (NY-ESO-1), oncofetal antigen (h5T4), prostate-specific membrane antigen (PSMA), programmed death ligand 1 (PDL-1), receptor tyrosine kinase-like orphan receptor 1 (ROR1), trophoblast glycoprotein (TPBG), tumor-associated glycoprotein 72 (TAG-72), tumor-associated calcium signal transducer 2 (TROP-2), tyrosinase, survivin, vascular endothelial growth factor receptor 2 (VEGF-R2), Wilms tumor-1 (WT-1), leukocyte immunoglobulin-like receptor B2 (LILRB2), Preferentially Expressed Antigen In Melanoma (PRAME), T cell receptor beta constant 1 (TRBC1), TRBC2, and (T-cell immunoglobulin mucin-3) TIM-3. In some embodiments, the CAR comprises an antigen binding domain selected from linear antibody, single domain antibody (sdAb), or single-chain variable fragment (scFv). In some embodiments, the antigen binding domain is an scFv derived from a reference antibody with specific binding affinity to a tumor cell antigen. In some embodiments, the scFv comprises VH and VL and/or heavy chain and light chain CDRs selected from the group consisting of the sequences set forth in Table 5. In the foregoing embodiment, the VH, VL, and/or the CDRs can have one or more amino acid substitutions wherein the scFv retains specific binding affinity to the tumor antigen.

In other embodiments of the method of preparing cells for immunotherapy in a subject, the nucleic acid encoding the CAR further comprises a nucleic acid encoding at least one intracellular signaling domain, wherein the at least one intracellular signaling domain comprises at least one intracellular signaling domain isolated or derived from CD247 molecule (CD3-zeta), CD27 molecule (CD27), CD28 molecule (CD28), TNF receptor superfamily member 9 (4-1BB), inducible T cell costimulator (ICOS), or TNF receptor superfamily member 4 (OX40). In one embodiment, the at least one intracellular signaling domain comprises: a) a CD3-zeta intracellular signaling domain; b) a CD3-zeta intracellular signaling domain and a 4-1BB or CD28 intracellular signaling domain; c) a CD-zeta intracellular signaling domain, a 4-1BB intracellular signaling domain, and a CD28 intracellular signaling domain; or d) a CD-zeta intracellular signaling domain, a CD28 intracellular signaling domain, a 4-1BB intracellular signaling domain, and a CD27 or OX40 intracellular signaling domain. In other embodiments, the CAR further comprises an extracellular hinge domain, wherein the hinge domain is an immunoglobulin like domain, or wherein the hinge domain is isolated or derived from IgG1, IgG2, or IgG4, or wherein the hinge domain is isolated or derived from CD8a molecule (CD8) or CD28. In some embodiments, the CAR further comprises a transmembrane domain, wherein the transmembrane domain is isolated or derived from the group consisting of CD3-zeta, CD4, CD8, and CD28. In the foregoing, the components of the CAR are operably linked with appropriate linkers to form a single chimeric fusion polypeptide.

In some embodiments, the TCR comprises one or more subunits selected from the group consisting of TCR alpha, TCR beta, CD3-delta, CD3-epsilon, CD-gamma or CD3-zeta, operably linked to the antigen binding domain arranged such that the extracellular antigen binding domain and the subunit form a single chimeric fusion polypeptide. In some embodiments, the single chimeric fusion polypeptide comprises a linker between the TCR subunit and the antigen binding domain.

In some embodiments, the TCR comprises one or more subunits selected from the group consisting of TCR alpha, TCR beta, CD3-delta, CD3-epsilon, CD-gamma or CD3-zeta, operably linked to the antigen binding domain and one or more intracellular domains comprising an intracellular signaling domain arranged such that the extracellular antigen binding domain, the intracellular signaling domain (and appropriate linkers) form a single chimeric fusion polypeptide. The one or more intracellular signaling domains can be isolated or derived from the group consisting of CD247 molecule (CD3-zeta), CD27 molecule (CD27), CD28 molecule (CD28), TNF receptor superfamily member 9 (4-1BB), inducible T cell costimulator (ICOS), or TNF receptor superfamily member 4 (OX40).

In some embodiments, the method further comprises introducing into the immune cells a polynucleic acid encoding an inducible expression cassette coding for an immune stimulatory cytokine selected from the group consisting of IL-7, IL-12, IL-15, and IL-18. In other embodiments, the method further comprises expanding the population of cells by in vitro culture in an appropriate medium and under appropriate conditions, for subsequent administration to a subject in need thereof.

In some embodiments of a method of preparing cells for immunotherapy in a subject, the method further comprises introducing into the immune cells a polynucleic acid encoding a TCR comprising one or more subunits selected from the group consisting of TCR alpha, TCR beta, CD3-delta, CD3-epsilon, CD-gamma or CD3-zeta. In some embodiment, the TCR further comprises an intracellular domain comprising a stimulatory domain from an intracellular signaling domain. In some embodiments, the antigen binding domain of the TCR is operably linked to the one ore more subunits. In some cases, the antigen binding domain of the TCR is an scFv comprising variable heavy (VH) and variable light (VL) and/or heavy chain and light chain CDRs selected from the group consisting of the sequences set forth in Table 5.

VIII. Therapeutic Methods

In another aspect, the present disclosure relates to methods of treating a subject having a disease associated with expression of a tumor antigen or having an autoimmune disease. In some embodiments, the present disclosure provides methods of immunotherapy for treating a disease in a subject in need thereof. In some embodiments of the disclosure, the methods of treatment can prevent, treat and/or ameliorate a disease of a subject by the administration to the subject of a therapeutically effective amount of the cells or populations of cells modified by CasX:gNA system composition(s) and the polynucleic acids of the embodiments described herein. In some embodiments, the method of treatment comprises the administration to the subject of a cell or a population of cells modified by a CasX:gNA composition and, optionally, a donor template, wherein one or more genes encoding one or more proteins involved in antigen processing, antigen presentation, antigen recognition, and/or antigen response are modified. In some cases, the cell or a population of cells have been also been modified to express a CAR or engineered TCR of any of the embodiments described herein. In one embodiment, the disease is a cancer. In another embodiment, the disease is an autoimmune disease. Unlike antibody therapies, the modified cells of the embodiments are able to replicate in vivo, resulting in long-term persistence that can lead to sustained control of the underlying disease. In various aspects, the modified cells administered to the subject, or their progeny, persist in the subject for at least one month, two month, three months, four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, or five years after administration of the modified cells to the subject. By the methods of treatment, the administration of the modified cells results in the killing of the cells causing or related to the underlying disease, such as a tumor cell.

In one embodiment, the disclosure provides a method of treating a subject having a disease associated with expression of a tumor antigen, comprising administering a population of cells wherein the cells have been modified such that expression of one or more proteins involved in antigen processing, antigen presentation, antigen recognition, and/or antigen response is reduced by at least about 50%, at least about 60%, at least about 70%, at least about 80%, at least about 90%, or at least about 95% in comparison to a cell that has not been modified, or wherein the cell does not express a detectable level of the protein. In one embodiment the protein is selected from the group consisting of beta-2-microglobulin (B2M), T cell receptor alpha chain constant region (TRAC), class II major histocompatibility complex transactivator (CIITA), ICP47 polypeptide, T cell receptor beta constant 1 (TRBC1), T cell receptor beta constant 2 (TRBC2), programmed cell death-1 receptor (PD-1), cytotoxic T-lymphocyte-associated protein 4 (CTLA-4), lymphocyte-activation gene 3 (LAG-3), T-cell immunoglobulin and mucin domain 3 (TIM-3), 2B4 (CD244), CISH, ADORA2A, TIGIT, NGK2A, human leukocyte antigen A (HLA-A), human leukocyte antigen B (HLA-B), and TGFβ Receptor 2 (TGFβRII). In another embodiment, the protein is selected from the group consisting of cluster of differentiation 247 (CD247), CD3D, CD3E, CD3G, CD52, human leukocyte antigen C (HLA-C), deoxycytidine kinase (dCK), and FKBP1A. In a particular embodiment, the protein is selected from the group consisting of B2M, TRAC, and CIITA. In some embodiments, the cell to be modified is selected from the group consisting of a rodent cell, a mouse cell, a rat cell, a non-human primate cell, or a human cell. In some embodiments, the cell to be modified is selected from the group consisting of a progenitor cell, a hematopoietic stem cell, and a pluripotent stem call. In one case, the cell is an induced pluripotent stem cell. In some embodiments, the cell to be modified is an immune cell selected from a T cell, Treg cell, NK cell, B cell, macrophage, or dendritic cell.

In the case where the immune cell is a T cell, the T cell can be a CD4+ T cell, a CD8+ T cell, gamma-delta T cells, or a combination thereof. In a particular embodiment, the cells to be modified are autologous with respect to a subject to be administered the cell. In another embodiment, the cells to be modified are allogeneic with respect to a subject to be administered the cell. The methods to modify the cells for administration to a subject have been described herein, but, briefly, the modifying comprises contacting the cells with: a) CasX:gNA system comprising a CasX protein and gNA of any of the embodiments described herein; b) a nucleic acid encoding the CasX protein and gNA; c) a vector comprising the nucleic acid of b); or d) any of a) to c), wherein expression of the one or more proteins (of those listed, above) is reduced or the cell does not express a detectable level of the one or more proteins. In the case of the foregoing target proteins, the method of treatment comprises knocking-down or knocking out expression of the one or more target protein. In the foregoing method of treatment embodiments, the cells can also be modified such that at least 70%, at least 75%, at least 80%, at least 85%, at least 90%, or at least 95% of the modified cells express a detectable level of the chimeric antigen receptor (CAR) or engineered TCR specific for a tumor cell antigen. In the foregoing, the CAR or engineered TCR can be specific for a tumor cell antigen selected from the group consisting of Cluster of Differentiation 19 (CD19), CD3, CD8, CD7, CD10, CD20, CD22, CD30, CLL1, CD33, CD34, CD38, CD41, CD44, CD47, CD49f, CD56, CD70, CD74, CD99, CD123, CD133, CD138, carbonix anhydrase IX (CAIX), CC chemokine receptor 4 (CCR4), ADAM metallopeptidase domain 12 (ADAM12), adhesion G protein-coupled receptor E2 (ADGRE2), alkaline phosphatase placental-like 2 (ALPPL2), alpha 4 Integrin, angiopoietin-2 (ANG2), B-cell maturation antigen (BCMA), CD44V6, carcinoembryonic antigen (CEA), CEAC, CEACAM5, Claudin 6 (CLDN6), CLDN18, C-type lectin domain family 12 member A (CLEC12A), mesenchymal-epithelial transition factor (cMET), cytotoxic T-lymphocyte-associated protein 4 (CTLA4), epidermal growth factor receptor 1 (EGF1R), EGFR-VIII, epithelial glycoprotein 2 (EGP-2), EGP-40, EphA2, ENPP3, epithelial cell adhesion molecule (EpCAM), erb-B2,3,4, folate binding protein (FBP), fetal acetylcholine receptor, folate receptor-a, folate receptor 1 (FOLR1), G protein-coupled receptor 143 (GPR143), glutamate metabotropic receptor 8 (GRM8), glypican-3 (GPC3), ganglioside GD2, ganglioside GD3, human epidermal growth factor receptor 1 (HER1), human epidermal growth factor receptor 2 (HER2), HER3, Integrin B7, intercellular cell-adhesion molecule-1 (ICAM-1), human telomerase reverse transcriptase (hTERT), Interleukin-13 receptor a2 (IL-13R-a2), K-light chain, Kinase insert domain receptor (KDR), Lewis-Y (LeY), chondromodulin-1 (LECT1), L1 cell adhesion molecule, Lysophosphatidic acid receptor 3 (LPAR3), melanoma-associated antigen 1 (MAGE-A1), mesothelin, mucin 1 (MUC1), MUC16, melanoma-associated antigen 3 (MAGEA3), tumor protein p53 (p53), Melanoma Antigen Recognized by T cells 1 (MARTl), glycoprotein 100 (GP100), Proteinase3 (PR1), ephrin-A receptor 2 (EphA2), Natural killer group 2D ligand (NKG2D ligand), New York esophageal squamous cell carcinoma 1 (NY-ESO-1), oncofetal antigen (h5T4), prostate-specific membrane antigen (PSMA), programmed death ligand 1 (PDL-1), receptor tyrosine kinase-like orphan receptor 1 (ROR1), trophoblast glycoprotein (TPBG), tumor-associated glycoprotein 72 (TAG-72), tumor-associated calcium signal transducer 2 (TROP-2), tyrosinase, survivin, vascular endothelial growth factor receptor 2 (VEGF-R2), Wilms tumor-1 (WT-1), leukocyte immunoglobulin-like receptor B2 (LILRB2), Preferentially Expressed Antigen In Melanoma (PRAME), T cell receptor beta constant 1 (TRBC1), TRBC2, and (T-cell immunoglobulin mucin-3) TIM-3. In some embodiments of the method of treatment, the CAR or engineered TCR comprises an antigen binding domain selected from the group consisting of linear antibody, single domain antibody (sdAb), and single-chain variable fragment (scFv). In some cases, the CAR further comprises one or more polypeptides selected from the group consisting of CD3zeta, CD27, CD28, 4-1BB (41BB), ICOS, and OX40. The one or more of CD3-zeta, CD27, CD28, 4-1BB (41BB), ICOS, or OX40 can be linked to the CAR antigen binding domain by an immunoglobulin-like domain hinge and/or a spacer sequence, and further comprises a transmembrane domain derived from a polypeptide selected from the group consisting of CD3-zeta, CD4, CD8, and CD28. In other cases, the cells are further modified by introducing into the immune cell a polynucleic acid encoding an inducible expression cassette coding for an immune stimulatory cytokine selected from the group consisting of IL-7, IL-12, IL-15, and IL-18.

In some embodiments of the method of treating a subject having a disease associated with expression of a tumor antigen, the administering to the subject of a therapeutically effective amount of the modified population of cells of any one of the embodiments described herein can produce a beneficial effect in helping to treat (e.g., cure or reduce the severity) or prevent (e.g., reduce the likelihood of recurrence) of a cancer or a tumor or result in an improvement in a clinical parameter or endpoint associated with the disease in the subject, wherein the clinical parameter or endpoint is selected from one or any combination of the group consisting of tumor shrinkage as a complete, partial or incomplete response; time-to-progression, time to treatment failure, biomarker response; progression-free survival; disease free-survival; time to recurrence; time to metastasis; time of overall survival; improvement of quality of life; and improvement of symptoms.

In the foregoing embodiment, the disease associated with expression of a tumor antigen is a cancer. In some embodiments, the cancer comprises a solid tumor or a liquid tumor. In some embodiments, the cancer is selected from colon cancer, rectal cancer, renal-cell carcinoma, liver cancer, non-small cell carcinoma of the lung, cancer of the small intestine, cancer of the esophagus, melanoma, bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, carcinoma of the fallopian tubes, carcinoma of the endometrium, carcinoma of the cervix, carcinoma of the vagina, carcinoma of the vulva, Hodgkin's Disease, non-Hodgkin's lymphoma, cancer of the endocrine system, cancer of the thyroid gland, cancer of the parathyroid gland, cancer of the adrenal gland, sarcoma of soft tissue, cancer of the urethra, cancer of the penis, solid tumors of childhood, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers, chronic lymphocytic leukemia (CLL), acute leukemias, acute lymphoid leukemia (ALL), B-cell acute lymphoid leukemia (B-ALL), T-cell acute lymphoid leukemia (T-ALL), chronic myelogenous leukemia (CML), acute myeloid leukemia (AML), B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, marginal zone lymphoma, multiple myeloma, myelodysplasia and myelodysplastic syndrome, Hodgkin's lymphoma, plasmablastic lymphoma, plasmacytoid dendritic cell neoplasm, Waldenstrom macroglobulinemia, or pre-leukemia, combinations of said cancers, or metastatic lesions of said cancers. In the method, upon binding of the CAR or engineered TCR-bearing modified cell to the tumor antigen of a cell bearing a ligand of the CAR or engineered TCR, the administered cells are capable of: i) becoming activated; ii) inducing proliferation of the modified cell; iii) cytokine secretion by the modified cell; or iv) inducing cytotoxicity of the cell bearing said tumor antigen. In other embodiments of the method of treating a subject having a disease associated with expression of a tumor antigen, the method further comprises administering a chemotherapeutic agent. Non-limiting examples of chemotherapeutic agents include immunosuppressive agents, such as cyclosporin, azathioprine, methotrexate, mycophenolate, and FK506, or other immunoablative agents such as alemtuzumab, anti-CD3 antibodies or other anti-tumor antibody therapies, cytoxin, fludarabine, cyclosporin, FK506, rapamycin, mycophenolic acid, steroids, FR901228, and cytokines.

In some embodiments, the disclosure provides a method of treating a subject having an autoimmune disease. In some embodiments, the subject having an autoimmune disease is administered an effective amount of a population of allogeneic immune cells (e.g., Treg cells) modified to reduce the expression of one or more proteins involved in antigen processing, presentation, recognition, and/or response.

In another embodiment, the invention provides a method of treatment of a subject having disease associated with expression of a tumor antigen, the method comprising administering to the subject a plurality of cells modified to express a detectable level of the chimeric antigen receptor (CAR) or engineered TCR, and that have a reduced or undetectable level of MHC Class I molecules and/or wild-type T-cell receptor according to a treatment regimen comprising one or more consecutive doses using a therapeutically effective dose of the cells. In one embodiment of the treatment regimen, the therapeutically effective dose of the cells is administered as a single dose. In another embodiment of the treatment regimen, the therapeutically effective dose of the cells is administered to the subject as two or more doses over a period of at least two weeks, or at least one month, or at least two months, or at least three months, or at least four months, or at least five months, or at least six months, or once a year, or every 2 or 3 years. In some embodiments, the dose of total cells and/or dose of individual sub-populations of cells is within a range of between at or about $10^4$ and at or about $10^9$ cells/kilograms (kg) body weight per dose, such as between $10^5$ and $10^6$ cells/kg body weight, for example, at or about $1\times10^5$ cells/kg, $1.5\times10^5$ cells/kg, $2\times10^5$ cells/kg, or $1\times10^6$ cells/kg body weight per dose. For example, in some embodiments, the cells are administered at, or within a certain range of error of, between at or about $10^4$ and at or about $10^9$ cells/kilograms (kg) body weight per dose, such as between $10^5$ and $10^6$ cells/kg body weight, for example, at or about $1\times10^5$ cells/kg, $1.5\times10^5$ cells/kg, $2\times10^5$ cells/kg, or $1\times10^6$ cells/kg body weight per dose.

In another embodiment, the invention provides a method of treatment of a subject having disease associated with expression of a tumor antigen, the method comprising administering to the subject a plurality of cells modified to express a CAR or engineered TCR of any of the embodiments described herein, and further modified such that expression of one or more proteins involved in antigen processing, antigen presentation, antigen recognition, and/or antigen response are reduced by at least about 50%, at least about 60%, at least about 70%, at least about 80%, at least about 90%, or at least about 95% in comparison to a cell that has not been modified, wherein the administration is according to a treatment regimen comprising one or more consecutive doses using a therapeutically effective dose of the cells. In one embodiment of the treatment regimen, the therapeutically effective dose of the cells is administered as a single dose. In another embodiment of the treatment regimen, the therapeutically effective dose of the cells is administered to the subject as two or more doses over a period of at least two weeks, or at least one month, or at least two months, or at least three months, or at least four months, or at least five months, or at least six months, or on an annual basis or every 2 or 3 years. In some embodiments, the treatment regimen results in the improvement of a clinical parameter or endpoint associated with the disease in the subject, wherein the clinical parameter or endpoint is selected from one or any combination of the group consisting of tumor shrinkage as a complete, partial or incomplete response; time-to-progression, time to treatment failure, biomarker response; progression-free survival; disease free-survival; time to recurrence; time to metastasis; time of overall survival; improvement of quality of life; and improvement of symptoms. In the foregoing embodiments of the treatment regimen, the one or more proteins are selected from the group consisting of beta-2-microglobulin (B2M), T cell receptor alpha chain constant region (TRAC), class II major histocompatibility complex transactivator (CIITA), ICP47 polypeptide, T cell receptor beta constant 1 (TRBC1), T cell receptor beta constant 2 (TRBC2), PD-1, CTLA-4, LAG-3, TIM-3, 2B4, CISH, ADORA2A, TIGIT, NKG2A, human leukocyte antigen A (HLA-A), human leukocyte antigen B (HLA-B), and TGFβ Receptor 2 (TGFβRII). In another embodiment, the cells are further modified to reduce expression of one or more proteins selected from the group consisting of cluster of differentiation 247 (CD247), CD3D, CD3E, CD3G, CD52, human leukocyte antigen C (HLA-C), deoxycytidine kinase (dCK), and FKBP1A.

The cells can be administered by any suitable means, for example, by bolus infusion, by injection, e.g., intraparenchymal, intravenous, intra-arterial, intracerebroventricular, intracisternal, intrathecal, intracranial, intra-lumbar, intraperitoneal, or by subcutaneous injections, intraocular injection, periocular injection, subretinal injection, intravitreal injection, trans-septal injection, subscleral injection, intrachoroidal injection, intracameral injection, subconjectval injection, subconjuntival injection, sub-Tenon's injection, retrobulbar injection, peribulbar injection, or posterior juxtascleral delivery. In some embodiments, they are administered by parenteral, intrapulmonary, and intranasal, and, if desired for local treatment, intralesional administration.

In some embodiments, provided herein are compositions of immune cells modified by CasX and gNA gene editing pairs and, optionally, donor templates and/or polynucleotides encoding CAR, engineered TCR, or fusion polypeptides comprising subunits thereof for use as a medicament for the treatment of a subject having a disease associated with expression of a tumor antigen. In the foregoing, the CasX can be a CasX variant of any of the embodiments described herein (e.g., the sequences of Table 4) and the gNA can be a gNA variant of any of the embodiments described herein (e.g., the sequences of Table 2). In other embodiments, the disclosure provides compositions cells modified by vectors comprising or encoding the gene editing pairs of CasX and gNA, donor templates and/or polynucleotides encoding CAR for use as a medicament for the treatment of a subject having a disease associated with expression of a tumor antigen.

IX. Kits and Articles of Manufacture

In another aspect, provided herein are kits comprising the compositions of the embodiments described herein. In some embodiments, the kit comprises a CasX protein and one or a plurality of gNA of any of the embodiments of the disclosure comprising a targeting sequence complementary to a cell gene encoding a protein involved in antigen processing, antigen presentation, antigen recognition, and/or antigen response, an excipient and a suitable container (for example a tube, vial or plate). In other embodiments, the kit comprises a nucleic acid encoding a CasX protein and one or a plurality of gNA of any of the embodiments of the disclosure comprising a targeting sequence complementary to a cell gene encoding a protein involved in antigen processing, antigen presentation, antigen recognition, and/or antigen response, a nucleic acid encoding a CAR, or engineered TCR, an excipient and a suitable container. In other embodiments, the kit comprises a vector comprising a nucleic acid encoding a CasX protein and one or a plurality of gNA of any of the embodiments of the disclosure comprising a targeting sequence complementary to a cell gene encoding a protein involved in antigen processing, antigen presentation, antigen recognition, and/or antigen response, a nucleic acid encoding a CAR or engineered TCR, an excipient and a suitable container. In still other embodiments, the kit comprises a VLP comprising a CasX protein and one or a plurality of gNA of any of the embodiments of the disclosure comprising a targeting sequence complementary to a cell gene encoding a protein involved in antigen processing, antigen presentation, antigen recognition, and/or antigen response, a nucleic acid encoding a CAR, an excipient and a suitable container.

In some embodiments, the kit further comprises a buffer, a nuclease inhibitor, a protease inhibitor, a liposome, a therapeutic agent, a label, a label visualization reagent, or any combination of the foregoing. In some embodiments, the kit further comprises a pharmaceutically acceptable carrier, diluent or excipient.

In some embodiments, the kit comprises appropriate control compositions for gene modifying applications, and instructions for use.

The present description sets forth numerous exemplary configurations, methods, parameters, and the like. It should be recognized, however, that such description is not intended as a limitation on the scope of the present disclosure, but is instead provided as a description of exemplary embodiments.

Examples of Non-Limiting Embodiments of the Disclosure

Embodiments of the present subject matter described above may be beneficial alone or in combination, with one or more other embodiments. Without limiting the foregoing description, certain non-limiting aspects of the disclosure, numbered 1-234 are provided below. As will be apparent to those of skill in the art upon reading this disclosure, each of the individually numbered embodiments may be used or combined with any of the preceding or following individually numbered embodiments. This is intended to provide support for all such combinations of embodiments and is not limited to combinations of embodiment explicitly provided below:

Embodiment Set No. 1

1. A CasX:gNA system comprising a CasX polypeptide and a guide nucleic acid (gNA), wherein the gNA comprises a targeting sequence (a) complementary to a nucleic acid sequence encoding a protein involved in antigen processing, antigen presentation, antigen recognition, and/or antigen response and/or its regulatory region; or (b) complementary to a complement of a nucleic acid sequence encoding a protein involved in antigen processing, antigen presentation, antigen recognition, and/or antigen response or its regulatory region.
2. The CasX:gNA system of 1, wherein the protein is an immune cell surface marker.
3. The CasX:gNA system of 1, wherein the protein is an intracellular protein.
4. The CasX:gNA system of any one of 1-3, wherein the protein is selected from the group consisting of beta-2-microglobulin (B2M), T cell receptor alpha chain constant region (TRAC), class II major histocompatibility complex transactivator (CIITA), T cell receptor beta constant 1 (TRBC1), T cell receptor beta constant 2 (TRBC2), human leukocyte antigen A (HLA-A), and human leukocyte antigen B (HLA-B).
5. The CasX:gNA system of 4, further comprising a gNA comprising a targeting sequence (a) complementary to a nucleic acid sequence encoding a protein selected from the group consisting of cluster of differentiation 247 (CD247), CD3D, CD3E, CD3G, CD52, human leukocyte antigen C (HLA-C), deoxycytidine kinase (dCK), and FKBP1A; or (b) is complementary to a complement of a nucleic acid sequence encoding a protein selected from the group consisting of cluster of differentiation 247 (CD247), CD3D, CD3E, CD3G, CD52, human leukocyte antigen C (HLA-C), deoxycytidine kinase (dCK), and FKBP1A.
6. The CasX:gNA system of any one of 1-5, wherein the gNA is a guide RNA (gRNA).
7. The CasX:gNA system of any one of 1-5, wherein the gNA is a guide DNA (gDNA).
8. The CasX:gNA system of any one of 1-5, wherein the gNA is a chimera comprising DNA and RNA.
9. The CasX:gNA system of 4, wherein the protein is B2M.
10. The CasX:gNA system of 9, wherein the targeting sequence of the gNA comprises a sequence having at least about 65%, at least about 75%, at least about 85%, or at least about 95% identity to a sequence selected from the group consisting of sequences set forth in Table 3A.
11. The CasX:gNA system of 4 wherein the protein is TRAC.
12. The CasX:gNA system of 11, wherein the targeting sequence of the gNA comprises a sequence having at least about 65%, at least about 75%, at least about 85%, or at least about 95% identity to a sequence selected from the group consisting of sequences set forth in Table 3B.

13. The CasX:gNA system of 4, wherein the protein is CIITA.
14. The CasX:gNA system of any one of 1-13, wherein the gNA has a scaffold comprising a sequence having at least about 50%, at least about 60%, at least about 70%, at least about 80%, at least about 90%, at least about 95%, or 100% sequence identity to a sequence of Table 2.
15. The CasX:gNA system of any one of 1-14, wherein the targeting sequence consists of 14, 15, 16, 17, 18, 19, 20, 21, 22, 23, 24, 25, 26, 27, 28, 29, or 30 consecutive nucleotides.
16. The composition of any one of 1-15, wherein the CasX polypeptide comprises any one of SEQ ID NOS: 1-3 or a sequence of Table 4, or a sequence having at least about 50%, at least about 60%, at least about 70%, at least about 80%, at least about 90%, or at least about 95% sequence identity thereto.
17. The CasX:gNA system of any one of 1-16, wherein the CasX polypeptide and the gNA are associated together in a ribonuclear protein complex (RNP).
18. The CasX:gNA system of any one of 1-17, further comprising a donor template nucleic acid.
19. The CasX:gNA system of 18, wherein the donor template comprises a nucleic acid encoding i) a chimeric antigen receptor (CAR) specific for a disease antigen, optionally a tumor cell antigen; and/or ii) the protein of 4.
20. The CasX:gNA system of 19, wherein the tumor cell antigen is selected from the group consisting of CD47, CD19, CD20, CD22, CD33, CD123, CD138, FLT3, BCMA, EGFR, and mesothelin.
21. The CasX:gNA system of 19 or 20, wherein the CAR comprises an antigen binding domain selected from the group consisting of linear antibody, single domain antibody (sdAb), and single-chain variable fragment (scFv).
22. The CasX:gNA system of 19, wherein the CAR further comprises one or more polypeptides selected from the group consisting of CD3zeta, CD27, CD28, 4-1BB (41BB), ICOS, and OX40.
23. The CasX:gNA system of 22, wherein the one or more of CD3zeta, CD27, CD28, 4-1BB (41BB), ICOS, or OX40 are linked to the CAR antigen binding domain by an immunoglobulin-like domain hinge and, optionally, a spacer sequence.
24. The CasX:gNA system of any one of 18-23, wherein the donor template comprises a nucleic acid for a gene or a portion of a gene encoding the protein of 4 or a regulatory region for the gene, wherein the nucleic acid comprises a deletion, insertion, or mutation of one or more nucleotides in comparison to a genomic nucleic acid sequence encoding the protein or its regulatory region.
25. A nucleic acid comprising a sequence that encodes the CasX:gNA system of any one of 1-17.
26. A vector comprising the nucleic acid of 25.
27. A vector comprising a donor template, wherein the donor template comprises a nucleic acid encoding i) a chimeric antigen receptor (CAR) specific for a disease antigen, optionally a tumor cell antigen; and/or ii) a gene or a portion of a gene encoding a protein selected from the group consisting of beta-2-microglobulin (B2M), T cell receptor alpha chain constant region (TRAC), class II major histocompatibility complex transactivator (CIITA), T cell receptor beta constant 1 (TRBC1), T cell receptor beta constant 2 (TRBC2), human leukocyte antigen A (HLA-A), and human leukocyte antigen B (HLA-B) or iii) a regulatory region for the gene of ii).
28. The vector of 27, wherein the tumor cell antigen is selected from the group consisting of CD47, CD19, CD20, CD22, CD33, CD123, CD138, FLT3, BCMA, EGFR, and mesothelin.
29. The vector of 27 or 28, wherein the CAR comprises an antigen binding domain selected from the group consisting of linear antibody, single domain antibody (sdAb), and single-chain variable fragment (scFv).
30. The vector of 29, wherein the CAR further comprises one or more polypeptides selected from the group consisting of CD3zeta, CD27, CD28, 4-1BB (41BB), ICOS, and OX40 linked to the antigen binding domain.
31. The vector of 30, wherein the one or more of CD3zeta, CD27, CD28, 4-1BB (41BB), ICOS, or OX40 are linked to the CAR antigen binding domain by an immunoglobulin-like domain hinge and, optionally, a linker sequence.
32. The vector of any one of 27-31, further comprising the nucleic acid of 25.
33. The vector of any one of 26-32, wherein the vector is selected from the group consisting of a lentiviral vector, an adenoviral vector, an adeno-associated viral (AAV) vector, a herpes simplex virus (HSV) vector, a plasmid, a minicircle, a nanoplasmid, and an RNA vector.
34. A method of altering a target sequence of a cell, comprising contacting said cell with: a) CasX:gNA system of any one of 1-24; b) the nucleic acid of 25; c) the vector as in any one of 26-33; or d) any of a) to c), above.
35. The method of 34, wherein the cell has been engineered such that expression of the protein is reduced by at least about 50%, at least about 60%, at least about 70%, at least about 80%, at least about 90%, or at least about 95% in comparison to a cell that has not been engineered.
36. The method of 34 or 35, wherein the cell has been engineered such that the cell does not express a detectable level of the protein.
37. The method of 35 or 36, wherein the protein is selected from the group consisting of B2M, TRAC, and CIITA.
38. A population of cells engineered by the method of 34 or 35, wherein the cells have been engineered such that at least 70%, at least 75%, at least 80%, at least 85%, at least 90%, or at least 95% of the engineered cells do not express a detectable level of MHC Class I molecules.
39. A population of cells engineered by the method of 34 or 35, wherein the cell has been engineered such that at least 70%, at least 75%, at least 80%, at least 85%, at least 90%, or at least 95% of the engineered cells do not express a detectable level of wild-type T cell receptor.
40. The population of cells of 38 or 39, wherein the cell has been engineered such that at least 70%, at least 75%, at least 80%, at least 85%, at least 90%, or at least 95% of the engineered cells express a detectable level of the chimeric antigen receptor (CAR).
41. The population of cells of any one of 38-40, wherein the cell is a non-primate mammalian cell, a non-human primate cell, or a human cell.
42. The population of cells of any one of 38-41, wherein the cell is selected from the group consisting of a progenitor cell, a hematopoietic stem cell, and a pluripotent stem call.

43. The population of cells of 42, wherein the cell is an induced pluripotent stem cell.
44. The population of cells of any one of 38-41, wherein the cell is an immune cell.
45. The population of cells of 44, wherein the immune cell is a T cell, TREG cell, NK cell, B cell, macrophage, or dendritic cell.
46. The population of cells of 45, wherein the immune cell is a T cell, wherein the T cell is a CD4+ T cell, a CD8+ T cell, or a combination thereof.
47. The population of cells of any one of 38-46, wherein the cells are autologous with respect to a patient to be administered the cell.
48. The population of cells of any one of 38-46, wherein the cells are allogeneic with respect to a patient to be administered the cell.
49. A population of cells, comprising the CasX:gNA system of any one of 1-24.
50. The population of cells of 49, wherein the cells have been engineered to i) express a chimeric antigen receptor (CAR) specific for a disease antigen, optionally a tumor cell antigen; and/or ii) disrupt expression of the protein of 4.
51. The population of cells of 50, wherein at least 70%, at least 75%, at least 80%, at least 85%, at least 90%, or at least 95% of the engineered cells express a detectable level of the CAR.
52. The population of cells of 50 or 51, wherein the cell has been engineered such that expression of the protein is reduced by at least about 50%, at least about 60%, at least about 70%, at least about 80%, at least about 90%, or at least about 95% in comparison to a cell that has not been engineered.
53. The population of cells of any one of 49-52, wherein the cells are autologous with respect to a patient to be administered the cell.
54. The population of cell of any one of 49-52, wherein the cells are allogeneic with respect to a patient to be administered the cell.
55. The population of cells of any one of 49-54, wherein at least 75%, at least 80%, at least 85%, at least 90%, or at least 95% of the engineered cells do not express a detectable level of MHC Class I molecules.
56. The population of cells of any one of 49-55, wherein at least 75%, at least 80%, at least 85%, at least 90%, or at least 95% of the engineered cells do not express a detectable level of wild-type T cell receptor.
57. A method of providing an anti-tumor immunity in a subject, the method comprising administering to the subject an effective amount of the cells of any one of 49-56.
58. A method of treating a subject having a disease associated with expression of a tumor antigen or having an autoimmune disease, the method comprising administering to the subject an effective amount of the cell of any one of 49-56.
59. The method of 58, wherein the disease associated with expression of a tumor antigen is a cancer selected from the group consisting of colon cancer, rectal cancer, renal-cell carcinoma, liver cancer, non-small cell carcinoma of the lung, cancer of the small intestine, cancer of the esophagus, melanoma, bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, carcinoma of the fallopian tubes, carcinoma of the endometrium, carcinoma of the cervix, carcinoma of the vagina, carcinoma of the vulva, Hodgkin's Disease, non-Hodgkin's lymphoma, cancer of the endocrine system, cancer of the thyroid gland, cancer of the parathyroid gland, cancer of the adrenal gland, sarcoma of soft tissue, cancer of the urethra, cancer of the penis, solid tumors of childhood, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers, chronic lymphocytic leukemia (CLL), acute leukemias, acute lymphoid leukemia (ALL), B-cell acute lymphoid leukemia (B-ALL), T-cell acute lymphoid leukemia (T-ALL), chronic myelogenous leukemia (CML), acute myeloid leukemia (AML), B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, marginal zone lymphoma, multiple myeloma, myelodysplasia and myelodysplastic syndrome, Hodgkin's lymphoma, plasmablastic lymphoma, plasmacytoid dendritic cell neoplasm, Waldenstrom macroglobulinemia, pre-leukemia, combinations of said cancers, and metastatic lesions of said cancers.
60. The method of any one of 57-59, wherein the method further comprises administering a chemotherapeutic agent.
61. A method of preparing cells for immunotherapy comprising modifying immune cells by reducing or eliminating expression of i) a protein involved in antigen processing, antigen presentation, antigen recognition, and/or antigen response or ii) the regulatory region of the protein.
62. The method of 61, comprising contacting a nucleic acid of the immune cell with a CasX:gNA system comprising a CasX polypeptide and a guide nucleic acid (gNA), wherein the gNA comprises a targeting sequence (a) complementary to the nucleic acid sequence for a gene or a portion of a gene encoding the protein or a regulatory region for the gene, or (b) is complementary to a complement of a nucleic acid sequence encoding the protein or its regulatory region.
63. The method of 61, wherein the protein is selected from the group consisting of beta-2-microglobulin (B2M), T cell receptor alpha chain constant region (TRAC), class II major histocompatibility complex transactivator (CIITA), T cell receptor beta constant 1 (TRBC1), T cell receptor beta constant 2 (TRBC2), human leukocyte antigen A (HLA-A), and human leukocyte antigen B (HLA-B).
64. The method of 63, further comprising a gNA comprising a targeting sequence (a) complementary to a nucleic acid sequence encoding a protein selected from the group consisting of cluster of differentiation 247 (CD247), CD3D, CD3E, CD3G, CD52, human leukocyte antigen C (HLA-C), deoxycytidine kinase (dCK), and FKBP1A; or (b) is complementary to a complement of a nucleic acid sequence encoding a protein selected from the group consisting of cluster of differentiation 247 (CD247), CD3D, CD3E, CD3G, CD52, human leukocyte antigen C (HLA-C), deoxycytidine kinase (dCK), and FKBP1A.

65. The method of any one of 61-64, wherein the cell has been engineered such that expression of the protein is reduced by at least about 50%, at least about 60%, at least about 70%, at least about 80%, at least about 90%, or at least about 95% in comparison to a cell that has not been engineered.

66. The method of any one of 61-65, wherein the cell has been engineered such that the cell does not express a detectable level of the protein.

67. The method of 65 or 66, wherein the protein is selected from the group consisting of B2M, TRAC, and CIITA.

68. The method of any one of 61-67, wherein the cells have been engineered such that at least 70%, at least 75%, at least 80%, at least 85%, at least 90%, or at least 95% of the engineered cells do not express a detectable level of MHC Class I molecules.

69. The method of 61-68, wherein the cells have been engineered such that at least 70%, at least 75%, at least 80%, at least 85%, at least 90%, or at least 95% of the engineered cells do not express a detectable level of wild-type T cell receptor.

70. The method of any one of 61-69, further comprising contacting the nucleic acid of the immune cell with a donor template nucleic acid wherein the donor template comprises a nucleic acid encoding a chimeric antigen receptor (CAR) specific for a tumor cell antigen.

71. The method of 70, wherein the tumor cell antigen is selected from the group consisting of CD47, CD19, CD20, CD22, CD33, CD123, CD138, FLT3, BCMA, EGFR, and mesothelin.

72. The method of 70 or 71, wherein the CAR comprises an antigen binding domain selected from the group consisting of linear antibody, single domain antibody (sdAb), and single-chain variable fragment (scFv).

73. The method of 72, wherein the CAR comprises one or more polypeptides selected from the group consisting of CD3zeta, CD27, CD28, 4-1BB (41BB), ICOS, and OX40.

74. The method of 73, wherein the one or more of CD3zeta, CD27, CD28, 4-1BB (41BB), ICOS, or OX40 are linked to the CAR antigen binding domain by an immunoglobulin-like domain hinge and, optionally, a spacer sequence.

75. The method of any one of 61-74, further comprising expanding a population of said cells.

76. A method of treating a subject in need thereof comprising administering cells prepared by the method of any one of 61-75.

77. A method of treating a subject in need thereof comprising administering cells prepared by the method of any one of 61-75 in combination with an immunosuppressive agent.

78. The method of 76 or 77, wherein the cells are autologous to the subject.

79. The method of 76 or 77, wherein the cells are allogeneic to the subject.

80. The method of any one of 76-79, wherein the subject has a disease associated with expression of a tumor antigen, wherein said administration treats said disease associated with expression of a tumor antigen.

81. The method of 80, wherein the disease associated with expression of a tumor antigen is a cancer selected from the group consisting of colon cancer, rectal cancer, renal-cell carcinoma, liver cancer, non-small cell carcinoma of the lung, cancer of the small intestine, cancer of the esophagus, melanoma, bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, carcinoma of the fallopian tubes, carcinoma of the endometrium, carcinoma of the cervix, carcinoma of the vagina, carcinoma of the vulva, Hodgkin's Disease, non-Hodgkin's lymphoma, cancer of the endocrine system, cancer of the thyroid gland, cancer of the parathyroid gland, cancer of the adrenal gland, sarcoma of soft tissue, cancer of the urethra, cancer of the penis, solid tumors of childhood, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers, chronic lymphocytic leukemia (CLL), acute leukemias, acute lymphoid leukemia (ALL), B-cell acute lymphoid leukemia (B-ALL), T-cell acute lymphoid leukemia (T-ALL), chronic myelogenous leukemia (CML), acute myeloid leukemia (AML), B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, marginal zone lymphoma, multiple myeloma, myelodysplasia and myelodysplastic syndrome, Hodgkin's lymphoma, plasmablastic lymphoma, plasmacytoid dendritic cell neoplasm, Waldenstrom macroglobulinemia, pre-leukemia, combinations of said cancers, and metastatic lesions of said cancers.

EXAMPLES

Example 1: Creation, Expression and Purification of CasX Stx2

1. Growth and Expression

An expression construct for CasX Stx2 (also referred to herein as CasX2), derived from Planctomycetes (having the CasX amino acid sequence of SEQ ID NO: 2 and encoded by the sequence of the Table 6, below), was constructed from gene fragments (Twist Biosciences) that were codon optimized for *E. coli*. The assembled construct contains a TEV-cleavable, C-terminal, TwinStrep tag and was cloned into a pBR322-derivative plasmid backbone containing an ampicillin resistance gene. The expression construct was transformed into chemically competent BL21* (DE3) *E. coli* and a starter culture was grown overnight in LB broth supplemented with carbenicillin at 37° C., 200 RPM, in UltraYield Flasks (Thomson Instrument Company). The following day, this culture was used to seed expression cultures at a 1:100 ratio (starter culture:expression culture). Expression cultures were Terrific Broth (Novagen) supplemented with carbenicillin and grown in UltraYield flasks at 37° C., 200 RPM. Once the cultures reached an optical density (OD) of 2, they were chilled to 16° C. and IPTG (isopropyl β-D-1-thiogalactopyranoside) was added to a final concentration of 1 mM, from a 1 M stock. The cultures were induced at 16° C., 200 RPM for 20 hours before being harvested by centrifugation at 4,000×g for 15 minutes, 4° C.

The cell paste was weighed and resuspended in lysis buffer (50 mM HEPES-NaOH, 250 mM NaCl, 5 mM $MgCl_2$, 1 mM TCEP, 1 mM benzamidine-HCL, 1 mM PMSF, 0.5% CHAPS, 10% glycerol, pH 8) at a ratio of 5 mL of lysis buffer per gram of cell paste. Once resuspended, the sample was frozen at −80° C. until purification.

TABLE 6

DNA sequence of CasX Stx2 construct

| Construct | DNA Sequence |
| --- | --- |
| SV40 NLS-CasX-SV40 NLS-TEV cleavage site - TwinStrep tag | (SEQ ID NO: 437) |

2. Purification

Frozen samples were thawed overnight at 4° C. with magnetic stirring. The viscosity of the resulting lysate was reduced by sonication and lysis was completed by homogenization in three passes at 17 k PSI using an Emulsiflex C3 (Avestin). Lysate was clarified by centrifugation at 50,000× g, 4° C., for 30 minutes and the supernatant was collected. The clarified supernatant was applied to a Heparin 6 Fast Flow column (GE Life Sciences) by gravity flow. The column was washed with 5 CV of Heparin Buffer A (50 mM HEPES-NaOH, 250 mM NaCl, 5 mM $MgCl_2$, 1 mM TCEP, 10% glycerol, pH 8), then with 5 CV of Heparin Buffer B (Buffer A with the NaCl concentration adjusted to 500 mM). Protein was eluted with 5 CV of Heparin Buffer C (Buffer A with the NaCl concentration adjusted to 1 M), collected in fractions. Fractions were assayed for protein by Bradford Assay and protein-containing fractions were pooled. The pooled heparin eluate was applied to a Strep-Tactin XT Superflow column (IBA Life Sciences) by gravity flow. The column was washed with 5 CV of Strep Buffer (50 mM HEPES-NaOH, 500 mM NaCl, 5 mM $MgCl_2$, 1 mM TCEP, 10% glycerol, pH 8). Protein was eluted from the column using 5 CV of Strep Buffer with 50 mM D-Biotin added and collected in fractions. CasX-containing fractions were pooled, concentrated at 4° C. using a 30 kDa cut-off spin concentrator, and purified by size exclusion chromatography on a Superdex 200 pg column (GE Life Sciences). The column was equilibrated with SEC Buffer (25 mM sodium phosphate, 300 mM NaCl, 1 mM TCEP, 10% glycerol, pH 7.25) operated by an AKTA Pure FPLC system (GE Life Sciences). CasX-containing fractions that eluted at the appropriate molecular weight were pooled, concentrated at 4° C. using a 30 kDa cut-off spin concentrator, aliquoted, and snap-frozen in liquid nitrogen before being stored at −80° C.

3. Results

Figure 2:
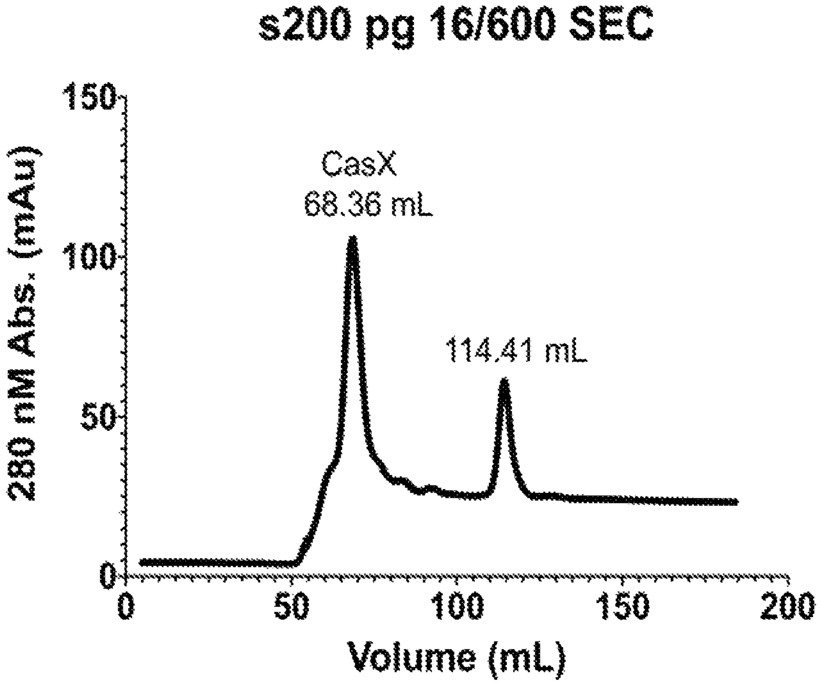
FIG. 2 shows the chromatogram from a size exclusion chromatography assay of the StX2, using of Superdex 200 16/600 pg Gel Filtration, as described in Example 1.
Figure 3:
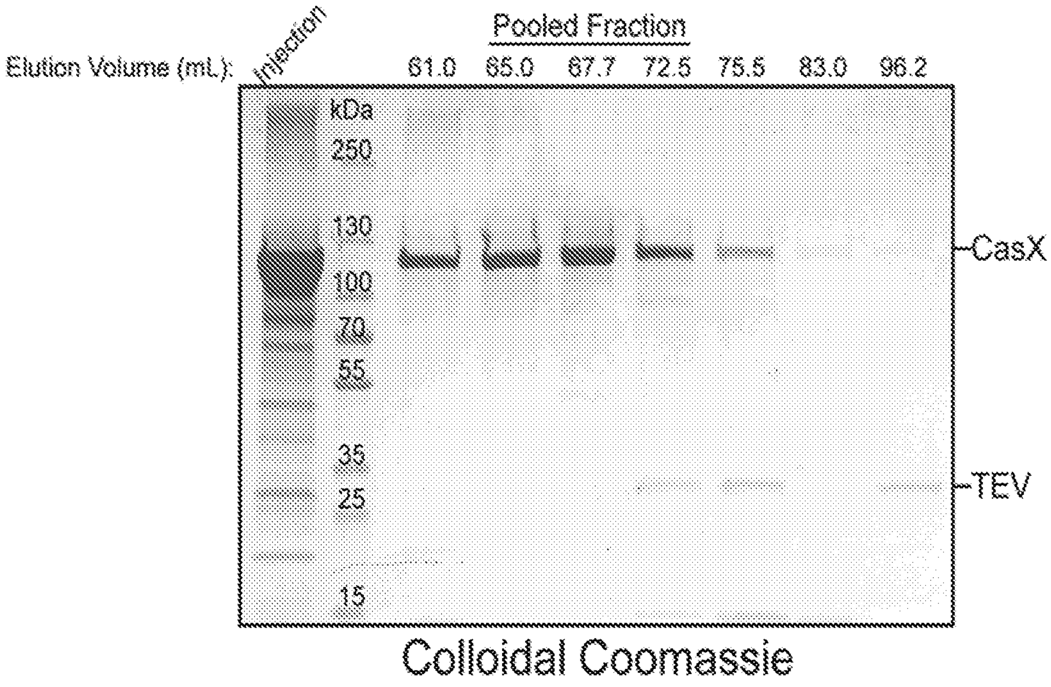
FIG. 3 shows an SDS-PAGE gel of StX2 purification fractions visualized by colloidal Coomassie staining, as described in Example 1.

Samples from throughout the purification were resolved by SDS-PAGE and visualized by colloidal Coomassie staining, as shown in FIG. 1 and FIG. 3. In FIG. 1, the lanes, from left to right, are: molecular weight standards, Pellet: insoluble portion following cell lysis, Lysate: soluble portion following cell lysis, Flow Thru: protein that did not bind the Heparin column, Wash: protein that eluted from the column in wash buffer, Elution: protein eluted from the heparin column with elution buffer, Flow Thru: Protein that did not bind the StrepTactinXT column, Elution: protein eluted from the StrepTactin XT column with elution buffer, Injection: concentrated protein injected onto the s200 gel filtration column, Frozen: pooled fractions from the s200 elution that have been concentrated and frozen. In FIG. 3, the lanes from right to left, are the injection (sample of protein injected onto the gel filtration column) molecular weight markers, lanes 3-9 are samples from the indicated elution volumes. Results from the gel filtration are shown in FIG. 2. The 68.36 mL peak corresponds to the apparent molecular weight of CasX and contained the majority of CasX protein. The average yield was 0.75 mg of purified CasX protein per liter of culture, with 75% purity, as evaluated by colloidal Coomassie staining.

Example 2: CasX Construct 119, 438 and 457

Figure 4:
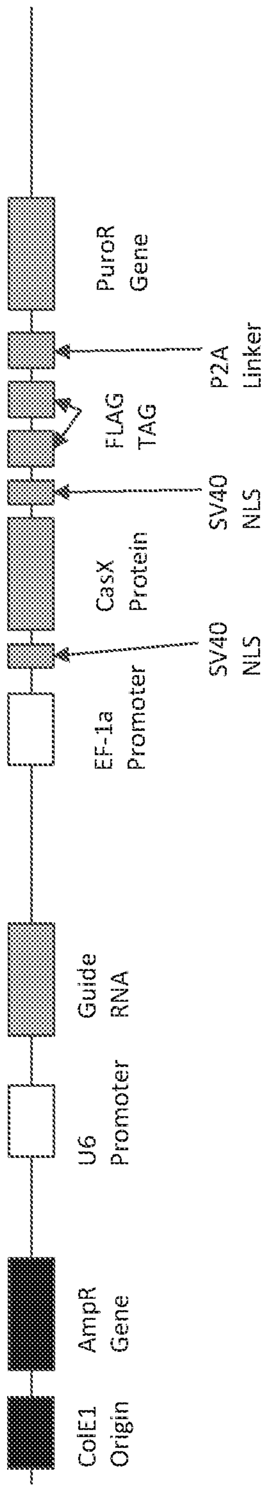
FIG. 4 is a schematic showing the organization of the components in the pSTX34 plasmid used to assemble the CasX constructs, as described in Example 2.
Figure 6:
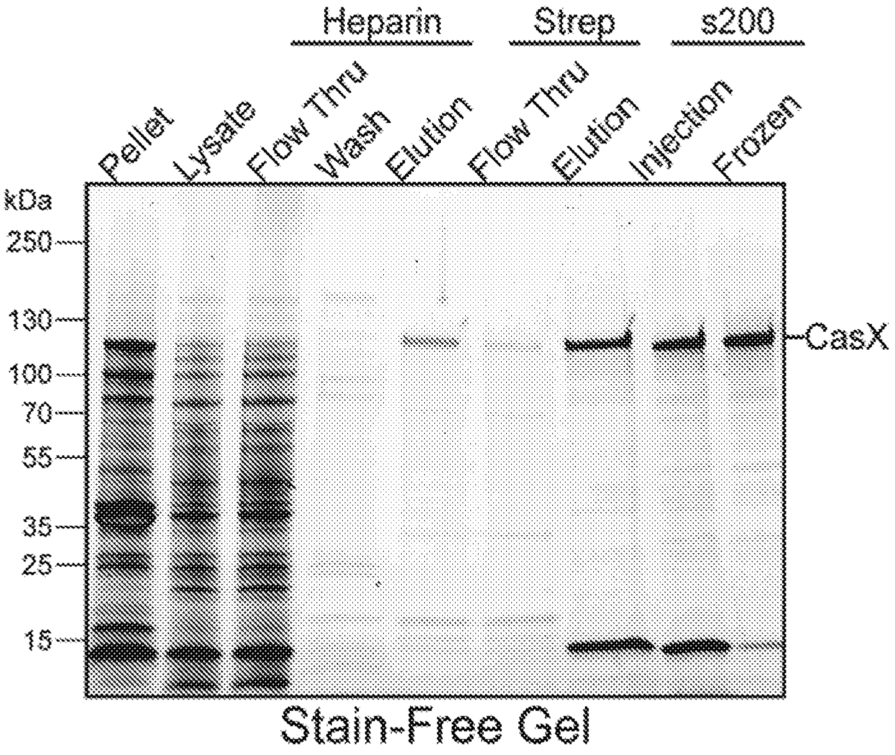
FIG. 6 shows an SDS-PAGE gel of purification samples, visualized on a Bio-Rad Stain-Free™ gel, as described in Example 2.
Figure 7:
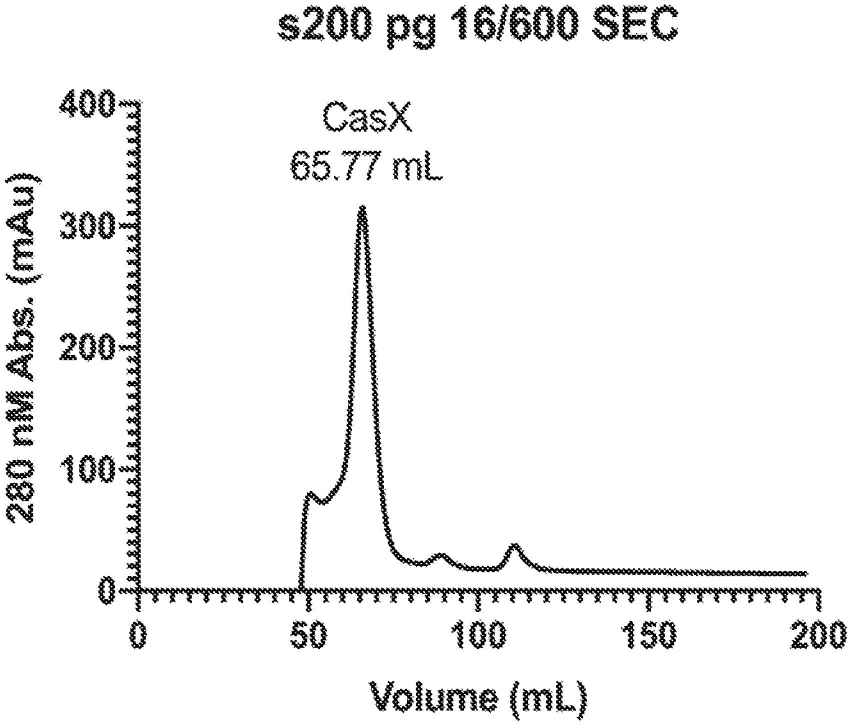
FIG. 7 shows the chromatogram of Superdex 200 16/600 pg Gel Filtration, as described in Example 2.
Figure 8:
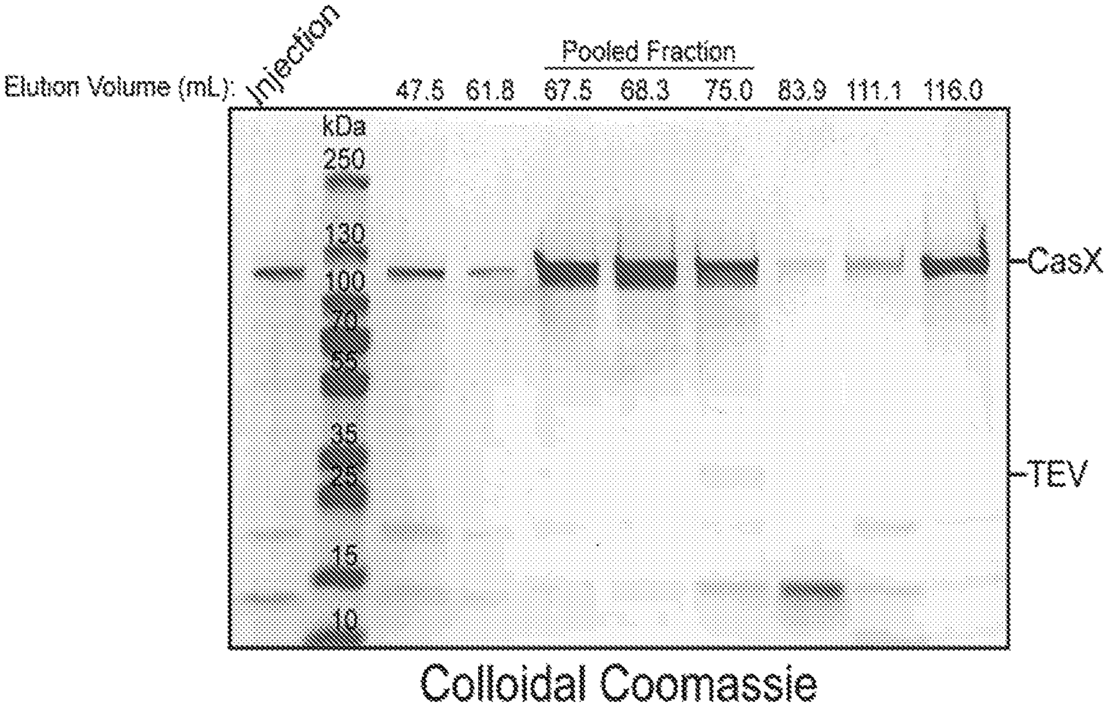
FIG. 8 shows an SDS-PAGE gel of gel filtration samples, stained with colloidal Coomassie, as described in Example 2.

In order to generate the CasX 119, 438, and 457 constructs (sequences in Table 7), the codon-optimized CasX 37 construct (based on the CasX Stx2 construct of Example 1, encoding Planctomycetes CasX SEQ ID NO: 2, with a A708K substitution and a [P793] deletion with fused NLS, and linked guide and non-targeting sequences) was cloned into a mammalian expression plasmid (pStX; see FIG. 4) using standard cloning methods. To build CasX 119, the CasX 37 construct DNA was PCR amplified in two reactions using Q5 DNA polymerase (New England BioLabs Cat #M0491L) according to the manufacturer's protocol, using primers oIC539 and oIC88 as well as oIC87 and oIC540 respectively (see FIG. 5). To build CasX 457, the CasX 365 construct DNA was PCR amplified in four reactions using Q5 DNA polymerase (New England BioLabs Cat #M0491L) according to the manufacturer's protocol, using primers oIC539 and oIC212, oIC211 and oIC376, oIC375 and oIC551, and oIC550 and oIC540 respectively. To build CasX 438, the CasX 119 construct DNA was PCR amplified in four reactions using Q5 DNA polymerase (New England BioLabs Cat #M0491L) according to the manufacturer's protocol, using primers oIC539 and oIC689, oIC688 and oIC376, oIC375 and oIC551, and oIC550 and oIC540 respectively. The resulting PCR amplification products were then purified using Zymoclean DNA clean and concentrator (Zymo Research Cat #4014) according to the manufacturer's protocol. The pStX backbone was digested using XbaI and SpeI in order to remove the 2931 base pair fragment of DNA between the two sites in plasmid pStx34. The digested backbone fragment was purified by gel extraction from a 1% agarose gel (Gold Bio Cat #A-201-500) using Zymoclean Gel DNA Recovery Kit (Zymo Research Cat #D4002) according to the manufacturer's protocol. The three fragments were then pieced together using Gibson assembly (New England BioLabs Cat #E2621S) following the manufacturer's protocol. Assembled products in the pStx34 were transformed into chemically-competent or electro-competent Turbo Competent *E. coli* bacterial cells, plated on LB-Agar plates (LB: Teknova Cat #L9315, Agar: Quartzy Cat #214510) containing carbenicillin. Individual colonies were picked and miniprepped using Qiagen Qiaprep spin Miniprep Kit (Qiagen Cat #27104) following the manufacturer's protocol. The resultant plasmids were sequenced using Sanger sequencing to ensure correct assembly. pStX34 includes an EF-1α promoter for the protein as well as a selection marker for both puromycin and carbenicillin. Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically or electro-competent cells such as NEB Turbo competent *E. coli* (NEB Cat #C2984I), plated on LB-Agar plates (LB: Teknova Cat #L9315, Agar: Quartzy Cat #214510) containing carbenicillin. Individual colonies were picked and miniprepped using Qiagen Qiaprep spin Miniprep Kit (Qiagen Cat #27104) and following the manufacturer's protocol. The resultant plasmids were sequenced using Sanger sequencing to ensure correct ligation. SaCas9 and SpyCas9 control plasmids were prepared similarly to pStX plasmids described above, with the protein and guide regions of pStX exchanged for the respective protein and guide. Targeting sequences for SaCas9 and SpyCas9 were either obtained from the literature or were rationally designed according to established methods. The expression and recovery of the CasX 119 and 457 proteins was performed using the general methodologies of Example 1 (however the DNA sequences were codon optimized for expression in *E. coli*). The results of analytical assays for CasX 119 are shown in FIGS. 6-8. The average yield of the CasX 119 was 1.56 mg of purified CasX protein per liter of culture at 75% purity, as evaluated by colloidal Coomassie staining. FIG. 6 shows an SDS-PAGE gel of purification samples, visualized on a Bio-Rad Stain-Free™ gel, as described. The lanes, from left to right, are: Pellet: insoluble portion following cell lysis, Lysate: soluble portion following cell lysis, Flow Thru: protein that did not bind the Heparin column, Wash: protein that eluted from the column in wash buffer, Elution: protein eluted from the heparin column with elution buffer, Flow Thru: Protein that did not bind the StrepTactinXT column, Elution: protein eluted from the StrepTactin XT column with elution buffer, Injection: concentrated protein injected onto the s200 gel filtration column, Frozen: pooled fractions from the s200 elution that have been concentrated and frozen.

FIG. 7 shows the chromatogram of Superdex 200 16/600 pg Gel Filtration, as described. Gel filtration run of CasX variant 119 protein plotted as 280 nm absorbance against elution volume. The 65.77 mL peak corresponds to the apparent molecular weight of CasX variant 119 and contained the majority of CasX variant 119 protein. FIG. 8 shows an SDS-PAGE gel of gel filtration samples, stained with colloidal Coomassie, as described. Samples from the indicated fractions were resolved by SDS-PAGE and stained with colloidal Coomassie. From right to left, Injection: sample of protein injected onto the gel filtration column, molecular weight markers, lanes 3-10: samples from the indicated elution volumes.

TABLE 7

TABLE 7-continued

Sequences of CasX 119, 438 and 457

| Construct | DNA Sequence | Amino Acid Sequence |
|---|---|---|
| CasX 119 | (SEQ ID NO: 438) | QEIKRINKIRRRLVKDSNTKKAGKTGPMK<br>TLLVRVMTPDLRERLENLRKKPENIPQPI<br>SNTSRANLNKLLTDYTEMKKAILHVYWEE<br>FQKDPVGLMSRVAQPAPKNIDQRKLIPVK<br>DGNERLTSSGFACSQCCQPLYVYKLEQVN<br>DKGKPHTNYFGRCNVSEHERLILLSPHKP<br>EANDELVTYSLGKFGQRALDFYSIHVTRE<br>SNHPVKPLEQIGGNSCASGPVGKALSDAC<br>MGAVASFLTKYQDIILEHQKVIKKNEKRL<br>ANLKDIASANGLAFPKITLPPQPHTKEGI<br>EAYNNVVAQIVIWVNLNLWQKLKIGRDEA<br>KPLQRLKGFPSFPLVERQANEVDWWDMVC<br>NVKKLINEKKEDGKVFWQNLAGYKRQEAL<br>RPYLSSEEDRKKGKKFARYQFGDLLLHLE<br>KKHGEDWGKVYDEAWERIDKKVEGLSKHI<br>KLEEERRSEDAQSKAALTDWLRAKASFVI<br>EGLKEADKDEFCRCELKLQKWYGDLRGKP<br>FAIEAENSILDISGFSKQYNCAFIWQKDG<br>VKKLNLYLIINYFKGGKLRFKKIKPEAFE<br>ANRFYTVINKKSGEIVPMEVNFNFDDPNL<br>IILPLAFGKRQGREFIWNDLLSLETGSLK<br>LANGRVIEKTLYNRRTRQDEPALFVALTF<br>ERREVLDSSNIKPMNLIGIDRGENIPAVI<br>ALTDPEGCPLSRFKDSLGNPTHILRIGES<br>YKEKQRTIQAKKEVEQRRAGGYSRKYASK<br>AKNLADDMVRNTARDLLYYAVTQDAMLIF<br>ENLSRGFGRQGKRTFMAERQYTRMEDWLT<br>AKLAYEGLSKTYLSKTLAQYTSKTCSNCG<br>FTITSADYDRVLEKLKKTATGWMTTINGK<br>ELKVEGQITYYNRYKRQNVVKDLSVELDR<br>LSEESVNNDISSWTKGRSGEALSLLKKRF<br>SHRPVQEKFVCLNCGFETHADEQAALNIA<br>RSWLFLRSQEYKKYQTNKTTGNTDKRAFV<br>ETWQSFYRKKLKEVWKPAV<br>(SEQ ID NO: 439) |
| CasX 457 | (SEQ ID NO: 440) | QEIKRINKIRRRLVKDSNTKKAGKTGPMK<br>TLLVRVMTPDLRERLENLRKKPENIPQPI<br>SNTSRANLNKLLTDYTEMKKAILHVYWEE<br>FQKDPVGLMSRVAQPAPKNIDQRKLIPVK<br>DGNERLTSSGFACSQCCQPLYVYKLEQVN<br>DKGKPHTNYFGRCNVSEHERLILLSPHKP<br>EANDELVTYSLGKFGQRALDFYSIHVTRE<br>SNHPVKPLEQIGGNSCASGPVGKALSDAC<br>MGAVASFLTKYQDIILEHKKVIKKNEKRL<br>ANLKDIASANGLAFPKITLPPQPHTKEGI<br>EAYNNVVAQIVIWVNLNLWQKLKIGRDEA<br>KPLQRLKGFPSFPLVERQANEVDWWDMVC<br>NVKKLINEKKEDGKVFWQNLAGYKRQEAL<br>RPYLSSPEDRKKGKKFARYQLGDLLLHLE<br>KKHGEDWGKVYDEAWERIDKKVEGLSKHI<br>KLEEERRSEDAQSKAALTDWLRAKASFVI<br>EGLKEADKDEFCRCELKLQKWYGDLRGKP<br>FAIEAENSILDISGFSKQYNCAFIWQKDG<br>VKKLNLYLIINYFKGGKLRFKKIKPEAFE<br>ANRFYTVINKKSGEIVPMEVNFNFDDPNL<br>IILPLAFGKRQGREFIWNDLLSLETGSLK<br>LANGRVIEKPLYNRRTRQDEPALFVALTF<br>ERREVLDSSNIKPMNLIGVDRGENIPAVI<br>ALTDPEGCPLSRFKDSLGNPTHILRIGES<br>YKEKQRTIQAKKEVEQRRAGGYSRKYASK<br>AKNLADDMVRNTARDLLYYAVTQDAMLIF<br>ENLSRGFGRQGKRTFMAERQYTRMEDWLT<br>AKLAYEGLSKTYLSKTLAQYTSKTCSNCG<br>FTITSADYDRVLEKLKKTATGWMTTINGK<br>ELKVEGQITYYNRRKRQNVVKDLSVELDR<br>LSEESVNNDISSWTKGRSGEALSLLKKRF<br>SHRPVQEKFVCLNCGFETHADEQAALNIA<br>RSWLFLRSQEYKKYQTNKTTGNTDKRAFV<br>ETWQSFYRKKLKEVWKPAV<br>(SEQ ID NO: 441) |
| CasX 438 | (SEQ ID NO: 442) | QEIKRINKIRRRLVKDSNTKKAGKTGPMK<br>TLLVRVMTPDLRERLENLRKKPENIPQPI<br>SNTSRANLNKLLTDYTEMKKAILHVYWEE<br>FQKDPVGLMSRVAQPAPKNIDQRKLIPVK<br>DGNERLTSSGFACSQCCQPLYVYKLEQVN<br>DKGKPHTNYFGRCNVSEHERLILLSPHKP<br>EANDELVTYSLGKFGQRALDFYSIHVTRE<br>SNHPVKPLEQIGGNSCASGPVGKALSDAC<br>MGAVASFLTKYQDIILEHQKVIKKNEKRL<br>ANLKDIASANGLAFPKITLPPQPHTKEGI<br>EAYNNVVAQIVIWVNLNLWQKLKIGRDEA<br>KPLQRLKGFPSFPLVERQANEVDWWDMVC<br>NVKKLINEKKEDGKVFWQNLAGYKRQEAL<br>RPYLSSEEDRKKGKKFARYQLGDLLKHLE<br>KKHGEDWGKVYDEAWERIDKKVEGLSKHI<br>KLEEERRSEDAQSKAALTDWLRAKASFVI<br>EGLKEADKDEFCRCELKLQKWYGDLRGKP<br>FAIEAENSILDISGFSKQYNCAFIWQKDG<br>VKKLNLYLIINYFKGGKLRFKKIKPEAFE |

TABLE 7-continued

| Sequences of CasX 119, 438 and 457 | | |
|---|---|---|
| Construct | DNA Sequence | Amino Acid Sequence |
| | | ANRFYTVINKKSGEIVPMEVNFNFDDPNL IILPLAFGKRQGREFIWNDLLSLETGSLK LANGRVIEKTLYNRRTRQDEPALFVALTF ERREVLDSSNIKPMNLIGVDRGENIPAVI ALTDPEGCPLSRFKDSLGNPTHILRIGES YKEKQRTIQAKKEVEQRRAGGYSRKYASK AKNLADDMVRNTARDLLYYAVTQDAMLIF ENLSRGFGRQGKRTFMAERQYTRMEDWLT AKLAYEGLSKTYLSKTLAQYTSKTCSNCG FTITSADYDRVLEKLKKTATGWMTTINGK ELKVEGQITYYNRRKRQNVVKDLSVELDR LSEESVNNDISSWTKGRSGEALSLLKKRF SHRPVQEKFVCLNCGFETHADEQAALNIA RSWLFLRSQEYKKYQTNKTTGNTDKRAFV ETWQSFYRKKLKEVWKPAV (SEQ ID NO: 443) |

Example 3: CasX Construct 488 and 491

In order to generate the CasX 488 construct (sequences in Table 8), the codon-optimized CasX 119 construct (based on the CasX Stx2 construct of Example 1, encoding Planctomycetes CasX SEQ ID NO: 2, with a A708K substitution, a L379R substitution, and a [P793] deletion with fused NLS, and linked guide and non-targeting sequences) was cloned into a mammalian expression plasmid (pStX; see FIG. 4) using standard cloning methods. Construct CasX 1 (based on the CasX Stx1 construct of Example 1, encoding CasX SEQ ID NO: 1) was cloned into a destination vector using standard cloning methods. To build CasX 488, the CasX 119 construct DNA was PCR amplified using Q5 DNA polymerase (New England BioLabs Cat #M0491L) according to the manufacturer's protocol, using primers oIC765 and oIC762 (see FIG. 5). The CasX 1 construct was PCR amplified using Q5 DNA polymerase (New England BioLabs Cat #M0491L) according to the manufacturer's protocol, using primers oIC766 and oIC784. The PCR products were purified by gel extraction from a 1% agarose gel (Gold Bio Cat #A-201-500) using Zymoclean Gel DNA Recovery Kit (Zymo Research Cat #D4002) according to the manufacturer's protocol. The two fragments were then pieced together using Gibson assembly (New England BioLabs Cat #E2621S) following the manufacturer's protocol. Assembled products in pStx1 were transformed into chemically-competent Turbo Competent *E. coli* bacterial cells, plated on LB-Agar plates (LB: Teknova Cat #L9315, Agar: Quartzy Cat #214510) containing kanamycin. Individual colonies were picked and miniprepped using Qiagen Qiaprep spin Miniprep Kit (Qiagen Cat #27104) following the manufacturer's protocol. The resultant plasmids were sequenced using Sanger sequencing to ensure correct assembly. The correct clones were then subcloned into the mammalian expression vector pStx34 using restriction enzyme cloning. The pStx34 backbone and the CasX 488 clone in pStx1 were digested with XbaI and BamHI respectively. The digested backbone and insert fragments were purified by gel extraction from a 1% agarose gel (Gold Bio Cat #A-201-500) using Zymoclean Gel DNA Recovery Kit (Zymo Research Cat #D4002) according to the manufacturer's protocol. The clean backbone and insert were then ligated together using T4 Ligase (New England Biolabs Cat #M0202L) according to the manufacturer's protocol. The ligated product was transformed into chemically-competent Turbo Competent *E. coli* bacterial cells, plated on LB-Agar plates (LB: Teknova Cat #L9315, Agar: Quartzy Cat #214510) containing carbenicillin. Individual colonies were picked and miniprepped using Qiagen Qiaprep spin Miniprep Kit (Qiagen Cat #27104) following the manufacturer's protocol. The resultant plasmids were sequenced using Sanger sequencing to ensure correct assembly.

Figure 5:
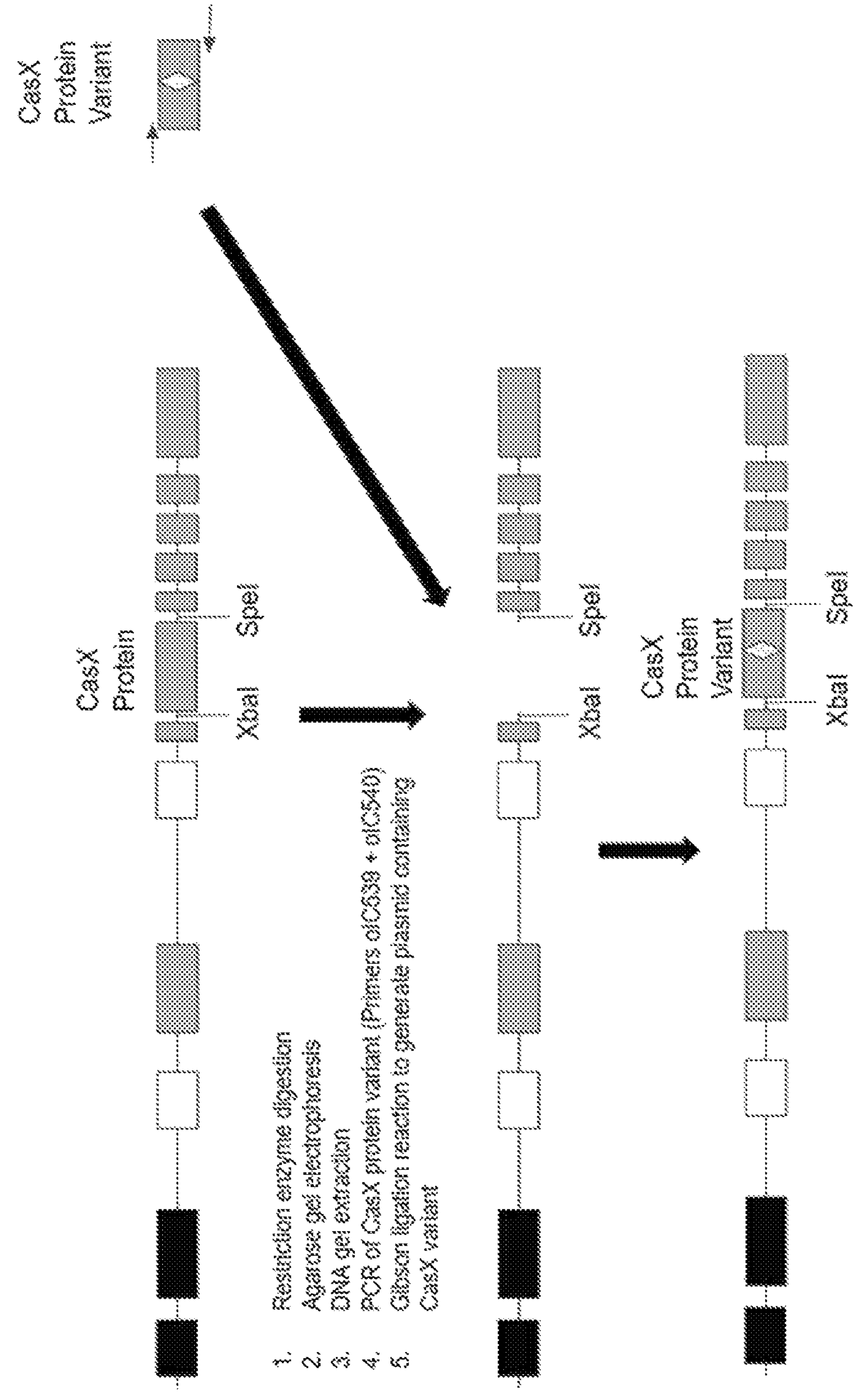
FIG. 5 is a schematic showing the steps of generating the CasX 119 variant, as described in Example 2.

In order to generate CasX 491 (sequences in Table 8), the CasX 484 construct DNA was PCR amplified using Q5 DNA polymerase (New England BioLabs Cat #M0491L) according to the manufacturer's protocol, using primers oIC765 and oIC762 (see FIG. 5). The CasX 1 construct was PCR amplified using Q5 DNA polymerase (New England BioLabs Cat #M0491L) according to the manufacturer's protocol, using primers oIC766 and oIC784. The PCR products were purified by gel extraction from a 1% agarose gel (Gold Bio Cat #A-201-500) using Zymoclean Gel DNA Recovery Kit (Zymo Research Cat #D4002) according to the manufacturer's protocol. The two fragments were then pieced together using Gibson assembly (New England BioLabs Cat #E2621S) following the manufacturer's protocol. Assembled products in pStx1 were transformed into chemically-competent Turbo Competent *E. coli* bacterial cells, plated on LB-Agar plates (LB: Teknova Cat #L9315, Agar: Quartzy Cat #214510) containing kanamycin. Individual colonies were picked and miniprepped using Qiagen Qiaprep spin Miniprep Kit (Qiagen Cat #27104) following the manufacturer's protocol. The resultant plasmids were sequenced using Sanger sequencing to ensure correct assembly. The correct clones were then subcloned into the mammalian expression vector pStx34 using restriction enzyme cloning. The pStx34 backbone and the CasX 491 clone in pStx1 were digested with XbaI and BamHI respectively. The digested backbone and insert fragments were purified by gel extraction from a 1% agarose gel (Gold Bio Cat #A-201-500) using Zymoclean Gel DNA Recovery Kit (Zymo Research Cat #D4002) according to the manufacturer's protocol. The clean backbone and insert were then ligated together using T4 Ligase (New England Biolabs Cat #M0202L) according to the manufacturer's protocol. The ligated product was transformed into chemically-competent Turbo Competent *E. coli* bacterial cells, plated on LB-Agar plates (LB: Teknova Cat #L9315, Agar: Quartzy Cat #214510) containing carbenicillin. Individual colonies were picked and miniprepped using Qiagen Qiaprep spin Miniprep Kit (Qiagen Cat #27104) following the manufacturer's protocol. The resultant plasmids were sequenced using Sanger sequencing to ensure correct assembly. pStX34 includes an EF-1α promoter for the protein as well as a selection marker for both puromycin and carbenicillin. Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically or electro-competent cells such as NEB Turbo competent *E. coli* (NEB Cat #C2984I), plated on LB-Agar plates (LB: Teknova Cat #L9315, Agar: Quartzy Cat #214510) containing carbenicillin. Individual colonies were picked and miniprepped using Qiagen Qiaprep spin Miniprep Kit (Qiagen Cat #27104) and following the manufacturer's protocol. The resultant plasmids were sequenced using Sanger sequencing to ensure correct ligation. SaCas9 and SpyCas9 control plasmids were prepared similarly to pStX plasmids described above, with the protein and guide regions of pStX exchanged for the respective protein and guide. Targeting sequences for SaCas9 and SpyCas9 were either obtained from the literature or were rationally designed according to established methods. The expression and recovery of the CasX constructs was performed using the general methodologies of Example 1 and Example 2, with similar results obtained.

TABLE 8

Sequences of CasX 488 and 491

| Construct | DNA Sequence | Amino Acid Sequence |
|---|---|---|
| CasX 488 | (SEQ ID NO: 444) | QEIKRINKIRRRLVKDSNTKKAGKTGPMK<br>TLLVRVMTPDLRERLENLRKKPENIPQPI<br>SNTSRANLNKLLTDYTEMKKAILHVYWEE<br>FQKDPVGLMSRVAQPASKKIDQNKLKPEM<br>DEKGNLTTAGFACSQCGQPLFVYKLEQVS<br>EKGKAYTNYFGRCNVAEHEKLILLAQLKP<br>EKDSDEAVTYSLGKFGQRALDFYSIHVTK<br>ESTHPVKPLAQIAGNRYASGPVGKALSDA<br>CMGTIASFLSKYQDIIIEHQKVVKGNQKR<br>LESLRELAGKENLEYPSVTLPPQPHTKEG<br>VDAYNEVIARVRMWVNLNLWQKLKLSRDD<br>AKPLLRLKGFPSFPLVERQANEVDWWDMV<br>CNVKKLINEKKEDGKVFWQNLAGYKRQEA<br>LRPYLSSEEDRKKGKKFARYQFGDLLLHL<br>EKKHGEDWGKVYDEAWERIDKKVEGLSKH<br>IKLEEERRSEDAQSKAALTDWLRAKASFV<br>IEGLKEADKDEFCRCELKLQKWYGDLRGK<br>PFAIEAENSILDISGFSKQYNCAFIWQKD<br>GVKKLNLYLIINYFKGGKLRFKKIKPEAF<br>EANRFYTVINKKSGEIVPMEVNFNFDDPN<br>LIILPLAFGKRQGREFIWNDLLSLETGSL<br>KLANGRVIEKTLYNRRTRQDEPALFVALT<br>FERREVLDSSNIKPMNLIGIDRGENIPAV<br>IALTDPEGCPLSRFKDSLGNPTHILRIGE<br>SYKEKQRTIQAKKEVEQRRAGGYSRKYAS<br>KAKNLADDMVRNTARDLLYYAVTQDAMLI<br>FENLSRGFGRQGKRTFMAERQYTRMEDWL<br>TAKLAYEGLSKTYLSKTLAQYTSKTCSNC<br>GFTITSADYDRVLEKLKKTATGWMTTING<br>KELKVEGQITYYNRYKRQNVVKDLSVELD<br>RLSEESVNNDISSWTKGRSGEALSLLKKR<br>FSHRPVQEKFVCLNCGFETHADEQAALNI<br>ARSWLFLRSQEYKKYQTNKTTGNTDKRAF<br>VETWQSFYRKKLKEVWKPAV<br>(SEQ ID NO: 445) |
| CasX 491 | (SEQ ID NO: 446) | QEIKRINKIRRRLVKDSNTKKAGKTGPMK<br>TLLVRVMTPDLRERLENLRKKPENIPQPI<br>SNTSRANLNKLLTDYTEMKKAILHVYWEE<br>FQKDPVGLMSRVAQPASKKIDQNKLKPEM<br>DEKGNLTTAGFACSQCGQPLFVYKLEQVS<br>EKGKAYTNYFGRCNVAEHEKLILLAQLKP<br>EKDSDEAVTYSLGKFGQRALDFYSIHVTK<br>ESTHPVKPLAQIAGNRYASGPVGKALSDA<br>CMGTIASFLSKYQDIIIEHQKVVKGNQKR<br>LESLRELAGKENLEYPSVTLPPQPHTKEG<br>VDAYNEVIARVRMWVNLNLWQKLKLSRDD<br>AKPLLRLKGFPSFPLVERQANEVDWWDMV<br>CNVKKLINEKKEDGKVFWQNLAGYKRQEA<br>LRPYLSSEEDRKKGKKFARYQLGDLLLHL<br>EKKHGEDWGKVYDEAWERIDKKVEGLSKH<br>IKLEEERRSEDAQSKAALTDWLRAKASFV<br>IEGLKEADKDEFCRCELKLQKWYGDLRGK<br>PFAIEAENSILDISGFSKQYNCAFIWQKD<br>GVKKLNLYLIINYFKGGKLRFKKIKPEAF<br>EANRFYTVINKKSGEIVPMEVNFNFDDPN<br>LIILPLAFGKRQGREFIWNDLLSLETGSL<br>KLANGRVIEKTLYNRRTRQDEPALFVALT<br>FERREVLDSSNIKPMNLIGVDRGENIPAV<br>IALTDPEGCPLSRFKDSLGNPTHILRIGE<br>SYKEKQRTIQAKKEVEQRRAGGYSRKYAS |

TABLE 8-continued

Sequences of CasX 488 and 491

| Construct | DNA Sequence | Amino Acid Sequence |
|---|---|---|
| | | KAKNLADDMVRNTARDLLYYAVTQDAMLI<br>FENLSRGFGRQGKRTFMAERQYTRMEDWL<br>TAKLAYEGLSKTYLSKTLAQYTSKTCSNC<br>GFTITSADYDRVLEKLKKTATGWMTTING<br>KELKVEGQITYYNRYKRQNVVKDLSVELD<br>RLSEESVNNDISSWTKGRSGEALSLLKKR<br>FSHRPVQEKFVCLNCGFETHADEQAALNI<br>ARSWLFLRSQEYKKYQTNKTTGNTDKRAF<br>VETWQSFYRKKLKEVWKPAV<br>(SEQ ID NO: 447) |

Example 4: Design and Generation of CasX Constructs 278-280, 285-288, 290, 291, 293, 300, 492, and 493

In order to generate the CasX 278-280, 285-288, 290, 291, 293, 300, 492, and 493 constructs (sequences in Table 9), the N- and C-termini of the codon-optimized CasX 119 construct (based on the CasX Stx37 construct of Example 2, encoding Planctomycetes CasX SEQ ID NO:2, with a A708K substitution and a [P793] deletion with fused NLS, and linked guide and non-targeting sequences) in a mammalian expression vector were manipulated to delete or add NLS sequences (sequences in Table 10). Constructs 278, 279, and 280 were manipulations of the N- and C-termini using only an SV40 NLS sequence. Construct 280 had no NLS on the N-terminus and added two SV40 NLS' on the C-terminus with a triple proline linker in between the two SV40 NLS sequences. Constructs 278, 279, and 280 were made by amplifying pStx34.119.174.NT with Q5 DNA polymerase (New England BioLabs Cat #M0491L) according to the manufacturer's protocol, using primers oIC527 and oIC528, oIC730 and oIC522, and oIC730 and oIC530 for the first fragments each and using oIC529 and oIC520, oIC519 and oIC731, and oIC529 and oIC731 to create the second fragments each. These fragments were purified by gel extraction from a 1% agarose gel (Gold Bio Cat #A-201-500) using Zymoclean Gel DNA Recovery Kit (Zymo Research Cat #D4002) according to the manufacturer's protocol. The respective fragments were cloned together using Gibson assembly (New England BioLabs Cat #E2621S) following the manufacturer's protocol. Assembled products in the pStx34 were transformed into chemically-competent Turbo Competent *E. coli* bacterial cells, plated on LB-Agar plates (LB: Teknova Cat #L9315, Agar: Quartzy Cat #214510) containing carbenicillin and incubated at 37° C. Individual colonies were picked and miniprepped using Qiagen Qiaprep spin Miniprep Kit (Qiagen Cat #27104) following the manufacturer's protocol. The resultant plasmids were sequenced using Sanger sequencing to ensure correct assembly. Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically- or electrocompetent cells such as NEB Turbo competent *E. coli* (NEB Cat #C2984I), plated on LB-Agar plates (LB: Teknova Cat #L9315, Agar: Quartzy Cat #214510) containing carbenicillin and incubated at 37° C. Individual colonies were picked and miniprepped using Qiagen Qiaprep spin Miniprep Kit (Qiagen Cat #27104) and following the manufacturer's protocol. The resultant plasmids were sequenced using Sanger sequencing to ensure correct ligation.

In order to generate constructs 285-288, 290, 291, 293, and 300, a nested PCR method was used for cloning. The backbone vector and PCR template used was construct pStx34 279.119.174.NT, having the CasX 119, guide 174, and non-targeting spacer (see Examples 8 and 9 and Tables therein for sequences). Construct 278 has the configuration SV40NLS-CasX119. Construct 279 has the configuration CasX119-SV40NLS. Construct 280 has the configuration CasX119-SV40NLS-PPP linker-SV40NLS. Construct 285 has the configuration CasX119-SV40NLS-PPP linker-SynthNLS3. Construct 286 has the configuration CasX119-SV40NLS-PPP linker-SynthNLS4. Construct 287 has the configuration CasX119-SV40NLS-PPP linker-SynthNLS5. Construct 288 has the configuration CasX119-SV40NLS-PPP linker-SynthNLS6. Constrict 290 has the configuration CasX119-SV40NLS-PPP linker-EGL-13 NLS. Construct 291 has the configuration CasX119-SV40NLS-PPP linker-c-Myc NLS. Construct 293 has the configuration CasX119-SV40NLS-PPP linker-Nucleolar RNA Helicase II NLS. Construct 300 has the configuration CasX119-SV40NLS-PPP linker-Influenza A protein NLS. Construct 492 has the configuration SV40NLS-CasX119-SV40NLS-PPP linker-SV40NLS. Construct 493 has the configuration SV40NLS-CasX119-SV40NLS-PPP linker-c-Myc NLS. Each variant had a set of three PCRs; two of which were nested, were purified by gel extraction, digested, and then ligated into the digested and purified backbone. Assembled products in the pStx34 were transformed into chemically-competent Turbo Competent *E. coli* bacterial cells, plated on LB-Agar plates (LB: Teknova Cat #L9315, Agar: Quartzy Cat #214510) containing carbenicillin and incubated at 37° C. Individual colonies were picked and miniprepped using Qiagen Qiaprep spin Miniprep Kit (Qiagen Cat #27104) following the manufacturer's protocol. The resultant plasmids were sequenced using Sanger sequencing to ensure correct assembly. Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence. These two oligos were annealed together and cloned into the resulting pStX individually or in bulk by Golden Gate assembly using T4 DNA Ligase (New England BioLabs Cat #M0202L) and an appropriate restriction enzyme for the plasmid. Golden Gate products were transformed into chemically- or electro-competent cells such as NEB Turbo competent *E. coli* (NEB Cat #C2984I), plated on LB-Agar plates (LB: Teknova Cat #L9315, Agar: Quartzy Cat #214510) containing carbenicillin and incubated at 37° C. Individual colonies were picked and miniprepped using Qiagen Qiaprep spin Miniprep Kit (Qiagen Cat #27104) and following the manufacturer's protocol. The resultant plasmids were sequenced using Sanger sequencing to ensure correct ligation.

In order to generate constructs 492 and 493, constructs 280 and 291 were digested using XbaI and BamHI (NEB #R0145S and NEB #R3136S) according to the manufacturer's protocol. Next, they were purified by gel extraction from a 1% agarose gel (Gold Bio Cat #A-201-500) using Zymoclean Gel DNA Recovery Kit (Zymo Research Cat #D4002) according to the manufacturer's protocol. Finally, they were ligated using T4 DNA ligase (NEB #M0202S) according to the manufacturer's protocol into the digested and purified pStx34.119.174.NT using XbaI and BamHI and Zymoclean Gel DNA Recovery Kit. Assembled products in the pStx34 were transformed into chemically-competent Turbo Competent *E. coli* bacterial cells, plated on LB-Agar plates (LB: Teknova Cat #L9315, Agar: Quartzy Cat #214510) containing carbenicillin and incubated at 37° C. Individual colonies were picked and miniprepped using Qiagen Qiaprep spin Miniprep Kit (Qiagen Cat #27104) following the manufacturer's protocol. The resultant plasmids were sequenced using Sanger sequencing to ensure correct assembly. Sequences encoding the targeting spacer sequences that target the gene of interest were designed based on CasX PAM locations. Targeting sequence DNA was ordered as single-stranded DNA (ssDNA) oligos (Integrated DNA Technologies) consisting of the targeting spacer sequence and the reverse complement of this sequence. These two oligos were annealed together and cloned into each pStX individually or in bulk by Golden Gate assembly using T4 DNA Ligase (New England BioLabs Cat #M0202L) and an appropriate restriction enzyme for the respective plasmids. Golden Gate products were transformed into chemically- or electro-competent cells such as NEB Turbo competent *E. coli* (NEB Cat #C2984I), plated on LB-Agar plates (LB: Teknova Cat #L9315, Agar: Quartzy Cat #214510) containing carbenicillin and incubated at 37° C. Individual colonies were picked and miniprepped using Qiagen Qiaprep spin Miniprep Kit (Qiagen Cat #27104) and following the manufacturer's protocol. The resultant plasmids were sequenced using Sanger sequencing to ensure correct ligation. The plasmids were used to produce and recover CasX protein utilizing the general methodologies of Examples 1 and 2.

TABLE 9

CasX 278-280, 285-288, 290, 291, 293, 300, 492, and 493 sequences

| Construct | Amino Acid Sequence |
|---|---|
| 278 | MAPKKKRKVSRQEIKRINKIRRRLVKDSNTKKAGKTGPMKTLLVRVMTP DLRERLENLRKKPENIPQPISNTSRANLNKLLTDYTEMKKAILHVYWEEF QKDPVGLMSRVAQPAPKNIDQRKLIPVKDGNERLTSSGFACSQCCQPLY VYKLEQVNDKGKPHTNYFGRCNVSEHERLILLSPHKPEANDELVTYSLG KFGQRALDFYSIHVTRESNHPVKPLEQIGGNSCASGPVGKALSDACMGA VASFLTKYQDIILEHQKVIKKNEKRLANLKDIASANGLAFPKITLPPQPHTK EGIEAYNNVVAQIVIWVNLNLWQKLKIGRDEAKPLQRLKGFPSFPLVERQ ANEVDWWDMVCNVKKLINEKKEDGKVFWQNLAGYKRQEALRPYLSSE EDRKKGKKFARYQFGDLLLHLEKKHGEDWGKVYDEAWERIDKKVEGLS KHIKLEEERRSEDAQSKAALTDWLRAKASFVIEGLKEADKDEFCRCELKL |

TABLE 9-continued

CasX 278-280, 285-288, 290, 291, 293, 300, 492, and 493 sequences

| Construct | Amino Acid Sequence |
|---|---|
| | QKWYGDLRGKPFAIEAENSILDISGFSKQYNCAFIWQKDGVKKLNLYLIIN<br>YFKGGKLRFKKIKPEAFEANRFYTVINKKSGEIVPMEVNFNFDDPNLIILPL<br>AFGKRQGREFIWNDLLSLETGSLKLANGRVIEKTLYNRRTRQDEPALFVA<br>LTFERREVLDSSNIKPMNLIGIDRGENIPAVIALTDPEGCPLSRFKDSLGN<br>PTHILRIGESYKEKQRTIQAKKEVEQRRAGGYSRKYASKAKNLADDMVR<br>NTARDLLYYAVTQDAMLIFENLSRGFGRQGKRTFMAERQYTRMEDWLT<br>AKLAYEGLSKTYLSKTLAQYTSKTCSNCGFTITSADYDRVLEKLKKTATG<br>WMTTINGKELKVEGQITYYNRYKRQNVVKDLSVELDRLSEESVNNDISS<br>WTKGRSGEALSLLKKRFSHRPVQEKFVCLNCGFETHADEQAALNIARS<br>WLFLRSQEYKKYQTNKTTGNTDKRAFVETWQSFYRKKLKEVWKPAV<br>(SEQ ID NO: 448) |
| 279 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDIIL<br>EHQKVIKKNEKRLANLKDIASANGLAFPKITLPPQPHTKEGIEAYNNVVAQI<br>VIWVNLNLWQKLKIGRDEAKPLQRLKGFPSFPLVERQANEVDWWDMVC<br>NVKKLINEKKEDGKVFWQNLAGYKRQEALRPYLSSEEDRKKGKKFARYQ<br>FGDLLLHLEKKHGEDWGKVYDEAWERIDKKVEGLSKHIKLEEERRSEDA<br>QSKAALTDWLRAKASFVIEGLKEADKDEFCRCELKLQKWYGDLRGKPFA<br>IEAENSILDISGFSKQYNCAFIWQKDGVKKLNLYLIINYFKGGKLRFKKIKP<br>EAFEANRFYTVINKKSGEIVPMEVNFNFDDPNLIILPLAFGKRQGREFIWN<br>DLLSLETGSLKLANGRVIEKTLYNRRTRQDEPALFVALTFERREVLDSSNI<br>KPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDA<br>MLIFENLSRGFGRQGKRTFMAERQYTRMEDWLTAKLAYEGLSKTYLSKT<br>LAQYTSKTCSNCGFTITSADYDRVLEKLKKTATGWMTTINGKELKVEGQI<br>TYYNRYKRQNVVKDLSVELDRLSEESVNNDISSWTKGRSGEALSLLKKR<br>FSHRPVQEKFVCLNCGFETHADEQAALNIARSWLFLRSQEYKKYQTNKT<br>TGNTDKRAFVETWQSFYRKKLKEVWKPAVTSPKKKRKV<br>(SEQ ID NO: 449) |
| 280 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDIIL<br>EHQKVIKKNEKRLANLKDIASANGLAFPKITLPPQPHTKEGIEAYNNVVAQI<br>VIWVNLNLWQKLKIGRDEAKPLQRLKGFPSFPLVERQANEVDWWDMVC<br>NVKKLINEKKEDGKVFWQNLAGYKRQEALRPYLSSEEDRKKGKKFARYQ<br>FGDLLLHLEKKHGEDWGKVYDEAWERIDKKVEGLSKHIKLEEERRSEDA<br>QSKAALTDWLRAKASFVIEGLKEADKDEFCRCELKLQKWYGDLRGKPFA<br>IEAENSILDISGFSKQYNCAFIWQKDGVKKLNLYLIINYFKGGKLRFKKIKP<br>EAFEANRFYTVINKKSGEIVPMEVNFNFDDPNLIILPLAFGKRQGREFIWN<br>DLLSLETGSLKLANGRVIEKTLYNRRTRQDEPALFVALTFERREVLDSSNI<br>KPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDA<br>MLIFENLSRGFGRQGKRTFMAERQYTRMEDWLTAKLAYEGLSKTYLSKT<br>LAQYTSKTCSNCGFTITSADYDRVLEKLKKTATGWMTTINGKELKVEGQI<br>TYYNRYKRQNVVKDLSVELDRLSEESVNNDISSWTKGRSGEALSLLKKR<br>FSHRPVQEKFVCLNCGFETHADEQAALNIARSWLFLRSQEYKKYQTNKT<br>TGNTDKRAFVETWQSFYRKKLKEVWKPAVTSPKKKRKVPPPPKKKRKV<br>(SEQ ID NO: 450) |
| 285 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDIIL<br>EHQKVIKKNEKRLANLKDIASANGLAFPKITLPPQPHTKEGIEAYNNVVAQI<br>VIWVNLNLWQKLKIGRDEAKPLQRLKGFPSFPLVERQANEVDWWDMVC<br>NVKKLINEKKEDGKVFWQNLAGYKRQEALRPYLSSEEDRKKGKKFARYQ<br>FGDLLLHLEKKHGEDWGKVYDEAWERIDKKVEGLSKHIKLEEERRSEDA<br>QSKAALTDWLRAKASFVIEGLKEADKDEFCRCELKLQKWYGDLRGKPFA<br>IEAENSILDISGFSKQYNCAFIWQKDGVKKLNLYLIINYFKGGKLRFKKIKP<br>EAFEANRFYTVINKKSGEIVPMEVNFNFDDPNLIILPLAFGKRQGREFIWN<br>DLLSLETGSLKLANGRVIEKTLYNRRTRQDEPALFVALTFERREVLDSSNI<br>KPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDA<br>MLIFENLSRGFGRQGKRTFMAERQYTRMEDWLTAKLAYEGLSKTYLSKT<br>LAQYTSKTCSNCGFTITSADYDRVLEKLKKTATGWMTTINGKELKVEGQI<br>TYYNRYKRQNVVKDLSVELDRLSEESVNNDISSWTKGRSGEALSLLKKR<br>FSHRPVQEKFVCLNCGFETHADEQAALNIARSWLFLRSQEYKKYQTNKT |

TABLE 9-continued

| CasX 278-280, 285-288, 290, 291, 293, 300, 492, and 493 sequences | |
|---|---|
| Construct | Amino Acid Sequence |
| | TGNTDKRAFVETWQSFYRKKLKEVWKPAVTSPKKKRKVPPPHKKKHPD<br>ASVNFSEFSK<br>(SEQ ID NO: 451) |
| 286 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDIIL<br>EHQKVIKKNEKRLANLKDIASANGLAFPKITLPPQPHTKEGIEAYNNVVAQI<br>VIWVNLNLWQKLKIGRDEAKPLQRLKGFPSFPLVERQANEVDWWDMVC<br>NVKKLINEKKEDGKVFWQNLAGYKRQEALRPYLSSEEDRKKGKKFARYQ<br>FGDLLLHLEKKHGEDWGKVYDEAWERIDKKVEGLSKHIKLEEERRSEDA<br>QSKAALTDWLRAKASFVIEGLKEADKDEFCRCELKLQKWYGDLRGKPFA<br>IEAENSILDISGFSKQYNCAFIWQKDGVKKLNLYLIINYFKGGKLRFKKIKP<br>EAFEANRFYTVINKKSGEIVPMEVNFNFDDPNLIILPLAFGKRQGREFIWN<br>DLLSLETGSLKLANGRVIEKTLYNRRTRQDEPALFVALTFERREVLDSSNI<br>KPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDA<br>MLIFENLSRGFGRQGKRTFMAERQYTRMEDWLTAKLAYEGLSKTYLSKT<br>LAQYTSKTCSNCGFTITSADYDRVLEKLKKTATGWMTTINGKELKVEGQI<br>TYYNRYKRQNVVKDLSVELDRLSEESVNNDISSWTKGRSGEALSLLKKR<br>FSHRPVQEKFVCLNCGFETHADEQAALNIARSWLFLRSQEYKKYQTNKT<br>TGNTDKRAFVETWQSFYRKKLKEVWKPAVTSPKKKRKVPPPQRPGPYD<br>RPQRPGPYDRP<br>(SEQ ID NO: 452) |
| 287 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTSSGFACSQCCQPLYVYKLEQVNDKG<br>KPHTNYFGRCNVSEHERLILLSPHKPEANDELVTYSLGKFGQRALDFYSI<br>HVTRESNHPVKPLEQIGGNSCASGPVGKALSDACMGAVASFLTKYQDIIL<br>EHQKVIKKNEKRLANLKDIASANGLAFPKITLPPQPHTKEGIEAYNNVVAQI<br>VIWVNLNLWQKLKIGRDEAKPLQRLKGFPSFPLVERQANEVDWWDMVC<br>NVKKLINEKKEDGKVFWQNLAGYKRQEALRPYLSSEEDRKKGKKFARYQ<br>FGDLLLHLEKKHGEDWGKVYDEAWERIDKKVEGLSKHIKLEEERRSEDA<br>QSKAALTDWLRAKASFVIEGLKEADKDEFCRCELKLQKWYGDLRGKPFA<br>IEAENSILDISGFSKQYNCAFIWQKDGVKKLNLYLIINYFKGGKLRFKKIKP<br>EAFEANRFYTVINKKSGEIVPMEVNFNFDDPNLIILPLAFGKRQGREFIWN<br>DLLSLETGSLKLANGRVIEKTLYNRRTRQDEPALFVALTFERREVLDSSNI<br>KPMNLIGIDRGENIPAVIALTDPEGCPLSRFKDSLGNPTHILRIGESYKEKQ<br>RTIQAKKEVEQRRAGGYSRKYASKAKNLADDMVRNTARDLLYYAVTQDA<br>MLIFENLSRGFGRQGKRTFMAERQYTRMEDWLTAKLAYEGLSKTYLSKT<br>LAQYTSKTCSNCGFTITSADYDRVLEKLKKTATGWMTTINGKELKVEGQI<br>TYYNRYKRQNVVKDLSVELDRLSEESVNNDISSWTKGRSGEALSLLKKR<br>FSHRPVQEKFVCLNCGFETHADEQAALNIARSWLFLRSQEYKKYQTNKT<br>TGNTDKRAFVETWQSFYRKKLKEVWKPAVTSPKKKRKVPPPLSPSLSPL<br>LSPSLSPL<br>(SEQ ID NO: 453) |
| 288 | MQEIKRINKIRRRLVKDSNTKKAGKTGPMKTLLVRVMTPDLRERLENLRK<br>KPENIPQPISNTSRANLNKLLTDYTEMKKAILHVYWEEFQKDPVGLMSRV<br>AQPAPKNIDQRKLIPVKDGNERLTMSSGFACSQCCQPLYVYKLEQVNDK<br>GKPHTNYFGRCNVSEHERLILLSPHKPEANDELVTYSLGKFGQRALDFY<br>SIHVTRESNHPVKPLEQIGGNSCASGPVGKALSDACMGAVASFLTKYQDI<br>ILEHQKVIKKNEKRLANLKDIASANGLAFPKITLPPQPHTKEGIEAYNNVVA<br>QIVIWVNLNLWQKLKIGRDEAKPLQRLKGFPSFPLVERQANEVDWWDMV<br>CNVKKLINEKKEDGKVFWQNLAGYKRQEALRPYLSSEEDRKKGKKFARY<br>QFGDLLLHLEKKHGEDWGKVYDEAWERIDKKVEGLSKHIKLEEERRSED<br>AQSKAALTDWLRAKASFVIEGLKEADKDEFCRCELKLQKWYGDLRGKPF<br>AIEAENSILDISGFSKQYNCAFIWQKDGVKKLNLYLIINYFKGGKLRFKKIK<br>PEAFEANRFYTVINKKSGEIVPMEVNFNFDDPNLIILPLAFGKRQGREFIW<br>NDLLSLETGSLKLANGRVIEKTLYNRRTRQDEPALFVALTFERREVLDSS<br>NIKPMNLIGIDRGENIPAVIALTDPEGCPLSRFKDSLGNPTHILRIGESYKE<br>KQRTIQAKKEVEQRRAGGYSRKYASKAKNLADDMVRNTARDLLYYAVT<br>QDAMLIFENLSRGFGRQGKRTFMAERQYTRMEDWLTAKLAYEGLSKTY<br>LSKTLAQYTSKTCSNCGFTITSADYDRVLEKLKKTATGWMTTINGKELKV<br>EGQITYYNRYKRQNVVKDLSVELDRLSEESVNNDISSWTKGRSGEALSL<br>LKKRFSHRPVQEKFVCLNCGFETHADEQAALNIARSWLFLRSQEYKKYQ<br>TNKTTGNTDKRAFVETWQSFYRKKLKEVWKPAVTSPKKKRKVPPPRGK<br>GGKGLGKGGAKRHRK<br>(SEQ ID NO: 454) |

TABLE 9-continued

| CasX 278-280, 285-288, 290, 291, 293, 300, 492, and 493 sequences | |
|---|---|
| Construct | Amino Acid Sequence |
| 290 | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDIIL EHQKVIKKNEKRLANLKDIASANGLAFPKITLPPQPHTKEGIEAYNNVVAQI VIWVNLNLWQKLKIGRDEAKPLQRLKGFPSFPLVERQANEVDWWDMVC NVKKLINEKKEDGKVFWQNLAGYKRQEALRPYLSSEEDRKKGKKFARYQ FGDLLLHLEKKHGEDWGKVYDEAWERIDKKVEGLSKHIKLEEERRSEDA QSKAALTDWLRAKASFVIEGLKEADKDEFCRCELKLQKWYGDLRGKPFA IEAENSILDISGFSKQYNCAFIWQKDGVKKLNLYLIINYFKGGKLRFKKIKP EAFEANRFYTVINKKSGEIVPMEVNFNFDDPNLIILPLAFGKRQGREFIWN DLLSLETGSLKLANGRVIEKTLYNRRTRQDEPALFVALTFERREVLDSSNI KPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDA MLIFENLSRGFGRQGKRTFMAERQYTRMEDWLTAKLAYEGLSKTYLSKT LAQYTSKTCSNCGFTITSADYDRVLEKLKKTATGWMTTINGKELKVEGQI TYYNRYKRQNVVKDLSVELDRLSEESVNNDISSWTKGRSGEALSLLKKR FSHRPVQEKFVCLNCGFETHADEQAALNIARSWLFLRSQEYKKYQTNKT TGNTDKRAFVETWQSFYRKKLKEVWKPAVTSPKKKRKVPPPSRRRKAN PTKLSENAKKLAKEVEN (SEQ ID NO: 455) |
| 291 | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDIIL EHQKVIKKNEKRLANLKDIASANGLAFPKITLPPQPHTKEGIEAYNNVVAQI VIWVNLNLWQKLKIGRDEAKPLQRLKGFPSFPLVERQANEVDWWDMVC NVKKLINEKKEDGKVFWQNLAGYKRQEALRPYLSSEEDRKKGKKFARYQ FGDLLLHLEKKHGEDWGKVYDEAWERIDKKVEGLSKHIKLEEERRSEDA QSKAALTDWLRAKASFVIEGLKEADKDEFCRCELKLQKWYGDLRGKPFA IEAENSILDISGFSKQYNCAFIWQKDGVKKLNLYLIINYFKGGKLRFKKIKP EAFEANRFYTVINKKSGEIVPMEVNFNFDDPNLIILPLAFGKRQGREFIWN DLLSLETGSLKLANGRVIEKTLYNRRTRQDEPALFVALTFERREVLDSSNI KPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDA MLIFENLSRGFGRQGKRTFMAERQYTRMEDWLTAKLAYEGLSKTYLSKT LAQYTSKTCSNCGFTITSADYDRVLEKLKKTATGWMTTINGKELKVEGQI TYYNRYKRQNVVKDLSVELDRLSEESVNNDISSWTKGRSGEALSLLKKR FSHRPVQEKFVCLNCGFETHADEQAALNIARSWLFLRSQEYKKYQTNKT TGNTDKRAFVETWQSFYRKKLKEVWKPAVTSPKKKRKVPPPPAAKRVK LD (SEQ ID NO: 456) |
| 293 | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDIIL EHQKVIKKNEKRLANLKDIASANGLAFPKITLPPQPHTKEGIEAYNNVVAQI VIWVNLNLWQKLKIGRDEAKPLQRLKGFPSFPLVERQANEVDWWDMVC NVKKLINEKKEDGKVFWQNLAGYKRQEALRPYLSSEEDRKKGKKFARYQ FGDLLLHLEKKHGEDWGKVYDEAWERIDKKVEGLSKHIKLEEERRSEDA QSKAALTDWLRAKASFVIEGLKEADKDEFCRCELKLQKWYGDLRGKPFA IEAENSILDISGFSKQYNCAFIWQKDGVKKLNLYLIINYFKGGKLRFKKIKP EAFEANRFYTVINKKSGEIVPMEVNFNFDDPNLIILPLAFGKRQGREFIWN DLLSLETGSLKLANGRVIEKTLYNRRTRQDEPALFVALTFERREVLDSSNI KPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDA MLIFENLSRGFGRQGKRTFMAERQYTRMEDWLTAKLAYEGLSKTYLSKT LAQYTSKTCSNCGFTITSADYDRVLEKLKKTATGWMTTINGKELKVEGQI TYYNRYKRQNVVKDLSVELDRLSEESVNNDISSWTKGRSGEALSLLKKR FSHRPVQEKFVCLNCGFETHADEQAALNIARSWLFLRSQEYKKYQTNKT TGNTDKRAFVETWQSFYRKKLKEVWKPAVTSPKKKRKVPPPKRSFSKA F (SEQ ID NO: 457) |
| 300 | MQEIKRINKIRRRLVKDSNTKKAGKTGPMKTLLVRVMTPDLRERLENLRK KPENIPQPISNTSRANLNKLLTDYTEMKKAILHVYWEEFQKDPVGLMSRV AQPAPKNIDQRKLIPVKDGNERLTSSGFACSQCCQPLYVYKLEQVNDKG KPHTNYFGRCNVSEHERLILLSPHKPEANDELVTYSLGKFGQRALDFYSI HVTRESNHPVKPLEQIGGNSCASGPVGKALSDACMGAVASFLTKYQDIIL |

TABLE 9-continued

CasX 278-280, 285-288, 290, 291, 293, 300, 492, and 493 sequences

| Construct | Amino Acid Sequence |
|---|---|
| | EHQKVIKKNEKRLANLKDIASANGLAFPKITLPPQPHTKEGIEAYNNVVAQI VIWVNLNLWQKLKIGRDEAKPLQRLKGFPSFPLVERQANEVDWWDMVC NVKKLINEKKEDGKVFWQNLAGYKRQEALRPYLSSEEDRKKGKKFARYQ FGDLLLHLEKKHGEDWGKVYDEAWERIDKKVEGLSKHIKLEEERRSEDA QSKAALTDWLRAKASFVIEGLKEADKDEFCRCELKLQKWYGDLRGKPFA IEAENSILDISGFSKQYNCAFIWQKDGVKKLNLYLIINYFKGGKLRFKKIKP EAFEANRFYTVINKKSGEIVPMEVNFNFDDPNLIILPLAFGKRQGREFIWN DLLSLETGSLKLANGRVIEKTLYNRRTRQDEPALFVALTFERREVLDSSNI KPMNLIGIDRGENIPAVIALTDPEGCPLSRFKDSLGNPTHILRIGESYKEKQ RTIQAKKEVEQRRAGGYSRKYASKAKNLADDMVRNTARDLLYYAVTQDA MLIFENLSRGFGRQGKRTFMAERQYTRMEDWLTAKLAYEGLSKTYLSKT LAQYTSKTCSNCGFTITSADYDRVLEKLKKTATGWMTTINGKELKVEGQI TYYNRYKRQNVVKDLSVELDRLSEESVNNDISSWTKGRSGEALSLLKKR FSHRPVQEKFVCLNCGFETHADEQAALNIARSWLFLRSQEYKKYQTNKT TGNTDKRAFVETWQSFYRKKLKEVWKPAVTSPKKKRKVPPPKRGINDR NFWRGENERKTR (SEQ ID NO: 458) |
| 492 | MAPKKKRKVSRMQEIKRINKIRRRLVKDSNTKKAGKTGPMKTLLVRVMTP DLRERLENLRKKPENIPQPISNTSRANLNKLLTDYTEMKKAILHVYWEEFQ KDPVGLMSRVAQPAPKNIDQRKLIPVKDGNERLTSSGFACSQCCQPLYV YKLEQVNDKGKPHTNYFGRCNVSEHERLILLSPHKPEANDELVTYSLGKF GQRALDFYSIHVTRESNHPVKPLEQIGGNSCASGPVGKALSDACMGAVA SFLTKYQDIILEHQKVIKKNEKRLANLKDIASANGLAFPKITLPPQPHTKEGI EAYNNVVAQIVIWVNLNLWQKLKIGRDEAKPLQRLKGFPSFPLVERQANE VDWWDMVCNVKKLINEKKEDGKVFWQNLAGYKRQEALRPYLSSEEDRK KGKKFARYQFGDLLLHLEKKHGEDWGKVYDEAWERIDKKVEGLSKHIKL EEERRSEDAQSKAALTDWLRAKASFVIEGLKEADKDEFCRCELKLQKWY GDLRGKPFAIEAENSILDISGFSKQYNCAFIWQKDGVKKLNLYLIINYFKG GKLRFKKIKPEAFEANRFYTVINKKSGEIVPMEVNFNFDDPNLIILPLAFGK RQGREFIWNDLLSLETGSLKLANGRVIEKTLYNRRTRQDEPALFVALTFE RREVLDSSNIKPMNLIGIDRGENIPAVIALTDPEGCPLSRFKDSLGNPTHIL RIGESYKEKQRTIQAKKEVEQRRAGGYSRKYASKAKNLADDMVRNTARD LLYYAVTQDAMLIFENLSRGFGRQGKRTFMAERQYTRMEDWLTAKLAYE GLSKTYLSKTLAQYTSKTCSNCGFTITSADYDRVLEKLKKTATGWMTTIN GKELKVEGQITYYNRYKRQNVVKDLSVELDRLSEESVNNDISSWTKGRS GEALSLLKKRFSHRPVQEKFVCLNCGFETHADEQAALNIARSWLFLRSQ EYKKYQTNKTTGNTDKRAFVETWQSFYRKKLKEVWKPAVTSPKKKRKV PPPPKKKRKV (SEQ ID NO: 459) |
| 493 | MAPKKKRKVSRMQEIKRINKIRRRLVKDSNTKKAGKTGPMKTLLVRVMTP DLRERLENLRKKPENIPQPISNTSRANLNKLLTDYTEMKKAILHVYWEEFQ KDPVGLMSRVAQPAPKNIDQRKLIPVKDGNERLTSSGFACSQCCQPLYV YKLEQVNDKGKPHTNYFGRCNVSEHERLILLSPHKPEANDELVTYSLGKF GQRALDFYSIHVTRESNHPVKPLEQIGGNSCASGPVGKALSDACMGAVA SFLTKYQDIILEHQKVIKKNEKRLANLKDIASANGLAFPKITLPPQPHTKEGI EAYNNVVAQIVIWVNLNLWQKLKIGRDEAKPLQRLKGFPSFPLVERQANE VDWWDMVCNVKKLINEKKEDGKVFWQNLAGYKRQEALRPYLSSEEDRK KGKKFARYQFGDLLLHLEKKHGEDWGKVYDEAWERIDKKVEGLSKHIKL EEERRSEDAQSKAALTDWLRAKASFVIEGLKEADKDEFCRCELKLQKWY GDLRGKPFAIEAENSILDISGFSKQYNCAFIWQKDGVKKLNLYLIINYFKG GKLRFKKIKPEAFEANRFYTVINKKSGEIVPMEVNFNFDDPNLIILPLAFGK RQGREFIWNDLLSLETGSLKLANGRVIEKTLYNRRTRQDEPALFVALTFE RREVLDSSNIKPMNLIGIDRGENIPAVIALTDPEGCPLSRFKDSLGNPTHIL RIGESYKEKQRTIQAKKEVEQRRAGGYSRKYASKAKNLADDMVRNTARD LLYYAVTQDAMLIFENLSRGFGRQGKRTFMAERQYTRMEDWLTAKLAYE GLSKTYLSKTLAQYTSKTCSNCGFTITSADYDRVLEKLKKTATGWMTTIN GKELKVEGQITYYNRYKRQNVVKDLSVELDRLSEESVNNDISSWTKGRS GEALSLLKKRFSHRPVQEKFVCLNCGFETHADEQAALNIARSWLFLRSQ EYKKYQTNKTTGNTDKRAFVETWQSFYRKKLKEVWKPAVTSPKKKRKV PPPPAAKRVKLD (SEQ ID NO: 460) |

TABLE 10

Nuclear localization sequence list

| CasX | NLS | DNA Sequence | Amino Acid Sequence |
|---|---|---|---|
| 278, 279, 280, 492, 493 | SV40 | CCAAAGAAGAAGCGGAAGGTC (SEQ ID NO: 461) | PKKKRKV (SEQ ID NO: 158) |
| 285 | SynthNLS3 | CACAAGAAGAAACATCCAGACGCATCAGTCAACTTTAGCAGTTCAGTAAA (SEQ ID NO: 462) | HKKKHPDASVNFGSEFSK (SEQ ID NO: 189) |
| 286 | SynthNLS4 | CAGCGCCCTGGGCCTTACGATAGGCCGCAAAGACCCGGACCGTATGATCGCCCT (SEQ ID NO: 463) | QRPGPYDRPQRPGPYDRP (SEQ ID NO: 190) |
| 287 | SynthNLS5 | CTCAGCCCGAGTCTTAGTCCACTGCTTTCCCCGTCCCTGCTCCACTG (SEQ ID NO: 464) | LSPSLSPLLSPSTLSPL (SEQ ID NO: 191) |
| 288 | SynthNLS6 | CGGGGCAAGGGTGGCAAGGGGCTTGGCAAGGGGGGGGCAAAGAGGCACAGGAAG (SEQ ID NO: 465) | RGKGGKGLGKGGAKRHRK (SEQ ID NO: 192) |
| 290 | EGL-13 | AGCCGCCGCAGAAAAGCCAATCCTACAAAACTGTCAGAAAATGCGAAAAAACTTGCTAAGGAGGTGGAAAAC (SEQ ID NO: 466) | SRRRKANPTKLSENAKKLAKEVEN (SEQ ID NO: 470) |
| 291 | c-Myc | CCTGCCGCAAAGCGAGTGAAATTGGAC (SEQ ID NO: 467) | PAAKRVKLD (SEQ ID NO: 160) |
| 293 | Nucleolar RNA Helicase II | AAGCGGTCCTTCAGTAAGGCCTTT (SEQ ID NO: 468) | KRSFSKAF (SEQ ID NO: 181) |
| 300 | Influenza A protein | AAACGGGGAATAAACGACCGGAACTTCTGGCGCGGGGAAAACGAGCGCAAAACCCGA (SEQ ID NO: 469) | KRGINDRNFWRGENERKTR (SEQ ID NO: 179) |

Example 5: Design and Generation of CasX Constructs 387, 395, 485-491, and 494

In order to generate CasX 395, CasX 485, CasX 486, CasX 487, the codon optimized CasX 119 (based on the CasX 37 construct of Example 2, encoding Planctomycetes CasX SEQ ID NO: 2, with a A708K substitution and a [P793] deletion with fused NLS, and linked guide and non-targeting sequences), CasX 435, CasX 438, and CasX 484 (each based on CasX 119 construct of Example 2 encoding Planctomycetes CasX SEQ ID NO: 2, with a L379R substitution, a A708K substitution, and a [P793] deletion with fused NLS, and linked guide and non-targeting sequences) were cloned respectively into a 4 kb staging vector comprising a KanR marker, colE1 ori, and CasX with fused NLS (pStx1) using standard cloning methods. Gibson primers were designed to amplify the CasX SEQ ID NO: 1 Helical I domain from amino acid 192-331 in its own vector to replace this corresponding region (aa 193-332) on CasX 119, CasX 435, CasX 438, and CasX 484 in pStx1 respectively. The Helical I domain from CasX SEQ ID NO: 1 was amplified with primers oIC768 and oIC784 using Q5 DNA polymerase (New England BioLabs Cat #M0491L) according to the manufacturer's protocol. The destination vector containing the desired CasX variant was amplified with primers oIC765 and oIC764 using Q5 DNA polymerase (New England BioLabs Cat #M0491L) according to the manufacturer's protocol. The two fragments were purified by gel extraction from a 1% agarose gel (Gold Bio Cat #A-201-500) using Zymoclean Gel DNA Recovery Kit (Zymo Research Cat #D4002) according to the manufacturer's protocol. The insert and backbone fragments were then pieced together using Gibson assembly (New England BioLabs Cat #E2621S) following the manufacturer's protocol. Assembled products in the pStx1 staging vector were transformed into chemically-competent Turbo Competent *E. coli* bacterial cells, plated on LB-Agar plates (LB: Teknova Cat #L9315, Agar: Quartzy Cat #214510) containing kanamycin and incubated at 37° C. Individual colonies were picked and miniprepped using Qiagen Qiaprep spin Miniprep Kit (Qiagen Cat #27104) following the manufacturer's protocol. The resultant plasmids were sequenced using Sanger sequencing to ensure correct assembly. Correct clones were then cut and pasted into a mammalian expression plasmid (see FIG. 5) using standard cloning methods. The resultant plasmids were sequenced using Sanger sequencing to ensure correct assembly. Sequences encoding the targeting spacer sequences that target the gene of interest were designed based on CasX PAM locations. Targeting spacer sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically or electro-competent cells such as NEB Turbo competent *E. coli* (NEB Cat #C2984I), plated on LB-Agar plates (LB: Teknova Cat #L9315, Agar: Quartzy Cat #214510) containing carbenicillin and incubated at 37° C. Individual colonies were picked and miniprepped using Qiagen Qiaprep spin Miniprep Kit (Qiagen Cat #27104) following the manufacturer's protocol. The resultant plasmids were sequenced using Sanger sequencing to ensure correct ligation.

In order to generate CasX 488, CasX 489, CasX 490, and CasX 491 (sequences in Table 11), the codon optimized CasX 119 (based on the CasX 37 construct of Example 2, encoding Planctomycetes CasX SEQ ID NO: 2, with a A708K substitution and a [P793] deletion with fused NLS, and linked guide and non-targeting sequences), CasX 435, CasX 438, and CasX 484 (each based on CasX119 construct of Example 2 encoding Planctomycetes CasX SEQ ID NO: 2, with a L379R substitution, a A708K substitution, and a [P793] deletion with fused NLS, and linked guide and non-targeting sequences) were cloned respectively into a 4 kb staging vector that was made up of a KanR marker, colE1 ori, and STX with fused NLS (pStx1) using standard cloning methods. Gibson primers were designed to amplify the CasX Stx1 NTSB domain from amino acid 101-191 and Helical I domain from amino acid 192-331 in its own vector to replace this similar region (aa 103-332) on CasX 119, CasX 435, CasX 438, and CasX 484 in pStx1 respectively. The NTSB and Helical I domain from CasX SEQ ID NO: 1 were amplified with primers oIC766 and oIC784 using Q5 DNA polymerase (New England BioLabs Cat #M0491L) according to the manufacturer's protocol. The destination vector containing the desired CasX variant was amplified with primers oIC762 and oIC765 using Q5 DNA polymerase (New England BioLabs Cat #M0491L) according to the manufacturer's protocol. The two fragments were purified by gel extraction from a 1% agarose gel (Gold Bio Cat #A-201-500) using Zymoclean Gel DNA Recovery Kit (Zymo Research Cat #D4002) according to the manufacturer's protocol. The insert and backbone fragments were then pieced together using Gibson assembly (New England BioLabs Cat #E2621S) following the manufacturer's protocol. Assembled products in the pStx1 staging vector were transformed into chemically-competent Turbo Competent *E. coli* bacterial cells, plated on LB-Agar plates (LB: Teknova Cat #L9315, Agar: Quartzy Cat #214510) containing kanamycin and incubated at 37° C. Individual colonies were picked and minipreped using Qiagen Qiaprep spin Miniprep Kit (Qiagen Cat #27104) following the manufacturer's protocol. The resultant plasmids were sequenced using Sanger sequencing to ensure correct assembly. Correct clones were then cut and pasted into a mammalian expression plasmid (see FIG. 5) using standard cloning methods. The resultant plasmids were sequenced using Sanger sequencing to ensure correct assembly. Sequences encoding the targeting spacer sequences that target the gene of interest were designed based on CasX PAM locations. Targeting spacer sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically or electro-competent cells such as NEB Turbo competent *E. coli* (NEB Cat #C2984I), plated on LB-Agar plates (LB: Teknova Cat #L9315, Agar: Quartzy Cat #214510) containing carbenicillin and incubated at 37° C. Individual colonies were picked and minipreped using Qiagen Qiaprep spin Miniprep Kit (Qiagen Cat #27104) and following the manufacturer's protocol. The resultant plasmids were sequenced using Sanger sequencing to ensure correct ligation.

In order to generate CasX 387 and CasX 494 (sequences in Table 11), the codon optimized CasX 119 (based on the CasX 37 construct of Example 2, encoding Planctomycetes CasX SEQ ID NO:2, with a A708K substitution and a [P793] deletion with fused NLS, and linked guide and non-targeting sequences) and CasX 484 (based on CasX119 construct of Example 2 encoding Planctomycetes CasX SEQ ID NO: 2, with a L379R substitution, a A708K substitution, and a [P793] deletion with fused NLS, and linked guide and non-targeting sequences) were cloned respectively into a 4 kb staging vector that was made up of a KanR marker, colE1 ori, and STX with fused NLS (pStx1) using standard cloning methods. Gibson primers were designed to amplify the CasX Stx1 NTSB domain from amino acid 101-191 in its own vector to replace this similar region (aa 103-192) on CasX 119 and CasX 484 in pStx1 respectively. The NTSB domain from CasX Stx1 was amplified with primers oIC766 and oIC767 using Q5 DNA polymerase (New England BioLabs Cat #M0491L) according to the manufacturer's protocol. The destination vector containing the desired CasX variant was amplified with primers oIC763 and oIC762 using Q5 DNA polymerase (New England BioLabs Cat #M0491L) according to the manufacturer's protocol. The two fragments were purified by gel extraction from a 1% agarose gel (Gold Bio Cat #A-201-500) using Zymoclean Gel DNA Recovery Kit (Zymo Research Cat #D4002) according to the manufacturer's protocol. The insert and backbone fragments were then pieced together using Gibson assembly (New England BioLabs Cat #E2621S) following the manufacturer's protocol. Assembled products in the pStx1 staging vector were transformed into chemically-competent Turbo Competent *E. coli* bacterial cells, plated on LB-Agar plates (LB: Teknova Cat #L9315, Agar: Quartzy Cat #214510) containing kanamycin and incubated at 37° C. Individual colonies were picked and minipreped using Qiagen Qiaprep spin Miniprep Kit (Qiagen Cat #27104) following the manufacturer's protocol. The resultant plasmids were sequenced using Sanger sequencing to ensure correct assembly. Correct clones were then cut and pasted into a mammalian expression plasmid (see FIG. 5) using standard cloning methods. The resultant plasmids were sequenced using Sanger sequencing to ensure correct assembly. Sequences encoding the targeting sequences that target the gene of interest were designed based on CasX PAM locations. Targeting sequence DNA was ordered as single-stranded DNA (ssDNA) oligos (Integrated DNA Technologies) consisting of the targeting sequence and the reverse complement of this sequence. These two oligos were annealed together and cloned into pStX individually or in bulk by Golden Gate assembly using T4 DNA Ligase (New England BioLabs Cat #M0202L) and an appropriate restriction enzyme for the plasmid. Golden Gate products were transformed into chemically or electro-competent cells such as NEB Turbo competent *E. coli* (NEB Cat #C2984I), plated on LB-Agar plates (LB: Teknova Cat #L9315, Agar: Quartzy Cat #214510) containing carbenicillin and incubated at 37° C. Individual colonies were picked and minipreped using Qiagen Qiaprep spin Miniprep Kit (Qiagen Cat #27104) and following the manufacturer's protocol. The resultant plasmids were sequenced using Sanger sequencing to ensure correct ligation. Sequences of the resulting constructs are listed in Table 11.

TABLE 11

Sequences of CasX 395 and 485-491

| Construct | DNA Sequence | Amino Acid Sequence |
|---|---|---|
| CasX 387 | (SEQ ID NO: 471) | MAPKKKRKVSRQEIKRINKIRRRLVKDSNTKKAGKTGPMKTL LVRVMTPDLRERLENLRKKPENIPQPISNTSRANLNKLLTDY TEMKKAILHVYWEEFQKDPVGLMSRVAQPASKKIDQNKLKP EMDEKGNLTTAGFACSQCGQPLFVYKLEQVSEKGKAYTNY FGRCNVAEHEKLILLAQLKPEKDSDEAVTYSLGKFGQRALD FYSIHVTRESNHPVKPLEQIGGNSCASGPVGKALSDACMGA VASFLTKYQDIILEHQKVIKKNEKRLANLKDIASANGLAFPKIT LPPQPHTKEGIEAYNNVVAQIVIWVNLNLWQKLKIGRDEAKP LQRLKGFPSFPLVERQANEVDWWDMVCNVKKLINEKKEDG KVFWQNLAGYKRQEALRPYLSSEEDRKKGKKFARYQFGDL LLHLEKKHGEDWGKVYDEAWERIDKKVEGLSKHIKLEEERR |

TABLE 11-continued

| Sequences of CasX 395 and 485-491 | | |
|---|---|---|
| Construct | DNA Sequence | Amino Acid Sequence |
| | | SEDAQSKAALTDWLRAKASFVIEGLKEADKDEFCRCELKLQ<br>KWYGDLRGKPFAIEAENSILDISGFSKQYNCAFIWQKDGVKK<br>LNLYLIINYFKGGKLRFKKIKPEAFEANRFYTVINKKSGEIVPM<br>EVNFNFDDPNLIILPLAFGKRQGREFIWNDLLSLETGSLKLAN<br>GRVIEKTLYNRRTRQDEPALFVALTFERREVLDSSNIKPMNLI<br>GIDRGENIPAVIALTDPEGCPLSRFKDSLGNPTHILRIGESYK<br>EKQRTIQAKKEVEQRRAGGYSRKYASKAKNLADDMVRNTA<br>RDLLYYAVTQDAMLIFENLSRGFGRQGKRTFMAERQYTRM<br>EDWLTAKLAYEGLSKTYLSKTLAQYTSKTCSNCGFTITSADY<br>DRVLEKLKKTATGWMTTINGKELKVEGQITYYNRYKRQNVV<br>KDLSVELDRLSEESVNNDISSWTKGRSGEALSLLKKRFSHR<br>PVQEKFVCLNCGFETHADEQAALNIARSWLFLRSQEYKKYQ<br>TNKTTGNTDKRAFVETWQSFYRKKLKEVWKPAVTSPKKKR<br>KV (SEQ ID NO: 472) |
| CasX 395 | (SEQ ID NO: 473) | MAPKKKRKVSRQEIKRINKIRRRLVKDSNTKKAGKTGPMKTL<br>LVRVMTPDLRERLENLRKKPENIPQPISNTSRANLNKLLTDY<br>TEMKKAILHVYWEEFQKDPVGLMSRVAQPAPKNIDQRKLIP<br>VKDGNERLTSSGFACSQCCQPLYVYKLEQVNDKGKPHTNY<br>FGRCNVSEHERLILLSPHKPEANDELVTYSLGKFGQRALDF<br>YSIHVTKESTHPVKPLAQIAGNRYASGPVGKALSDACMGTIA<br>SFLSKYQDIIIEHQKWKGNQKRLESLRELAGKENLEYPSVTL<br>PPQPHTKEGVDAYNEVIARVRMWVNLNLWQKLKLSRDDAK<br>PLLRLKGFPSFPLVERQANEVDWWDMVCNVKKLINEKKED<br>GKVFWQNLAGYKRQEALRPYLSSEEDRKKGKKFARYQFGD<br>LLLHLEKKHGEDWGKVYDEAWERIDKKVEGLSKHIKLEEER<br>RSEDAQSKAALTDWLRAKASFVIEGLKEADKDEFCRCELKL<br>QKWYGDLRGKPFAIEAENSILDISGFSKQYNCAFIWQKDGV<br>KKLNLYLIINYFKGGKLRFKKIKPEAFEANRFYTVINKKSGEIV<br>PMEVNFNFDDPNLIILPLAFGKRQGREFIWNDLLSLETGSLK<br>LANGRVIEKTLYNRRTRQDEPALFVALTFERREVLDSSNIKP<br>MNLIGIDRGENIPAVIALTDPEGCPLSRFKDSLGNPTHILRIGE<br>SYKEKQRTIQAKKEVEQRRAGGYSRKYASKAKNLADDMVR<br>NTARDLLYYAVTQDAMLIFENLSRGFGRQGKRTFMAERQYT<br>RMEDWLTAKLAYEGLSKTYLSKTLAQYTSKTCSNCGFTITSA<br>DYDRVLEKLKKTATGWMTTINGKELKVEGQITYYNRYKRQN<br>VVKDLSVELDRLSEESVNNDISSWTKGRSGEALSLLKKRFS<br>HRPVQEKFVCLNCGFETHADEQAALNIARSWLFLRSQEYKK<br>YQTNKTTGNTDKRAFVETWQSFYRKKLKEVWKPAVTSPKK<br>KRKVTSPKKKRKV (SEQ ID NO: 474) |
| CasX 485 | (SEQ ID NO: 475) | MAPKKKRKVSRQEIKRINKIRRRLVKDSNTKKAGKTGPMKTL<br>LVRVMTPDLRERLENLRKKPENIPQPISNTSRANLNKLLTDY<br>TEMKKAILHVYWEEFQKDPVGLMSRVAQPAPKNIDQRKLIP<br>VKDGNERLTSSGFACSQCCQPLYVYKLEQVNDKGKPHTNY<br>FGRCNVSEHERLILLSPHKPEANDELVTYSLGKFGQRALDF<br>YSIHVTKESTHPVKPLAQIAGNRYASGPVGKALSDACMGTIA<br>SFLSKYQDIIIEHQKWKGNQKRLESLRELAGKENLEYPSVTL<br>PPQPHTKEGVDAYNEVIARVRMWWNLNLWQKLKLSRDDAK<br>PLLRLKGFPSFPLVERQANEVDWWDMVCNVKKLINEKKED<br>GKVFWQNLAGYKRQEALRPYLSSEEDRKKGKKFARYQLGD<br>LLLHLEKKHGEDWGKVYDEAWERIDKKVEGLSKHIKLEEER<br>RSEDAQSKAALTDWLRAKASFVIEGLKEADKDEFCRCELKL<br>QKWYGDLRGKPFAIEAENSILDISGFSKQYNCAFIWQKDGV<br>KKLNLYLIINYFKGGKLRFKKIKPEAFEANRFYTVINKKSGEIV<br>PMEVNFNFDDPNLIILPLAFGKRQGREFIWNDLLSLETGSLK<br>LANGRVIEKTLYNRRTRQDEPALFVALTFERREVLDSSNIKP<br>MNLIGVDRGENIPAVIALTDPEGCPLSRFKDSLGNPTHILRIG<br>ESYKEKQRTIQAKKEVEQRRAGGYSRKYASKAKNLADDMV<br>RNTARDLLYYAVTQDAMLIFENLSRGFGRQGKRTFMAERQ<br>YTRMEDWLTAKLAYEGLSKTYLSKTLAQYTSKTCSNCGFTIT<br>SADYDRVLEKLKKTATGWMTTINGKELKVEGQITYYNRRKR<br>QNWKDLSVELDRLSEESVNNDISSWTKGRSGEALSLLKKR<br>FSHRPVQEKFVCLNCGFETHADEQAALNIARSWLFLRSQEY<br>KKYQTNKTTGNTDKRAFVETWQSFYRKKLKEVWKPAVTSP<br>KKKRKV (SEQ ID NO: 476) |
| CasX 486 | (SEQ ID NO: 477) | MAPKKKRKVSRQEIKRINKIRRRLVKDSNTKKAGKTGPMKTL<br>LVRVMTPDLRERLENLRKKPENIPQPISNTSRANLNKLLTDY<br>TEMKKAILHVYWEEFQKDPVGLMSRVAQPAPKNIDQRKLIP<br>VKDGNERLTSSGFACSQCCQPLYVYKLEQVNDKGKPHTNY<br>FGRCNVSEHERLILLSPHKPEANDELVTYSLGKFGQRALDF<br>YSIHVTKESTHPVKPLAQIAGNRYASGPVGKALSDACMGTIA<br>SFLSKYQDIIIEHQKWKGNQKRLESLRELAGKENLEYPSVTL<br>PPQPHTKEGVDAYNEVIARVRMWNLNLWQKLKLSRDDAK |

TABLE 11-continued

Sequences of CasX 395 and 485-491

| Construct | DNA Sequence | Amino Acid Sequence |
|---|---|---|
| | | PLLRLKGFPSFPLVERQANEVDWWDMVCNVKKLINEKKED<br>GKVFWQNLAGYKRQEALRPYLSSEEDRKKGKKFARYQLGD<br>LLKHLEKKHGEDWGKVYDEAWERIDKKVEGLSKHIKLEEER<br>RSEDAQSKAALTDWLRAKASFVIEGLKEADKDEFCRCELKL<br>QKWYGDLRGKPFAIEAENSILDISGFSKQYNCAFIWQKDGV<br>KKLNLYLIINYFKGGKLRFKKIKPEAFEANRFYTVINKKSGEIV<br>PMEVNFNFDDPNLIILPLAFGKRQGREFIWNDLLSLETGSLK<br>LANGRVIEKTLYNRRTRQDEPALFVALTFERREVLDSSNIKP<br>MNLIGVDRGENIPAVIALTDPEGCPLSRFKDSLGNPTHILRIG<br>ESYKEKQRTIQAKKEVEQRRAGGYSRKYASKAKNLADDMV<br>RNTARDLLYYAVTQDAMLIFENLSRGFGRQGKRTFMAERQ<br>YTRMEDWLTAKLAYEGLSKTYLSKTLAQYTSKTCSNCGFTIT<br>SADYDRVLEKLKKTATGWMTTINGKELKVEGQITYYNRRKR<br>QNWKDLSVELDRLSEESVNNDISSWTKGRSGEALSLLKKR<br>FSHRPVQEKFVCLNCGFETHADEQAALNIARSWLFLRSQEY<br>KKYQTNKTTGNTDKRAFVETWQSFYRKKLKEVWKPAVTSP<br>KKKRKV (SEQ ID NO: 478) |
| CasX 487 | (SEQ ID NO: 479) | MAPKKKRKVSRQEIKRINKIRRRLVKDSNTKKAGKTGPMKTL<br>LVRVMTPDLRERLENLRKKPENIPQPISNTSRANLNKLLTDY<br>TEMKKAILHVYWEEFQKDPVGLMSRVAQPAPKNIDQRKLIP<br>VKDGNERLTSSGFACSQCCQPLYVYKLEQVNDKGKPHTNY<br>FGRCNVSEHERLILLSPHKPEANDELVTYSLGKFGQRALDF<br>YSIHVTKESTHPVKPLAQIAGNRYASGPVGKALSDACMGTIA<br>SFLSKYQDIIIEHQKWKGNQKRLESLRELAGKENLEYPSVTL<br>PPQPHTKEGVDAYNEVIARVRMWNLNLWQKLKLSRDDAK<br>PLLRLKGFPSFPLVERQANEVDWWDMVCNVKKLINEKKED<br>GKVFWQNLAGYKRQEALRPYLSSEEDRKKGKKFARYQLGD<br>LLLHLEKKHGEDWGKVYDEAWERIDKKVEGLSKHIKLEEER<br>RSEDAQSKAALTDWLRAKASFVIEGLKEADKDEFCRCELKL<br>QKWYGDLRGKPFAIEAENSILDISGFSKQYNCAFIWQKDGV<br>KKLNLYLIINYFKGGKLRFKKIKPEAFEANRFYTVINKKSGEIV<br>PMEVNFNFDDPNLIILPLAFGKRQGREFIWNDLLSLETGSLK<br>LANGRVIEKTLYNRRTRQDEPALFVALTFERREVLDSSNIKP<br>MNLIGVDRGENIPAVIALTDPEGCPLSRFKDSLGNPTHILRIG<br>ESYKEKQRTIQAKKEVEQRRAGGYSRKYASKAKNLADDMV<br>RNTARDLLYYAVTQDAMLIFENLSRGFGRQGKRTFMAERQ<br>YTRMEDWLTAKLAYEGLSKTYLSKTLAQYTSKTCSNCGFTIT<br>SADYDRVLEKLKKTATGWMTTINGKELKVEGQITYYNRYKR<br>QNWKDLSVELDRLSEESVNNDISSWTKGRSGEALSLLKKR<br>FSHRPVQEKFVCLNCGFETHADEQAALNIARSWLFLRSQEY<br>KKYQTNKTTGNTDKRAFVETWQSFYRKKLKEVWKPAVTSP<br>KKKRKV (SEQ ID NO: 480) |
| CasX 488 | (SEQ ID NO: 481) | MAPKKKRKVSRQEIKRINKIRRRLVKDSNTKKAGKTGPMKTL<br>LVRVMTPDLRERLENLRKKPENIPQPISNTSRANLNKLLTDY<br>TEMKKAILHVYWEEFQKDPVGLMSRVAQPASKKIDQNKLKP<br>EMDEKGNLTTAGFACSQCGQPLFVYKLEQVSEKGKAYTNY<br>FGRCNVAEHEKLILLAQLKPEKDSDEAVTYSLGKFGQRALD<br>FYSIHVTKESTHPVKPLAQIAGNRYASGPVGKALSDACMGTI<br>ASFLSKYQDIIIEHQKVVKGNQKRLESLRELAGKENLEYPSV<br>TLPPQPHTKEGVDAYNEVIARVRMWVNLNLWQKLKLSRDD<br>AKPLLRLKGFPSFPLVERQANEVDWWDMVCNVKKLINEKKE<br>DGKVFWQNLAGYKRQEALRPYLSSEEDRKKGKKFARYQFG<br>DLLLHLEKKHGEDWGKVYDEAWERIDKKVEGLSKHIKLEEE<br>RRSEDAQSKAALTDWLRAKASFVIEGLKEADKDEFCRCELK<br>LQKWYGDLRGKPFAIEAENSILDISGFSKQYNCAFIWQKDGV<br>KKLNLYLIINYFKGGKLRFKKIKPEAFEANRFYTVINKKSGEIV<br>PMEVNFNFDDPNLIILPLAFGKRQGREFIWNDLLSLETGSLK<br>LANGRVIEKTLYNRRTRQDEPALFVALTFERREVLDSSNIKP<br>MNLIGIDRGENIPAVIALTDPEGCPLSRFKDSLGNPTHILRIGE<br>SYKEKQRTIQAKKEVEQRRAGGYSRKYASKAKNLADDMVR<br>NTARDLLYYAVTQDAMLIFENLSRGFGRQGKRTFMAERQYT<br>RMEDWLTAKLAYEGLSKTYLSKTLAQYTSKTCSNCGFTITSA<br>DYDRVLEKLKKTATGWMTTINGKELKVEGQITYYNRYKRQN<br>VVKDLSVELDRLSEESVNNDISSWTKGRSGEALSLLKKRFS<br>HRPVQEKFVCLNCGFETHADEQAALNIARSWLFLRSQEYKK<br>YQTNKTTGNTDKRAFVETWQSFYRKKLKEVWKPAVTSPKK<br>KRKV (SEQ ID NO: 482) |
| CasX 489 | (SEQ ID NO: 483) | MAPKKKRKVSRQEIKRINKIRRRLVKDSNTKKAGKTGPMKTL<br>LVRVMTPDLRERLENLRKKPENIPQPISNTSRANLNKLLTDY<br>TEMKKAILHVYWEEFQKDPVGLMSRVAQPASKKIDQNKLKP<br>EMDEKGNLTTAGFACSQCGQPLFVYKLEQVSEKGKAYTNY<br>FGRCNVAEHEKLILLAQLKPEKDSDEAVTYSLGKFGQRALD |

TABLE 11-continued

| Sequences of CasX 395 and 485-491 | | |
|---|---|---|
| Construct | DNA Sequence | Amino Acid Sequence |
| | | FYSIHVTKESTHPVKPLAQIAGNRYASGPVGKALSDACMGTI ASFLSKYQDIIIEHQKVVKGNQKRLESLRELAGKENLEYPSV TLPPQPHTKEGVDAYNEVIARVRMWVNLNLWQKLKLSRDD AKPLLRLKGFPSFPLVERQANEVDWWDMVCNVKKLINEKKE DGKVFWQNLAGYKRQEALRPYLSSEEDRKKGKKFARYQLG DLLLHLEKKHGEDWGKVYDEAWERIDKKVEGLSKHIKLEEE RRSEDAQSKAALTDWLRAKASFVIEGLKEADKDEFCRCELK LQKWYGDLRGKPFAIEAENSILDISGFSKQYNCAFIWQKDGV KKLNLYLIINYFKGGKLRFKKIKPEAFEANRFYTVINKKSGEIV PMEVNFNFDDPNLIILPLAFGKRQGREFIWNDLLSLETGSLK LANGRVIEKTLYNRRTRQDEPALFVALTFERREVLDSSNIKP MNLIGVDRGENIPAVIALTDPEGCPLSRFKDSLGNPTHILRIG ESYKEKQRTIQAKKEVEQRRAGGYSRKYASKAKNLADDMV RNTARDLLYYAVTQDAMLIFENLSRGFGRQGKRTFMAERQ YTRMEDWLTAKLAYEGLSKTYLSKTLAQYTSKTCSNCGFTIT SADYDRVLEKLKKTATGWMTTINGKELKVEGQITYYNRRKR QNVVKDLSVELDRLSEESVNNDISSWTKGRSGEALSLLKKR FSHRPVQEKFVCLNCGFETHADEQAALNIARSWLFLRSQEY KKYQTNKTTGNTDKRAFVETWQSFYRKKLKEVWKPAVTSP KKKRKV (SEQ ID NO: 484) |
| CasX 490 | (SEQ ID NO: 485) | MAPKKKRKVSRQEIKRINKIRRRLVKDSNTKKAGKTGPMKTL LVRVMTPDLRERLENLRKKPENIPQPISNTSRANLNKLLTDY TEMKKAILHVYWEEFQKDPVGLMSRVAQPASKKIDQNKLKP EMDEKGNLTTAGFACSQCGQPLFVYKLEQVSEKGKAYTNY FGRCNVAEHEKLILLAQLKPEKDSDEAVTYSLGKFGQRALD FYSIHVTKESTHPVKPLAQIAGNRYASGPVGKALSDACMGTI ASFLSKYQDIIIEHQKVVKGNQKRLESLRELAGKENLEYPSV TLPPQPHTKEGVDAYNEVIARVRMWVNLNLWQKLKLSRDD AKPLLRLKGFPSFPLVERQANEVDWWDMVCNVKKLINEKKE DGKVFWQNLAGYKRQEALRPYLSSEEDRKKGKKFARYQLG DLLKHLEKKHGEDWGKVYDEAWERIDKKVEGLSKHIKLEEE RRSEDAQSKAALTDWLRAKASFVIEGLKEADKDEFCRCELK LQKWYGDLRGKPFAIEAENSILDISGFSKQYNCAFIWQKDGV KKLNLYLIINYFKGGKLRFKKIKPEAFEANRFYTVINKKSGEIV PMEVNFNFDDPNLIILPLAFGKRQGREFIWNDLLSLETGSLK LANGRVIEKTLYNRRTRQDEPALFVALTFERREVLDSSNIKP MNLIGVDRGENIPAVIALTDPEGCPLSRFKDSLGNPTHILRIG ESYKEKQRTIQAKKEVEQRRAGGYSRKYASKAKNLADDMV RNTARDLLYYAVTQDAMLIFENLSRGFGRQGKRTFMAERQ YTRMEDWLTAKLAYEGLSKTYLSKTLAQYTSKTCSNCGFTIT SADYDRVLEKLKKTATGWMTTINGKELKVEGQITYYNRRKR QNVVKDLSVELDRLSEESVNNDISSWTKGRSGEALSLLKKR FSHRPVQEKFVCLNCGFETHADEQAALNIARSWLFLRSQEY KKYQTNKTTGNTDKRAFVETWQSFYRKKLKEVWKPAVTSP KKKRKV (SEQ ID NO: 486) |
| CasX 491 | (SEQ ID NO: 487) | MAPKKKRKVSRQEIKRINKIRRRLVKDSNTKKAGKTGPMKTL LVRVMTPDLRERLENLRKKPENIPQPISNTSRANLNKLLTDY TEMKKAILHVYWEEFQKDPVGLMSRVAQPASKKIDQNKLKP EMDEKGNLTTAGFACSQCGQPLFVYKLEQVSEKGKAYTNY FGRCNVAEHEKLILLAQLKPEKDSDEAVTYSLGKFGQRALD FYSIHVTKESTHPVKPLAQIAGNRYASGPVGKALSDACMGTI ASFLSKYQDIIIEHQKVVKGNQKRLESLRELAGKENLEYPSV TLPPQPHTKEGVDAYNEVIARVRMWVNLNLWQKLKLSRDD AKPLLRLKGFPSFPLVERQANEVDWWDMVCNVKKLINEKKE DGKVFWQNLAGYKRQEALRPYLSSEEDRKKGKKFARYQLG DLLLHLEKKHGEDWGKVYDEAWERIDKKVEGLSKHIKLEEE RRSEDAQSKAALTDWLRAKASFVIEGLKEADKDEFCRCELK LQKWYGDLRGKPFAIEAENSILDISGFSKQYNCAFIWQKDGV KKLNLYLIINYFKGGKLRFKKIKPEAFEANRFYTVINKKSGEIV PMEVNFNFDDPNLIILPLAFGKRQGREFIWNDLLSLETGSLK LANGRVIEKTLYNRRTRQDEPALFVALTFERREVLDSSNIKP MNLIGVDRGENIPAVIALTDPEGCPLSRFKDSLGNPTHILRIG ESYKEKQRTIQAKKEVEQRRAGGYSRKYASKAKNLADDMV RNTARDLLYYAVTQDAMLIFENLSRGFGRQGKRTFMAERQ YTRMEDWLTAKLAYEGLSKTYLSKTLAQYTSKTCSNCGFTIT SADYDRVLEKLKKTATGWMTTINGKELKVEGQITYYNRYKR QNVVKDLSVELDRLSEESVNNDISSWTKGRSGEALSLLKKR FSHRPVQEKFVCLNCGFETHADEQAALNIARSWLFLRSQEY KKYQTNKTTGNTDKRAFVETWQSFYRKKLKEVWKPAVTSP KKKRKV (SEQ ID NO: 488) |

TABLE 11-continued

| Sequences of CasX 395 and 485-491 | | |
|---|---|---|
| Construct | DNA Sequence | Amino Acid Sequence |
| CasX 494 | (SEQ ID NO: 489) | MAPKKKRKVSRQEIKRINKIRRRLVKDSNTKKAGKTGPMKTL LVRVMTPDLRERLENLRKKPENIPQPISNTSRANLNKLLTDY TEMKKAILHVYWEEFQKDPVGLMSRVAQPASKKIDQNKLKP EMDEKGNLTTAGFACSQCGQPLFVYKLEQVSEKGKAYTNY FGRCNVAEHEKLILLAQLKPEKDSDEAVTYSLGKFGQRALD FYSIHVTRESNHPVKPLEQIGGNSCASGPVGKALSDACMGA VASFLTKYQDIILEHQKVIKKNEKRLANLKDIASANGLAFPKIT LPPQPHTKEGIEAYNNVVAQIVIWVNLNLWQKLKIGRDEAKP LQRLKGFPSFPLVERQANEVDWWDMVCNVKKLINEKKEDG KVFWQNLAGYKRQEALRPYLSSEEDRKKGKKFARYQLGDL LLHLEKKHGEDWGKVYDEAWERIDKKVEGLSKHIKLEEERR SEDAQSKAALTDWLRAKASFVIEGLKEADKDEFCRCELKLQ KWYGDLRGKPFAIEAENSILDISGFSKQYNCAFIWQKDGVKK LNLYLIINYFKGGKLRFKKIKPEAFEANRFYTVINKKSGEIVPM EVNFNFDDPNLIILPLAFGKRQGREFIWNDLLSLETGSLKLAN GRVIEKTLYNRRTRQDEPALFVALTFERREVLDSSNIKPMNLI GVDRGENIPAVIALTDPEGCPLSRFKDSLGNPTHILRIGESYK EKQRTIQAKKEVEQRRAGGYSRKYASKAKNLADDMVRNTA RDLLYYAVTQDAMLIFENLSRGFGRQGKRTFMAERQYTRM EDWLTAKLAYEGLSKTYLSKTLAQYTSKTCSNCGFTITSADY DRVLEKLKKTATGWMTTINGKELKVEGQITYYNRYKRQNVV KDLSVELDRLSEESVNNDISSWTKGRSGEALSLLKKRFSHR PVQEKFVCLNCGFETHADEQAALNIARSWLFLRSQEYKKYQ TNKTTGNTDKRAFVETWQSFYRKKLKEVWKPAVTSPKKKR KV (SEQ ID NO: 490) |

Example 6: Generation of RNA Guides

For the generation of RNA single guides and spacers, templates for in vitro transcription were generated by performing PCR with Q5 polymerase (NEB M0491) according to the recommended protocol, with template oligos for each backbone and amplification primers with the T7 promoter and the spacer sequence. The DNA primer sequences for the T7 promoter, guide and spacer for guides and spacers are presented in Table 12, below. The template oligos, labeled "backbone fwd" and "backbone rev" for each scaffold, were included at a final concentration of 20 nM each, and the amplification primers (T7 promoter and the unique spacer primer) were included at a final concentration of 1 uM each. The sg2, sg32, sg64, and sg174 guides correspond to SEQ TD NOS: 5, 2104, 2106, and 2238, respectively, with the exception that sg2, sg32, and sg64 were modified with an additional 5' G to increase transcription efficiency (compare sequences in Table 12 to Table 2). The 7.37 spacer targets beta2-microglobulin (B2M). Following PCR amplification, templates were cleaned and isolated by phenol-chloroform-isoamyl alcohol extraction followed by ethanol precipitation.

In vitro transcriptions were carried out in buffer containing 50 mM Tris pH 8.0, 30 mM $MgCl_2$, 0.01% Triton X-100, 2 mM spermidine, 20 mM DTT, 5 mM NTPs, 0.5 GM template, and 100 μg/mL T7 RNA polymerase. Reactions were incubated at 37° C. overnight. 20 units of DNase I (Promega #M6101)) were added per 1 mL of transcription volume and incubated for one hour. RNA products were purified via denaturing PAGE, ethanol precipitated, and resuspended in 1× phosphate buffered saline. To fold the sgRNAs, samples were heated to 70' C for 5 min and then cooled to room temperature. The reactions were supplemented to 1 mM final $MgCl_2$ concentration, heated to 50° C. for 5 min and then cooled to room temperature. Final RNA guide products were stored at −80° C.

TABLE 12

| Sequences for generation of guide RNA | | |
|---|---|---|
| Primer | Primer sequence | RNA product |
| T7 promoter primer | GAAATTAATACGACTCACTATA (SEQ ID NO: 491) | Used for all |
| sg2 backbone fwd | GAAATTAATACGACTCACTATA GGTACTGGCGCTTTTATCTCAT TACTTTGAGAGCCATCACCAGC GACTATGTCGTATGGGTAAAG (SEQ ID NO: 492) | GGUACUGGCGCU UUUAUCUCAUUA CUUUGAGAGCCA UCACCAGCGACU AUGUCGUAUGGG |
| sg2 backbone rev | CTTTGATGCTTCTTATTTATCG GATTTCTCTCCGATAAATAAGC GCTTTACCCATACGACATAGTC GCTGGTGATGGC (SEQ ID NO: 493) | UAAAGCGCUUAU UUAUCGGAGAGA AAUCCGAUAAAU AAGAAGCAUCAA AGGGCCGAGAUG |
| sg2.7.37 spacer primer | CGGAGCGAGACATCTCGGCCCT TTGATGCTTCTTATTTATCGGA TTTCTCTCCG (SEQ ID NO: 494) | UCUCGCUCCG (SEQ ID NO: 504) |
| sg32 backbone fwd | GAAATTAATACGACTCACTATA GGTACTGGCGCTTTTATCTCAT TACTTTGAGAGCCATCACCAGC GACTATGTCGTATGGGTAAAGC GC (SEQ ID NO: 495) | GGUACUGGCGCU UUUAUCUCAUUA CUUUGAGAGCCA UCACCAGCGACU AUGUCGUAUGGG |
| sg32 backbone rev | CTTTGATGCTTCCCTCCGAAGA GGGCGCTTTACCCATACGACAT AG (SEQ ID NO: 496) | UAAAGCGCCCUC UUCGGAGGGAAG CAUCAAAGGGCC GAGAUGUCUCG (SEQ ID |
| sg32.7.37 spacer primer | CGGAGCGAGACATCTCGGCCCT TTGATGCTTCCCTCCGAAGAG (SEQ ID NO: 497) | NO: 505) |
| sg64 backbone fwd | GAAATTAATACGACTCACTATA GGTACTGGCGCCTTTATCTCAT TACTTTGAGAGCCATCACCAGC GACTATGTCGTATGGGTAAAGC GC (SEQ ID NO: 498) | GGUACUGGCGCC UUUAUCUCAUUA CUUUGAGAGCCA UCACCAGCGACU AUGUCGUAUGGG |

TABLE 12-continued

Sequences for generation of guide RNA

| Primer | Primer sequence | RNA product |
|---|---|---|
| sg64 backbone rev | CTTTGATGCTTCTTACGGACCGAAGTCCGTAAGCGCTTTACCCATACGACATAG (SEQ ID NO: 499) | UAAAGCGCUUACGGACUUCGGUCCGUAAGAAGCAUCAAAGGGCCGAGA |
| sg64.7.37 spacer primer | CGGAGCGAGACATCTCGGCCCTTTGATGCTTCTTACGGACCGAAG(SEQ ID NO: 500) | UGUCUCGCUCCG (SEQ ID NO: 506) |
| sg174 backbone fwd | GAAATTAATACGACTCACTATAACTGGCGCTTTTATCTGATTACTTTGAGAGCCATCACCAGCGACTATGTCGTAGTGGGTAAAGCT (SEQ ID NO: 501) | ACUGGCGCUUUUAUCUgAUUACUUUGAGAGCCAUCACCAGCGACUAUGUCGUAgUGGGUA |
| sg174 backbone rev | CTTTGATGCTCCCTCCGAAGAGGGAGCTTTACCCACTACGACATAGTCGC (SEQ ID NO: 502) | AAGCUCCCUCUUCGGAGGGAGCAUCAAAGGGCCGAGAUGUCUCGCUCC |
| sg174.7.37 spacer primer | CGGAGCGAGACATCTCGGCCCTTTGATGCTCCCTCC (SEQ ID NO: 503) | G (SEQ ID NO: 507) |

Example 7: RNP Assembly

Purified wild-type and RNP of CasX and single guide RNA (sgRNA) were either prepared immediately before experiments or prepared and snap-frozen in liquid nitrogen and stored at −80° C. for later use. To prepare the RNP complexes, the CasX protein was incubated with sgRNA at 1:1.2 molar ratio. Briefly, sgRNA was added to Buffer #1 (25 mM NaPi, 150 mM NaCl, 200 mM trehalose, 1 mM MgCl2), then the CasX was added to the sgRNA solution, slowly with swirling, and incubated at 37° C. for 10 min to form RNP complexes. RNP complexes were filtered before use through a 0.22 m Costar 8160 filters that were pre-wet with 200 μl Buffer #1. If needed, the RNP sample was concentrated with a 0.5 ml Ultra 100-Kd cutoff filter, (Millipore part #UFC510096), until the desired volume was obtained. Formation of competent RNP was assessed as described in Example 14.

Example 8: Assessing Binding Affinity to the Guide RNA

Purified wild-type and improved CasX will be incubated with synthetic single-guide RNA containing a 3' Cy7.5 moiety in low-salt buffer containing magnesium chloride as well as heparin to prevent non-specific binding and aggregation. The sgRNA will be maintained at a concentration of 10 pM, while the protein will be titrated from 1 pM to 100 pM in separate binding reactions. After allowing the reaction to come to equilibrium, the samples will be run through a vacuum manifold filter-binding assay with a nitrocellulose membrane and a positively charged nylon membrane, which bind protein and nucleic acid, respectively. The membranes will be imaged to identify guide RNA, and the fraction of bound vs unbound RNA will be determined by the amount of fluorescence on the nitrocellulose vs nylon membrane for each protein concentration to calculate the dissociation constant of the protein-sgRNA complex. The experiment will also be carried out with improved variants of the sgRNA to determine if these mutations also affect the affinity of the guide for the wild-type and mutant proteins. We will also perform electromobility shift assays to qualitatively compare to the filter-binding assay and confirm that soluble binding, rather than aggregation, is the primary contributor to protein-RNA association.

Example 9: Assessing Binding Affinity to the Target DNA

Purified wild-type and improved CasX will be complexed with single-guide RNA bearing a targeting sequence complementary to the target nucleic acid. The RNP complex will be incubated with double-stranded target DNA containing a PAM and the appropriate target nucleic acid sequence with a 5' Cy7.5 label on the target strand in low-salt buffer containing magnesium chloride as well as heparin to prevent non-specific binding and aggregation. The target DNA will be maintained at a concentration of 1 nM, while the RNP will be titrated from 1 pM to 100 pM in separate binding reactions. After allowing the reaction to come to equilibrium, the samples will be run on a native 5% polyacrylamide gel to separate bound and unbound target DNA. The gel will be imaged to identify mobility shifts of the target DNA, and the fraction of bound vs unbound DNA will be calculated for each protein concentration to determine the dissociation constant of the RNP-target DNA ternary complex.

Example 10: Editing of Gene Targets PCSK9, PMP22, TRAC, SOD1, B2M and HTT

The purpose of this study was to evaluate the ability of the CasX variant 119 and gNA variant 174 to edit nucleic acid sequences in six gene targets.

Materials and Methods

Spacers for all targets except B2M and SOD1 were designed in an unbiased manner based on PAM requirements (TTC or CTC) to target a desired locus of interest. Spacers targeting B2M and SOD1 had been previously identified within targeted exons via lentiviral spacer screens carried out for these genes. Designed spacers for the other targets were ordered from Integrated DNA Technologies (IDT) as single-stranded DNA (ssDNA) oligo pairs. ssDNA spacer pairs were annealed together and cloned via Golden Gate cloning into a base mammalian-expression plasmid construct that contains the following components: codon optimized Cas X 119 protein+NLS under an EF1A promoter, guide scaffold 174 under a U6 promoter, carbenicillin and puromycin resistance genes. Assembled products were transformed into chemically-competent *E. coli*, plated on Lb-Agar plates (LB: Teknova Cat #L9315, Agar: Quartzy Cat #214510) containing carbenicillin and incubated at 37° C. Individual colonies were picked and miniprepped using Qiagen Qiaprep spin Miniprep Kit (Qiagen Cat #27104) following the manufacturer's protocol. The resulting plasmids were sequenced through the guide scaffold region via Sanger sequencing (Quintara Biosciences) to ensure correct ligation.

HEK 293T cells were grown in Dulbecco's Modified Eagle Medium (DMEM; Corning Cellgro, #10-013-CV) supplemented with 10% fetal bovine serum (FBS; Seradigm, #1500-500), 100 Units/ml penicillin and 100 mg/ml streptomycin (100×-Pen-Strep; GIBCO #15140-122), sodium pyruvate (100×, Thermofisher #11360070), non-essential amino acids (100× Thermofisher #11140050), HEPES buffer (100× Thermofisher #15630080), and 2-mercaptoethanol (1000× Thermofisher #21985023). Cells were passed every 3-5 days using TryplE and maintained in an incubator at 37° C. and 5% CO2.

On day 0, HEK293T cells were seeded in 96-well, flat-bottom plates at 30 k cells/well. On day 1, cells were transfected with 100 ng plasmid DNA using Lipofectamine 3000 according to the manufacturer's protocol. On day 2, cells were switched to FB medium containing puromycin. On day 3, this media was replaced with fresh FB medium containing puromycin. The protocol after this point diverged depending on the gene of interest. Day 4 for PCSK9, PMP22, and TRAC: cells were verified to have completed selection and switched to FB medium without puromycin. Day 4 for B2M, SOD1, and HTT: cells were verified to have completed selection and passed 1:3 using TryplE into new plates containing FB medium without puromycin. Day 7 for PCSK9, PMP22, and TRAC: cells were lifted from the plate, washed in dPBS, counted, and resuspended in Quick Extract (Lucigen, QE09050) at 10,000 cells/μl. Genomic DNA was extracted according to the manufacturer's protocol and stored at −20° C. Day 7 for B2M, SOD1, and HTT: cells were lifted from the plate, washed in dPBS, and genomic DNA was extracted with the Quick-DNA Miniprep Plus Kit (Zymo, D4068) according to the manufacturer's protocol and stored at −20° C.

NGS Analysis: Editing in cells from each experimental sample was assayed using next generation sequencing (NGS) analysis. All PCRs were carried out using the KAPA HiFi HotStart ReadyMix PCR Kit (KR0370). The template for genomic DNA sample PCR was 5 μl of genomic DNA in QE at 10 k cells/μL for PCSK9, PMP22, and TRAC. The template for genomic DNA sample PCR was 400 ng of genomic DNA in water for B2M, SOD1, and HTT. Primers were designed specific to the target genomic location of interest to form a target amplicon. These primers contain additional sequence at the 5' ends to introduce Illumina read and 2 sequences. Further, they contain a 7 nt randomer sequence that functions as a unique molecular identifier (UMI). Quality and quantification of the amplicon was assessed using a Fragment Analyzer DNA analyzer kit (Agilent, dsDNA 35-1500 bp). Amplicons were sequenced on the Illumina Miseq according to the manufacturer's instructions. Resultant sequencing reads were aligned to a reference sequence and analyzed for indels. Samples with editing that did not align to the estimated cut location or with unexpected alleles in the spacer region were discarded.

Results

Figure 9:
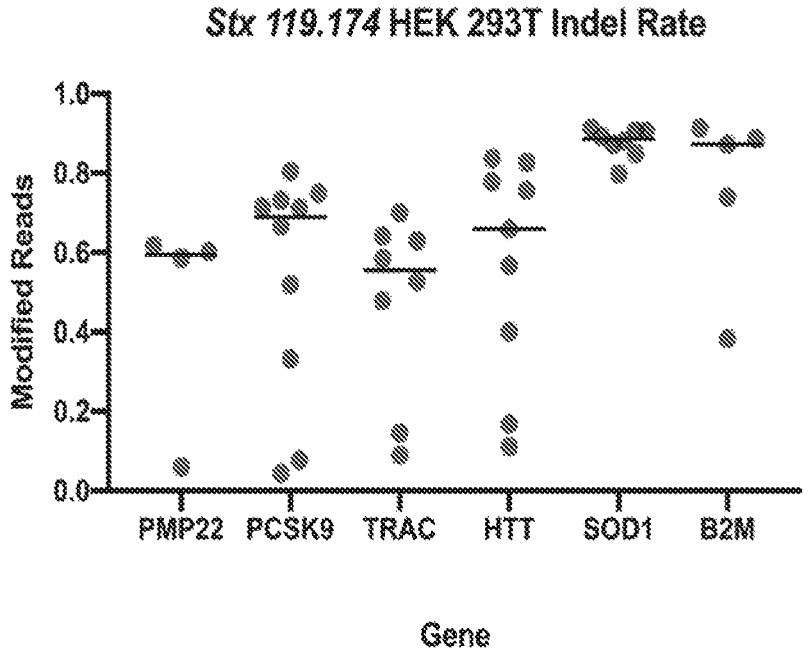
FIG. 9 shows the results of an editing assay of 6 target genes in HEK293T cells, as described in Example 10. Each dot represents results using an individual spacer.
Figure 10:
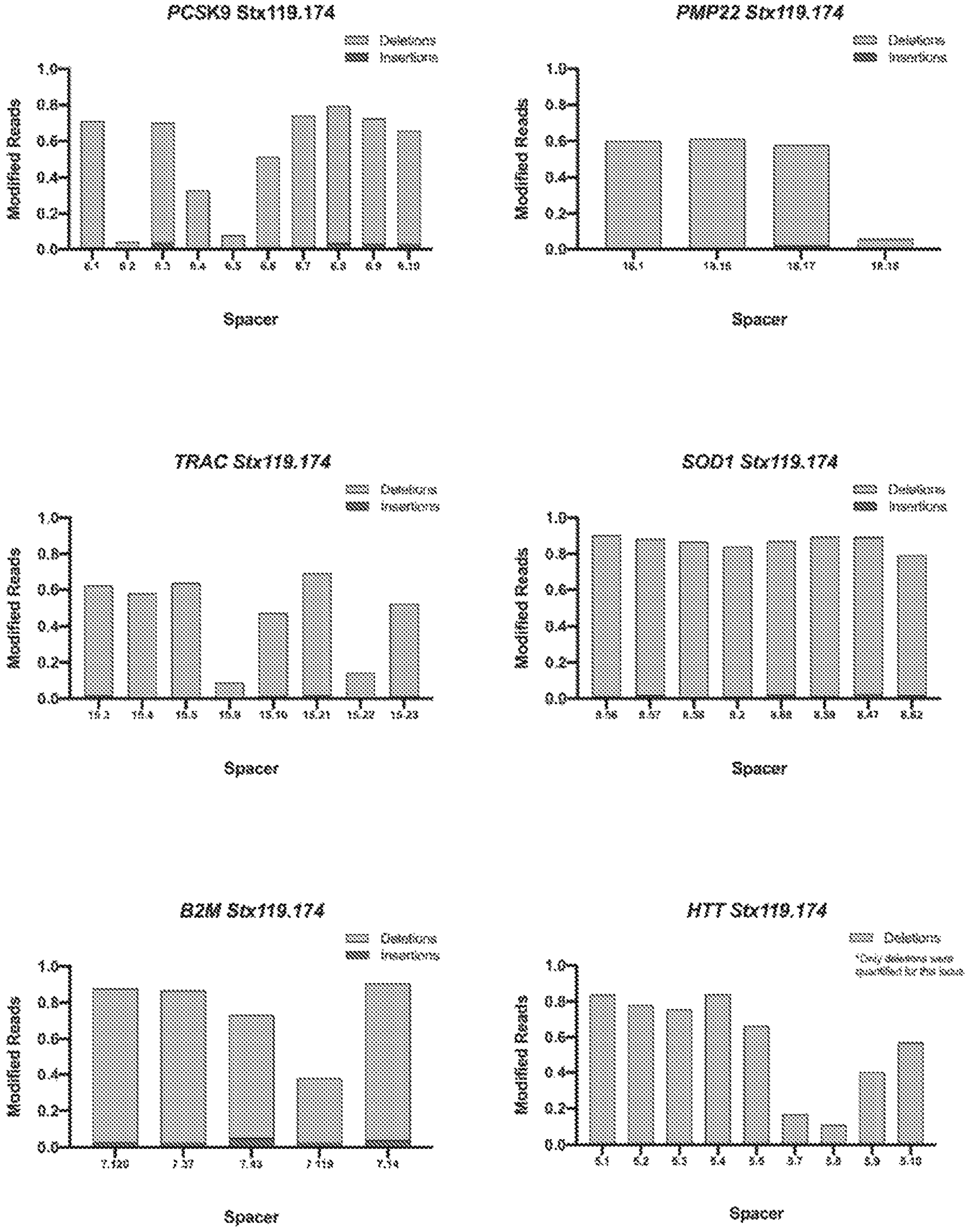
FIG. 10 shows the results of an editing assay of 6 target genes in HEK293T cells, with individual bars representing the results obtained with individual spacers, as described in Example 10.
Figure 11:
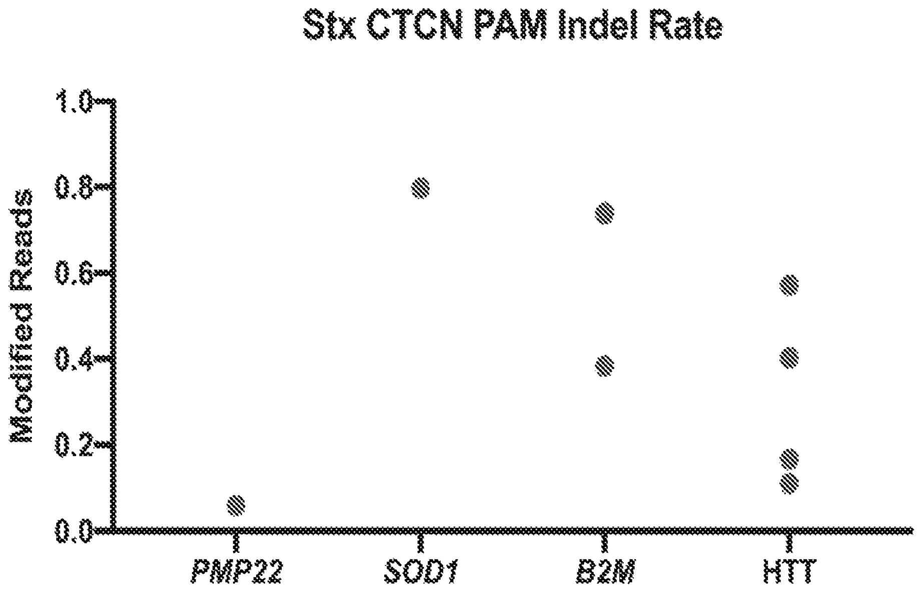
FIG. 11 shows the results of an editing assay of 4 target genes in HEK293T cells, as described in Example 10. Each dot represents results using an individual spacer utilizing a CTC PAM.

In order to validate the editing effected by the CasX:gNA 119.174 at a variety of genetic loci, a clonal plasmid transfection experiment was performed in HEK 293T cells. Multiple spacers (Table 13, listing the encoding DNA and the RNA sequences of the actual gNA spacers) were designed and cloned into an expression plasmid encoding the CasX 119 nuclease and guide 174 scaffold. HEK 293T cells were transfected with plasmid DNA, selected with puromycin, and harvested for genomic DNA six days post-transfection. Genomic DNA was analyzed via next generation sequencing (NGS) and aligned to a reference DNA sequence for analysis of insertions or deletions (indels). CasX:gNA 119.174 was able to efficiently generate indels across the 6 target genes, as shown in FIGS. 9 and 10. Indel rates varied between spacers, but median editing rates were consistently at 60% or higher, and in some cases, indel rates as high as 91% were observed. Additionally, spacers with non-canonical CTC PAMs were demonstrated to be able to generate indels with all tested target genes (FIG. 11).

The results demonstrate that the CasX variant 119 and gNA variant 174 can consistently and efficiently generate indels at a wide variety of genetic loci in human cells. The unbiased selection of many of the spacers used in the assays shows the overall effectiveness of the 119.174 RNP molecules to edit genetic loci, while the ability to target to spacers with both a TTC and a CTC PAM demonstrates its increased versatility compared to reference CasX that edit only with the TTC PAM.

TABLE 13

Spacer sequences targeting each genetic locus.

| Gene | Spacer | PAM | Spacer DNA Sequence | Spacer RNA Sequence |
|---|---|---|---|---|
| PCSK9 | 6.1 | TTC | GAGGAGGACGGCCTG GCCGA (SEQ ID NO: 508) | GAGGAGGACGGCCUGG CCGA (SEQ ID NO: 552) |
| PCSK9 | 6.2 | TTC | ACCGCTGCGCCAAGGT GCGG (SEQ ID NO: 509) | ACCGCUGCGCCAAGGU GCGG (SEQ ID NO: 553) |
| PCSK9 | 6.4 | TTC | GCCAGGCCGTCCTCCT CGGA (SEQ ID NO: 510) | GCCAGGCCGUCCUCCU CGGA (SEQ ID NO: 554) |
| PCSK9 | 6.5 | TTC | GTGCTCGGGTGCTTCG GCCA (SEQ ID NO: 511) | GUGCUCGGGUGCUUCG GCCA (SEQ ID NO: 555) |
| PCSK9 | 6.3 | TTC | ATGGCCTTCTTCCTGG CTTC (SEQ ID NO: 512) | AUGGCCUUCUUCCUGG CUUC (SEQ ID NO: 556) |
| PCSK9 | 6.6 | TTC | GCACCACCACGTAGGT GCCA (SEQ ID NO: 513) | GCACCACCACGUAGGU GCCA (SEQ ID NO: 557) |
| PCSK9 | 6.7 | TTC | TCCTGGCTTCCTGGTG AAGA (SEQ ID NO: 514) | UCCUGGCUUCCUGGUG AAGA (SEQ ID NO: 558) |
| PCSK9 | 6.8 | TTC | TGGCTTCCTGGTGAAG ATGA (SEQ ID NO: 515) | UGGCUUCCUGGUGAAG AUGA (SEQ ID NO: 559) |
| PCSK9 | 6.9 | TTC | CCAGGAAGCCAGGAA GAAGG (SEQ ID NO: 516) | CCAGGAAGCCAGGAAG AAGG (SEQ ID NO: 560) |
| PCSK9 | 6.10 | TTC | TCCTTGCATGGGGCCA GGAT (SEQ ID NO: 517) | UCCUUGCAUGGGGCCA GGAU (SEQ ID NO: 561) |
| PMP22 | 18.16 | TTC | GGCGGCAAGTTCTGCT CAGC (SEQ ID NO: 518) | GGCGGCAAGUUCUGCU CAGC (SEQ ID NO: 562) |
| PMP22 | 18.17 | TTC | TCTCCACGATCGTCAG CGTG (SEQ ID NO: 519) | UCUCCACGAUCGUCAG CGUG (SEQ ID NO: 563) |
| PMP22 | 18.18 | CTC | ACGATCGTCAGCGTGA GTGC (SEQ ID NO: 520) | ACGAUCGUCAGCGUGA GUGC (SEQ ID NO: 564) |
| PMP22 | 18.1 | TTC | CTCTAGCAATGGATCG TGGG (SEQ ID NO: 521) | CUCUAGCAAUGGAUCG UGGG (SEQ ID NO: 565) |
| TRAC | 15.3 | TTC | CAAACAAATGTGTCAC AAAG (SEQ ID NO: 522) | CAAACAAAUGUGUCAC AAAG (SEQ ID NO: 566) |

TABLE 13-continued

Spacer sequences targeting each genetic locus.

| Gene | Spacer | PAM | Spacer DNA Sequence | Spacer RNA Sequence |
|---|---|---|---|---|
| TRAC | 15.4 | TTC | GATGTGTATATCACAGACAA (SEQ ID NO: 523) | GAUGUGUAUAUCACAGACAA (SEQ ID NO: 567) |
| TRAC | 15.5 | TTC | GGAATAATGCTGTTGTTGAA (SEQ ID NO: 524) | GGAAUAAUGCUGUUGUUGAA (SEQ ID NO: 568) |
| TRAC | 15.9 | TTC | AAATCCAGTGACAAGTCTGT (SEQ ID NO: 525) | AAAUCCAGUGACAAGUCUGU (SEQ ID NO: 569) |
| TRAC | 15.10 | TTC | AGGCCACAGCACTGTTGCTC (SEQ ID NO: 526) | AGGCCACAGCACUGUUGCUC (SEQ ID NO: 570) |
| TRAC | 15.21 | TTC | AGAAGACACCTTCTTCCCCA (SEQ ID NO: 527) | AGAAGACACCUUCUUCCCCA (SEQ ID NO: 571) |
| TRAC | 15.22 | TTC | TCCCCAGCCCAGGTAAGGGC (SEQ ID NO: 528) | UCCCCAGCCCAGGUAAGGGC (SEQ ID NO: 572) |
| TRAC | 15.23 | TTC | CCAGCCCAGGTAAGGGCAGC (SEQ ID NO: 529) | CCAGCCCAGGUAAGGGCAGC (SEQ ID NO: 573) |
| HTT | 5.1 | TTC | AGTCCCTCAAGTCCTTCCAG (SEQ ID NO: 530) | AGUCCCUCAAGUCCUUCCAG (SEQ ID NO: 574) |
| HTT | 5.2 | TTC | AGCAGCAGCAGCAGCAGCAG (SEQ ID NO: 531) | AGCAGCAGCAGCAGCAGCAG (SEQ ID NO: 575) |
| HTT | 5.3 | TTC | TCAGCCGCCGCCGCAGGCAC (SEQ ID NO: 532) | UCAGCCGCCGCCGCAGGCAC (SEQ ID NO: 576) |
| HTT | 5.4 | TTC | AGGGTCGCCATGGCGGTCTC (SEQ ID NO: 533) | AGGGUCGCCAUGGCGGUCUC (SEQ ID NO: 577) |
| HTT | 5.5 | TTC | TCAGCTTTTCCAGGGTCGCC (SEQ ID NO: 534) | UCAGCUUUUCCAGGGUCGCC (SEQ ID NO: 578) |
| HTT | 5.7 | CTC | GCCGCAGCCGCCCCCGCCGC (SEQ ID NO: 535) | GCCGCAGCCGCCCCCGCCGC (SEQ ID NO: 579) |
| HTT | 5.8 | CTC | GCCACAGCCGGGCCGGGTGG (SEQ ID NO: 536) | GCCACAGCCGGGCCGGGUGG (SEQ ID NO: 580) |
| HTT | 5.9 | CTC | TCAGCCACAGCCGGGCCGGG (SEQ ID NO: 537) | UCAGCCACAGCCGGGCCGGG (SEQ ID NO: 581) |
| HTT | 5.10 | CTC | CGGTCGGTGCAGCGGCTCCT (SEQ ID NO: 538) | CGGUCGGUGCAGCGGCUCCU (SEQ ID NO: 582) |
| SOD1 | 8.56 | TTC | CCACACCTTCACTGGTCCAT (SEQ ID NO: 539) | CCACACCUUCACUGGUCCAU (SEQ ID NO: 583) |
| SOD1 | 8.57 | TTC | TAAAGGAAAGTAATGGACCA (SEQ ID NO: 540) | UAAAGGAAAGUAAUGGACCA (SEQ ID NO: 584) |
| SOD1 | 8.58 | TTC | CTGGTCCATTACTTTCCTTT (SEQ ID NO: 541) | CUGGUCCAUUACUUUCCUUU (SEQ ID NO: 585) |
| SOD1 | 8.2 | TTC | ATGTTCATGAGTTTGGAGAT (SEQ ID NO: 542) | AUGUUCAUGAGUUUGGAGAU (SEQ ID NO: 586) |
| SOD1 | 8.68 | TTC | TGAGTTTGGAGATAATACAG (SEQ ID NO: 543) | UGAGUUUGGAGAUAAUACAG (SEQ ID NO: 587) |
| SOD1 | 8.59 | TTC | ATAGACACATCGGCCACACC (SEQ ID NO: 544) | AUAGACACAUCGGCCACACC (SEQ ID NO: 588) |
| SOD1 | 8.47 | TTC | TTATTAGGCATGTTGGAGAC (SEQ ID NO: 545) | UUAUUAGGCAUGUUGGAGAC (SEQ ID NO: 589) |
| SOD1 | 8.62 | CTC | CAGGAGACCATTGCATCATT (SEQ ID NO: 546) | CAGGAGACCAUUGCAUCAUU (SEQ ID NO: 590) |
| B2M | 7.120 | TTC | GGCCTGGAGGCTATCCAGCG (SEQ ID NO: 547) | GGCCUGGAGGCUAUCCAGCG (SEQ ID NO: 591) |
| B2M | 7.37 | TTC | GGCCGAGATGTCTCGCTCCG (SEQ ID NO: 548) | GGCCGAGAUGUCUCGCUCCG (SEQ ID NO: 592) |
| B2M | 7.43 | CTC | AGGCCAGAAAGAGAGAGTAG (SEQ ID NO: 549) | AGGCCAGAAAGAGAGAGUAG (SEQ ID NO: 593) |
| B2M | 7.119 | CTC | CGCTGGATAGCCTCCAGGCC (SEQ ID NO: 550) | CGCUGGAUAGCCUCCAGGCC (SEQ ID NO: 594) |
| B2M | 7.14 | TTC | TGAAGCTGACAGCATTCGGG (SEQ ID NO: 551) | UGAAGCUGACAGCAUUCGGG (SEQ ID NO: 595) |

Example 11: Assessing Differential PAM Recognition In Vitro

Purified wild-type and engineered CasX variants will be complexed with single-guide RNA bearing a fixed targeting sequence. The RNP complexes will be added to buffer containing MgCl2 at a final concentration of 100 nM and incubated with 5' Cy7.5-labeled double-stranded target DNA at a concentration of 10 nM. Separate reactions will be carried out with different DNA substrates containing different PANMs adjacent to the target nucleic acid sequence. Aliquots of the reactions will be taken at fixed time points and quenched by the addition of an equal volume of 50 mM EDTA and 9500 formamide. The samples will be run on a denaturing polyacrylamide gel to separate cleaved and uncleaved DNA substrates. The results will be visualized and the rate of cleavage of the non-canonical PAMs by the CasX variants will be determined.

Example 12: Assessing Nuclease Activity for Double-Strand Cleavage

Purified wild-type and engineered CasX variants will be complexed with single-guide RNA bearing a fixed PM22 targeting sequence. The RNP complexes will be added to buffer containing $MgCl_2$ at a final concentration of 100 nM and incubated with double-stranded target DNA with a 5' Cy7.5 label on either the target or non-target strand at a concentration of 10 nM. Aliquots of the reactions will be taken at fixed time points and quenched by the addition of an equal volume of 50 mM EDTA and 95% formamide. The samples will be run on a denaturing polyacrylamide gel to separate cleaved and uncleaved DNA substrates. The results will be visualized and the cleavage rates of the target and non-target strands by the wild-type and engineered variants will be determined. To more clearly differentiate between changes to target binding vs the rate of catalysis of the nucleolytic reaction itself, the protein concentration will be titrated over a range from 10 nM to 1 uM and cleavage rates will be determined at each concentration to generate a pseudo-Michaelis-Menten fit and determine the kcat* and KM*. Changes to KM* are indicative of altered binding, while changes to kcat* are indicative of altered catalysis.

Example 13: Assessing Target Strand Loading for Cleavage

Purified wild-type and engineered CasX 119 will be complexed with single-guide RNA bearing a fixed PM22 targeting sequence. The RNP complexes will be added to buffer containing MgCl2 at a final concentration of 100 nM and incubated with double-stranded target DNA with a 5' Cy7.5 label on the target strand and a 5' Cy5 label on the non-target strand at a concentration of 10 nM. Aliquots of the reactions will be taken at fixed time points and quenched by the addition of an equal volume of 50 mM EDTA and 95% formamide. The samples will be run on a denaturing polyacrylamide gel to separate cleaved and uncleaved DNA substrates. The results will be visualized and the cleavage rates of both strands by the variants will be determined. Changes to the rate of target strand cleavage but not non-target strand cleavage would be indicative of improvements to the loading of the target strand in the active site for cleavage. This activity could be further isolated by repeating the assay with a dsDNA substrate that has a gap on the non-target strand, mimicking a pre-cleaved substrate. Improved cleavage of the non-target strand in this context would give further evidence that the loading and cleavage of the target strand, rather Example 14: CasX:gNA In Vitro Cleavage Assays 1. Determining Cleavage-Competent Fractions for Protein Variants Compared to Wild-Type Reference CasX The ability of CasX variants to form active RNP compared to reference CasX was determined using an in vitro cleavage assay. The beta-2 microglobulin (B2M) 7.37 target for the cleavage assay was created as follows. DNA oligos with the sequence TGAAGCTGACAGCATTCGGGCCGAGATGTCTCGCTCCGTGGCCTTAGCTGTGCTC GCGCT (non-target strand, NTS (SEQ ID NO: 596)) and TGAAGCTGACAGCATTCGGGCCGAGATGTCTCGCTCCGTGGCCTTAGCTGTGCTC GCGCT (target strand, TS (SEQ ID NO: 597)) were purchased with 5' fluorescent labels (LI-COR IRDye 700 and 800, respectively). dsDNA targets were formed by mixing the oligos in a 1:1 ratio in 1× cleavage buffer (20 mM Tris HCl pH 7.5, 150 mM NaCl, 1 mM TCEP, 5% glycerol, 10 mM $MgCl_2$), heating to 95° C. for 10 minutes, and allowing the solution to cool to room temperature.

CasX RNPs were reconstituted with the indicated CasX and guides (see graphs) at a final concentration of 1 μM with 1.5-fold excess of the indicated guide unless otherwise specified in 1× cleavage buffer (20 mM Tris HCl pH 7.5, 150 mM NaCl, 1 mM TCEP, 5% glycerol, 10 mM $MgCl_2$) at 37° C. for 10 min before being moved to ice until ready to use. The 7.37 target was used, along with sgRNAs having spacers complementary to the 7.37 target.

Figure 12:
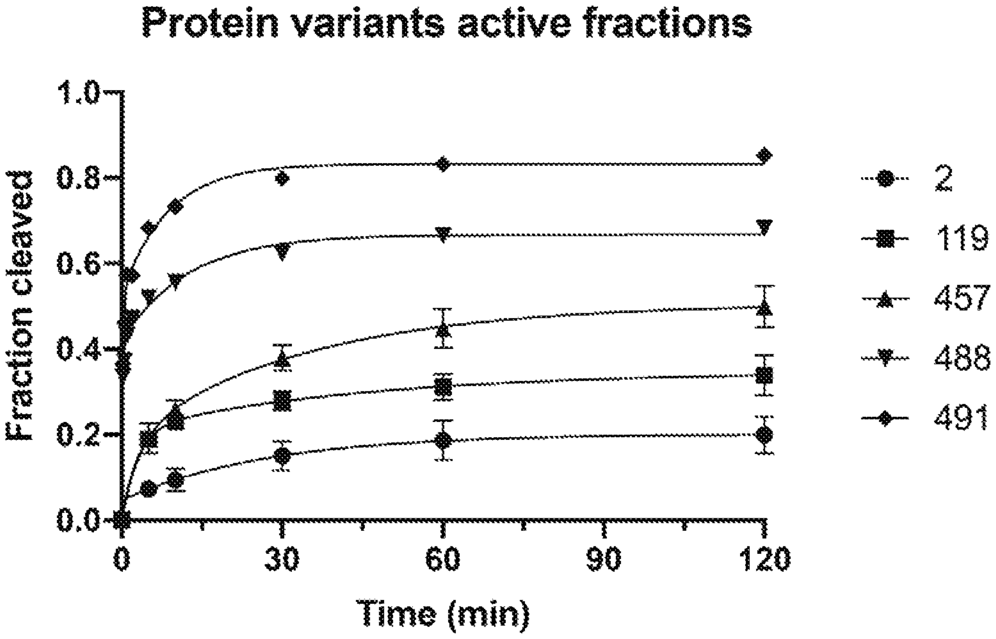
FIG. 12 is a graph of the results of an assay for the quantification of active fractions of RNP formed by sgRNA174 and the CasX variants, as described in Example 14. Equimolar amounts of RNP and target were co-incubated and the amount of cleaved target was determined at the indicated timepoints. Mean and standard deviation of three independent replicates are shown for each timepoint. The biphasic fit of the combined replicates is shown. "2" refers to the reference CasX protein of SEQ ID NO:2.

Cleavage reactions were prepared with final RNP concentrations of 100 nM and a final target concentration of 100 nM. Reactions were carried out at 37° C. and initiated by the addition of the 7.37 target DNA. Aliquots were taken at 5, 10, 30, 60, and 120 minutes and quenched by adding to 95% formamide, 20 mM EDTA. Samples were denatured by heating at 95° C. for 10 minutes and run on a 10% urea-PAGE gel. The gels were either imaged with a LI-COR Odyssey CLx and quantified using the LI-COR Image Studio software or imaged with a Cytiva Typhoon and quantified using the Cytiva IQTL software. The resulting data were plotted and analyzed using Prism. We assumed that CasX acts essentially as a single-turnover enzyme under the assayed conditions, as indicated by the observation that sub-stoichiometric amounts of enzyme fail to cleave a greater-than-stoichiometric amount of target even under extended time-scales and instead approach a plateau that scales with the amount of enzyme present. Thus, the fraction of target cleaved over long time-scales by an equimolar amount of RNP is indicative of what fraction of the RNP is properly formed and active for cleavage. The cleavage traces were fit with a biphasic rate model, as the cleavage reaction clearly deviates from monophasic under this concentration regime, and the plateau was determined for each of three independent replicates. The mean and standard deviation were calculated to determine the active fraction (Table 14). The graphs are shown in FIG. 12.

Apparent active (competent) fractions were determined for RNPs formed for CasX2+guide 174+7.37 spacer, CasX119+guide 174+7.37 spacer, CasX457+guide 174+7.37 spacer, CasX488+guide 174+7.37 spacer, and CasX491+guide 174+7.37 spacer. The determined active fractions are shown in Table 14. All CasX variants had higher active fractions than the wild-type CasX2, indicating that the engineered CasX variants form significantly more active and stable RNP with the identical guide under tested conditions compared to wild-type CasX. This may be due to an increased affinity for the sgRNA, increased stability or solubility in the presence of sgRNA, or greater stability of a cleavage-competent conformation of the engineered CasX:sgRNA complex. An increase in solubility of the RNP was indicated by a notable decrease in the observed precipitate formed when CasX457, CasX488, or CasX491 was added to the sgRNA compared to CasX2.

Figure 13:
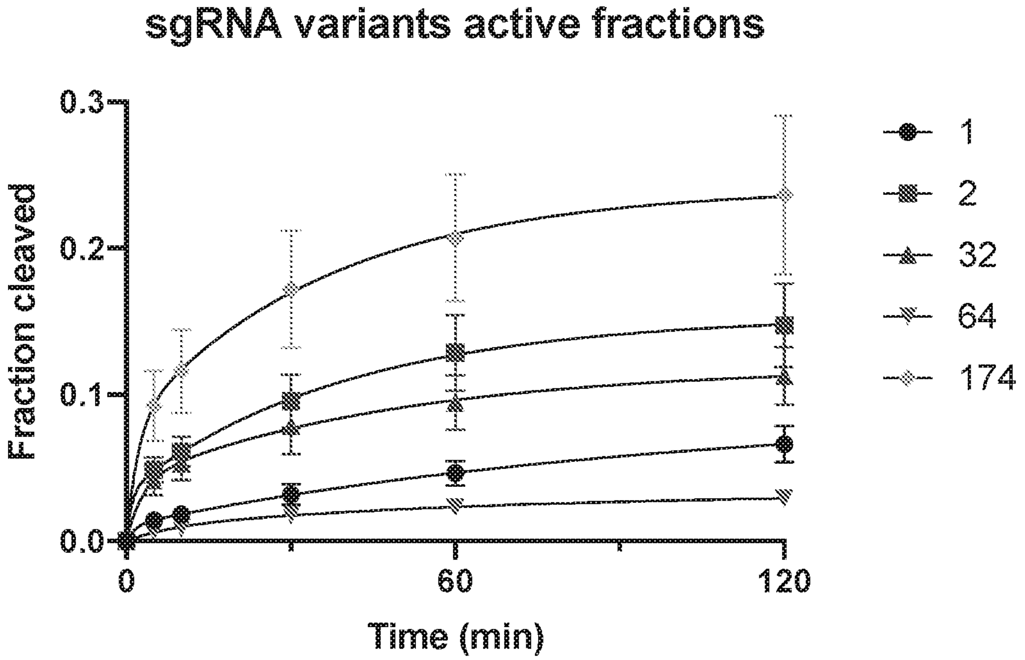
FIG. 13 shows the quantification of active fractions of RNP formed by CasX2 and the modified sgRNAs, as described in Example 14. Equimolar amounts of RNP and target were co-incubated and the amount of cleaved target was determined at the indicated timepoints. Mean and standard deviation of three independent replicates are shown for each timepoint. The biphasic fit of the combined replicates is shown.

2. In Vitro Cleavage Assays—Determining $k_{cleave}$ for CasX Variants Compared to Wild-Type Reference CasX Cleavage-competent fractions were also determined using the same protocol for CasX2.2.7.37, CasX2.32.7.37, CasX2.64.7.37, and CasX2.174.7.37 to be 16±3%, 13±3%, 5±2%, and 22±5%, as shown in FIG. 13 and Table 14.

Figure 14:
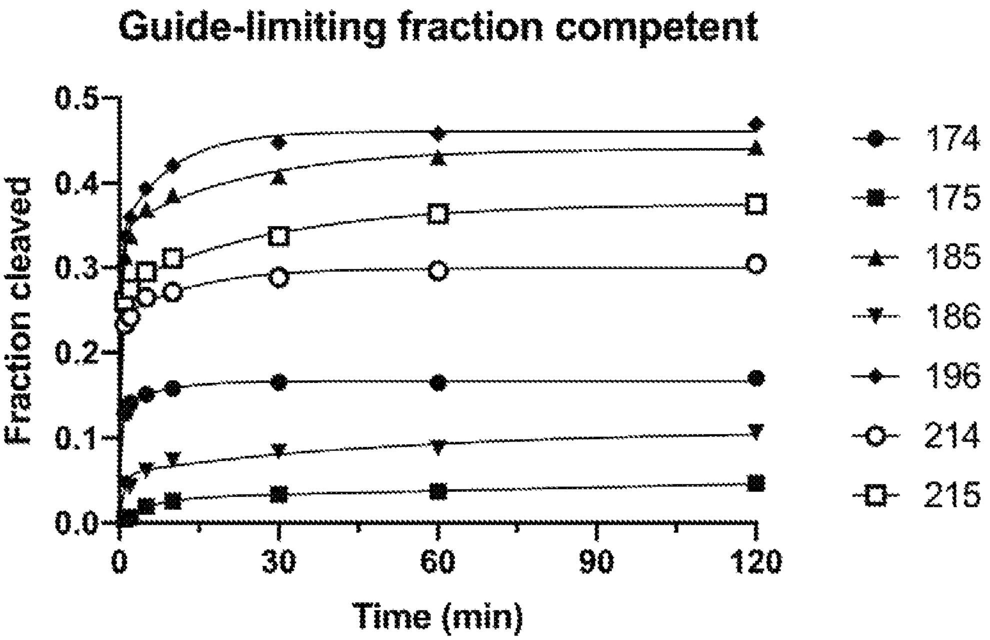
FIG. 14 shows the quantification of active fractions of RNP formed by CasX 491 and the modified sgRNAs under guide-limiting conditions, as described in Example 14. Equimolar amounts of RNP and target were co-incubated and the amount of cleaved target was determined at the indicated timepoints. The biphasic fit of the data is shown.

A second set of guides were tested under different conditions to better isolate the contribution of the guide to RNP formation. 174, 175, 185, 186, 196, 214, and 215 guides with 7.37 spacer were mixed with CasX491 at final concentrations of 1 μM for the guide and 1.5 μM for the protein, rather than with excess guide as before. Results are shown in FIG. 14 and Table 14. Many of these guides exhibited additional improvement over 174, with 185 and 196 achieving 44% and 46% competent fractions, respectively, compared with 17% for 174 under these guide-limiting conditions.

The data indicate that both CasX variants and sgRNA variants are able to form a higher degree of active RNP with guide RNA compare to wild-type CasX and wild-type sgRNA.

The apparent cleavage rates of CasX variants 119, 457, 488, and 491 compared to wild-type reference CasX were determined using an in vitro fluorescent assay for cleavage of the target 7.37.

CasX RNPs were reconstituted with the indicated CasX (see FIG. 15) at a final concentration of 1 μM with 1.5-fold excess of the indicated guide in 1× cleavage buffer (20 mM Tris HCl pH 7.5, 150 mM NaCl, 1 mM TCEP, 5% glycerol, 10 mM $MgCl_2$) at 37° C. for 10 min before being moved to ice until ready to use. Cleavage reactions were set up with a final RNP concentration of 200 nM and a final target concentration of 10 nM. Reactions were carried out at 37° C. except where otherwise noted and initiated by the addition of the target DNA. Aliquots were taken at 0.25, 0.5, 1, 2, 5, and 10 minutes and quenched by adding to 95% formamide, 20 mM EDTA. Samples were denatured by heating at 95° C. for 10 minutes and run on a 10% urea-PAGE gel. The gels were imaged with a LI-COR Odyssey CLx and quantified using the LI-COR Image Studio software or imaged with a Cytiva Typhoon and quantified using the Cytiva IQTL software. The resulting data were plotted and analyzed using Prism, and the apparent first-order rate constant of non-target strand cleavage ($k_{cleave}$) was determined for each CasX:sgRNA combination replicate individually. The mean and standard deviation of three replicates with independent fits are presented in Table 14, and the cleavage traces are shown in FIG. 15.

Figure 15:
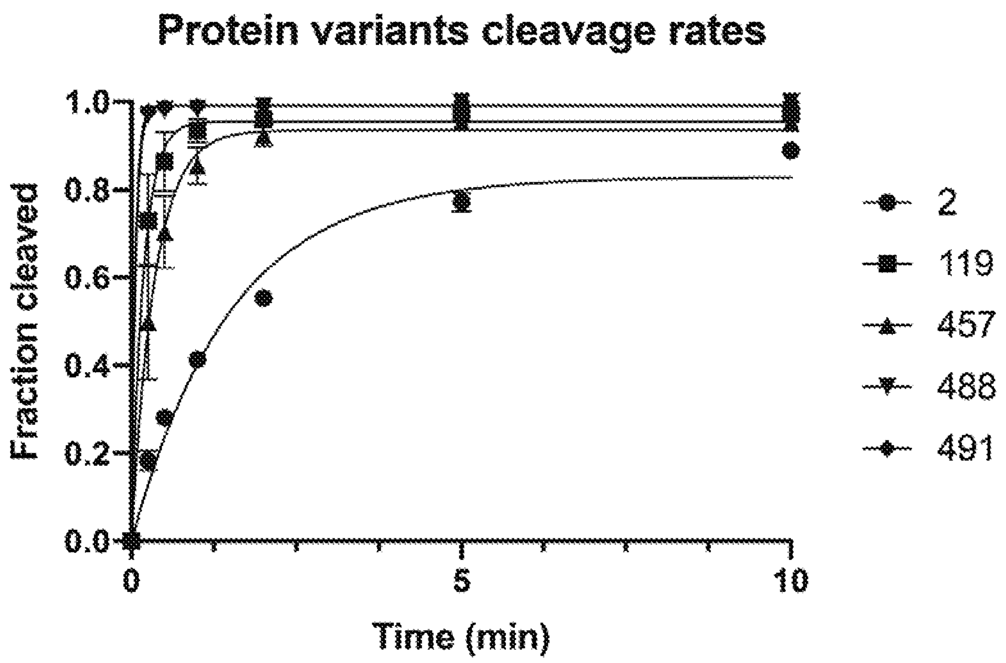
FIG. 15 shows the quantification of cleavage rates of RNP formed by sgRNA174 and the CasX variants, as described in Example 14. Target DNA was incubated with a 20-fold excess of the indicated RNP and the amount of cleaved target was determined at the indicated time points. Mean and standard deviation of three independent replicates are shown for each timepoint, except for 488 and 491 where a single replicate is shown. The monophasic fit of the combined replicates is shown.

Apparent cleavage rate constants were determined for wild-type CasX2, and CasX variants 119, 457, 488, and 491 with guide 174 and spacer 7.37 utilized in each assay (see Table 14 and FIG. 15). All CasX variants had improved cleavage rates relative to the wild-type CasX2. CasX457 cleaved more slowly than 119, despite having a higher competent fraction as determined above. CasX488 and CasX491 had the highest cleavage rates by a large margin; as the target was almost entirely cleaved in the first time-point, the true cleavage rate exceeds the resolution of this assay, and the reported $k_{cleave}$ should be taken as a lower bound.

The data indicate that the CasX variants have a higher level of activity, with $k_{cleave}$ rates reaching at least 30-fold higher compared to wild-type CasX2.

3. In Vitro Cleavage Assays: Comparison of Guide Variants to Wild-Type Guides

Cleavage assays were also performed with wild-type reference CasX2 and reference guide 2 compared to guide variants 32, 64, and 174 to determine whether the variants improved cleavage. The experiments were performed as described above. As many of the resulting RNPs did not approach full cleavage of the target in the time tested, we determined initial reaction velocities ($V_0$) rather than first-order rate constants. The first two timepoints (15 and 30 seconds) were fit with a line for each CasX:sgRNA combination and replicate. The mean and standard deviation of the slope for three replicates were determined.

Figure 16:
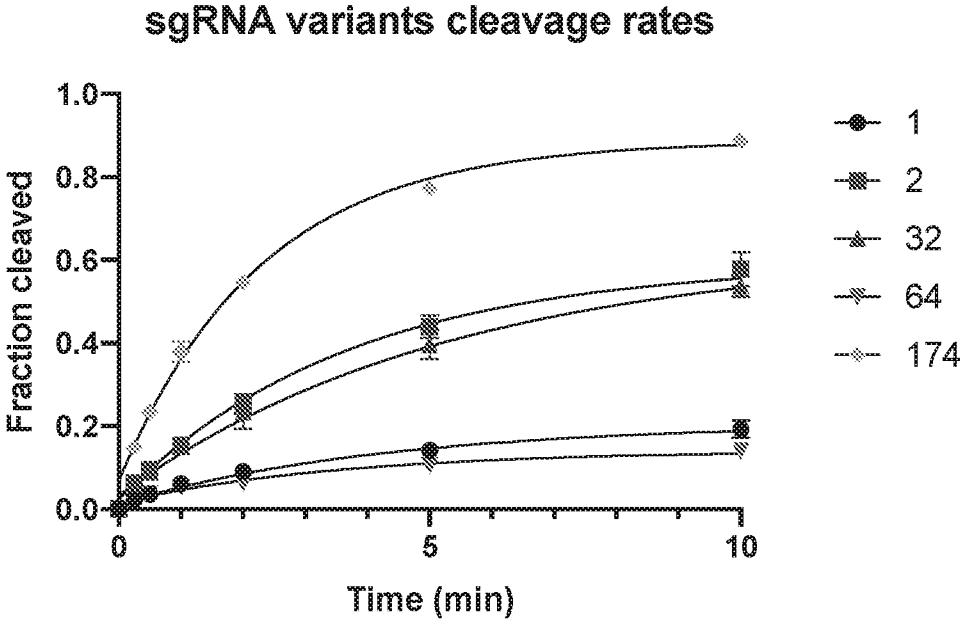
FIG. 16 shows the quantification of cleavage rates of RNP formed by CasX2 and the sgRNA variants, as described in Example 14. Target DNA was incubated with a 20-fold excess of the indicated RNP and the amount of cleaved target was determined at the indicated time points. Mean and standard deviation of three independent replicates are shown for each timepoint. The monophasic fit of the combined replicates is shown.
Figure 17:
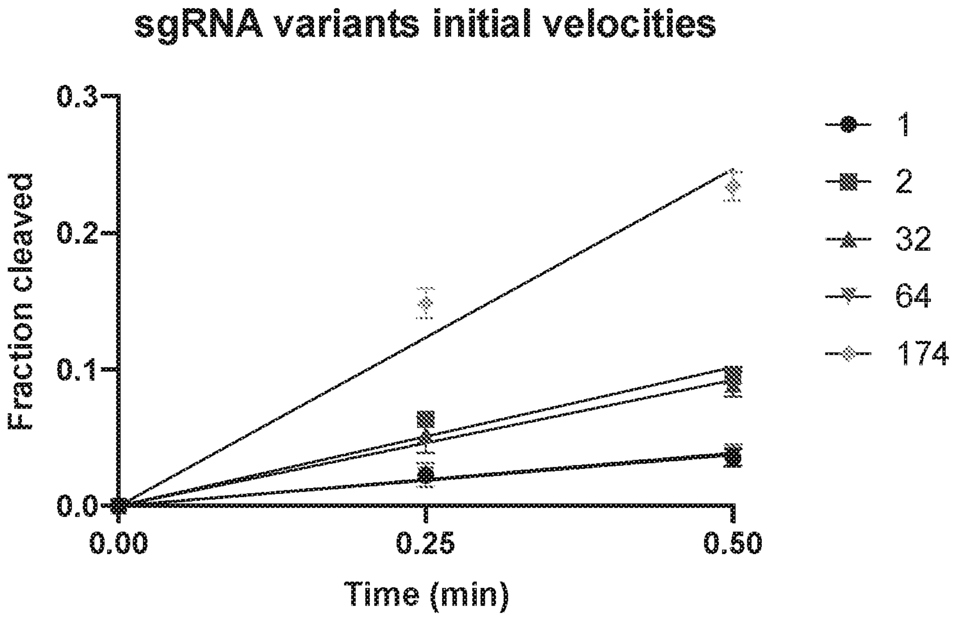
FIG. 17 shows the quantification of initial velocities of RNP formed by CasX2 and the sgRNA variants, as described in Example 14. The first two time-points of the previous cleavage experiment were fit with a linear model to determine the initial cleavage velocity.

Under the assayed conditions, the $V_0$ for CasX2 with guides 2, 32, 64, and 174 were 20.4±1.4 nM/min, 18.4±2.4 nM/min, 7.8±1.8 nM/min, and 49.3±1.4 nM/min (see Table 14 and FIG. 16 and FIG. 17). Guide 174 showed substantial improvement in the cleavage rate of the resulting RNP (~2.5-fold relative to 2, see FIG. 17), while guides 32 and 64 performed similar to or worse than guide 2. Notably, guide 64 supports a cleavage rate lower than that of guide 2 but performs much better in vivo (data not shown). Some of the sequence alterations to generate guide 64 likely improve in vivo transcription at the cost of a nucleotide involved in triplex formation. Improved expression of guide 64 likely explains its improved activity in vivo, while its reduced stability may lead to improper folding in vitro.

Figure 18:
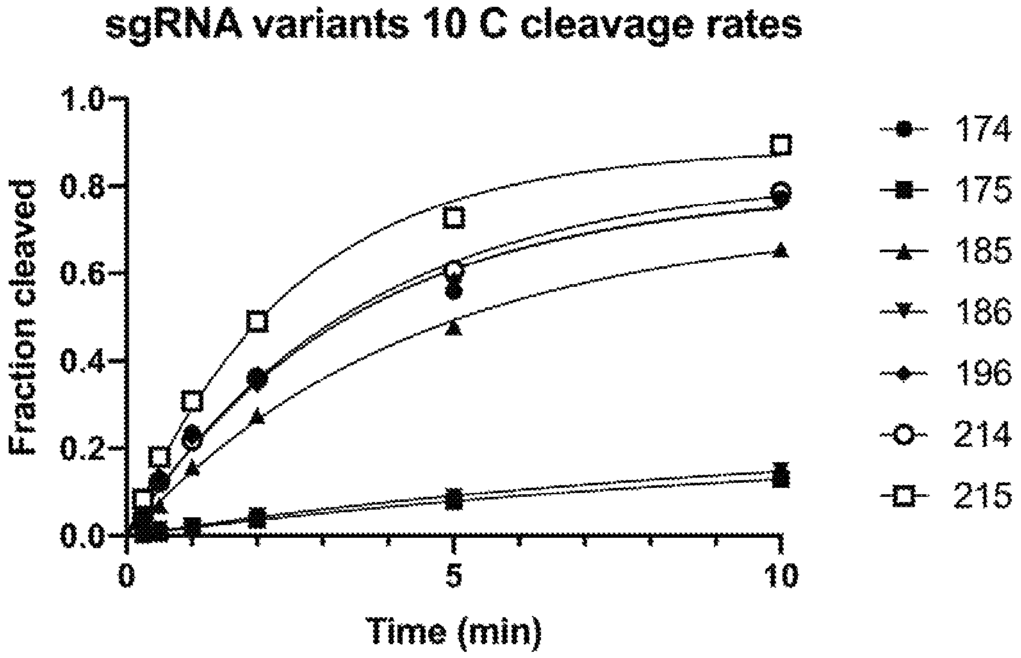
FIG. 18 shows the quantification of cleavage rates of RNP formed by CasX491 and the sgRNA variants, as described in Example 14. Target DNA was incubated with a 20-fold excess of the indicated RNP at 10° C. and the amount of cleaved target was determined at the indicated time points. The monophasic fit of the timepoints is shown.

Additional experiments were carried out with guides 174, 175, 185, 186, 196, 214, and 215 with spacer 7.37 and CasX491 to determine relative cleavage rates. To reduce cleavage kinetics to a range measurable with our assay, the cleavage reactions were incubated at 10° C. Results are in FIG. 18 and Table 14. Under these conditions, 215 was the only guide that supported a faster cleavage rate than 174. 196, which exhibited the highest active fraction of RNP under guide-limiting conditions, had kinetics essentially the same as 174, again highlighting that different variants result in improvements of distinct characteristics.

The data support that, under the conditions of the assay, use of the majority of the guide variants with CasX results in RNP with a higher level of activity than one with the wild-type guide, with improvements in initial cleavage velocity ranging from ~2-fold to >6-fold. Numbers in Table 14 indicate, from left to right, CasX variant, sgRNA scaffold, and spacer sequence of the RNP construct.

TABLE 14

Results of cleavage and RNP formation assays

| RNP Construct | $k_{cleave}$* | Initial velocity* | Competent fraction |
|---|---|---|---|
| 2.2.7.37 | | 20.4 ± 1.4 nM/min | 16 ± 3% |
| 2.32.7.37 | | 18.4 ± 2.4 nM/min | 13 ± 3% |
| 2.64.7.37 | | 7.8 ± 1.8 nM/min | 5 ± 2% |
| 2.174.7.37 | 0.51 ± 0.01 $min^{-1}$ | 49.3 ± 1.4 nM/min | 22 ± 5% |
| 119.174.7.37 | 6.29 ± 2.11 $min^{-1}$ | | 35 ± 6% |
| 457.174.7.37 | 3.01 ± 0.90 $min^{-1}$ | | 53 ± 7% |
| 488.174.7.37 | 15.19 $min^{-1}$ | | 67% |
| 491.174.7.37 | 16.59 $min^{-1}$/0.293 $min^{-1}$ (10° C) | | 83%/17% (guide-limited) |
| 491.175.7.37 | 0.089 $min^{-1}$ (10° C) | | 5% (guide-limited) |
| 491.185.7.37 | 0.227 $min^{-1}$ (10° C) | | 44% (guide-limited) |
| 491.186.7.37 | 0.099 $min^{-1}$ (10° C) | | 11% (guide-limited) |
| 491.196.7.37 | 0.292 $min^{-1}$ (10° C) | | 46% (guide-limited) |
| 491.214.7.37 | 0.284 $min^{-1}$ (10° C) | | 30% (guide-limited) |
| 491.215.7.37 | 0.398 $min^{-1}$ (10° C) | | 38% (guide-limited) |

*Mean and standard deviation

Example 15: Identification of Nicking Variants

Purified modified CasX variants will be complexed with single-guide RNA bearing a fixed targeting sequence. The RNP complexes will be added to buffer containing $MgCl_2$ at a final concentration of 100 nM and incubated with double-stranded target DNA with a 5' fluorescein label on the target strand and a 5' Cy5 label on the non-target strand at a concentration of 10 nM. Aliquots of the reactions will be taken at fixed time points and quenched by the addition of an equal volume of 50 mM EDTA and 95% formamide. The samples will be run on a denaturing polyacrylamide gel to separate cleaved and uncleaved DNA substrates. Efficient cleavage of one strand but not the other would be indicative that the variant possessed single-strand nickase activity.

Example 16: Assessing Improved Expression and Solubility Characteristics of CasX Variants for RNP Production Wild-type and modified CasX variants will be expressed in BL21 (DE3) *E. coli* under identical conditions. All proteins will be under the control of an IPTG-inducible T7 promoter. Cells will be grown to an OD of 0.6 in TB media at 37° C., at which point the growth temperature will be reduced to 16° C. and expression will be induced by the addition of 0.5 mM IPTG. Cells will be harvested following 18 hours of expression. Soluble protein fractions will be extracted and analyzed on an SDS-PAGE gel. The relative levels of soluble CasX expression will be identified by Coomassie staining. The proteins will be purified in parallel according to the protocol above, and final yields of pure protein will be compared. To determine the solubility of the purified protein, the constructs will be concentrated in storage buffer until the protein begins to precipitate. Precipitated protein will be removed by centrifugation and the final concentration of soluble protein will be measured to determine the maximum solubility for each variant. Finally, the CasX variants will be complexed with single guide RNA and concentrated until precipitation begins. Precipitated RNP will be removed by centrifugation and the final concentration of soluble RNP will be measured to determine the maximum solubility of each variant when bound to guide RNA.

Example 17: Assays Used to Measure sgNA and CasX Protein Activity

Several assays were used to carry out initial screens of CasX protein and sgNA Deep Mutational Evolution (DME) libraries and modified mutants, and to measure the activity of select protein and sgNA variants relative to CasX reference sgNAs and proteins. *E. coli* CRISPRi screen:

Briefly, biological triplicates of dead CasX DME Libraries on a chloramphenicol (CM) resistant plasmid with a GFP gNA on a carbenicillin (Carb) resistant plasmid were transformed (at >5× library size) into MG1655 with genetically integrated and constitutively expressed GFP and RFP. Cells were grown overnight in EZ-RDM+Carb, CM and Anhydrotetracycline (aTc) inducer. *E. coli* were FACS sorted based on gates for the top 1% of GFP but not RFP repression, collected, and resorted immediately to further enrich for highly functional CasX molecules. Double sorted libraries were then grown out and DNA was collected for deep sequencing on a highseq. This DNA was also re-transformed onto plates and individual clones were picked for further analysis.

*E. coli* Toxin Selection:

Briefly carbenicillin resistant plasmid containing an arabinose inducible toxin were transformed into *E. coli* cells and made electrocompetent. Biological triplicates of CasX DME Libraries with a toxin targeted gNA on a chloramphenicol resistant plasmid were transformed (at >5× library size) into said cells and grown in LB+CM and arabinose inducer. *E. coli* that cleaved the toxin plasmid survived in the induction media and were grown to mid log and plasmids with functional CasX cleavers were recovered. This selection was repeated as needed. Selected libraries were then grown out and DNA was collected for deep sequencing on a highseq. This DNA was also re-transformed onto plates and individual clones were picked for further analysis and testing.

Figure 19:
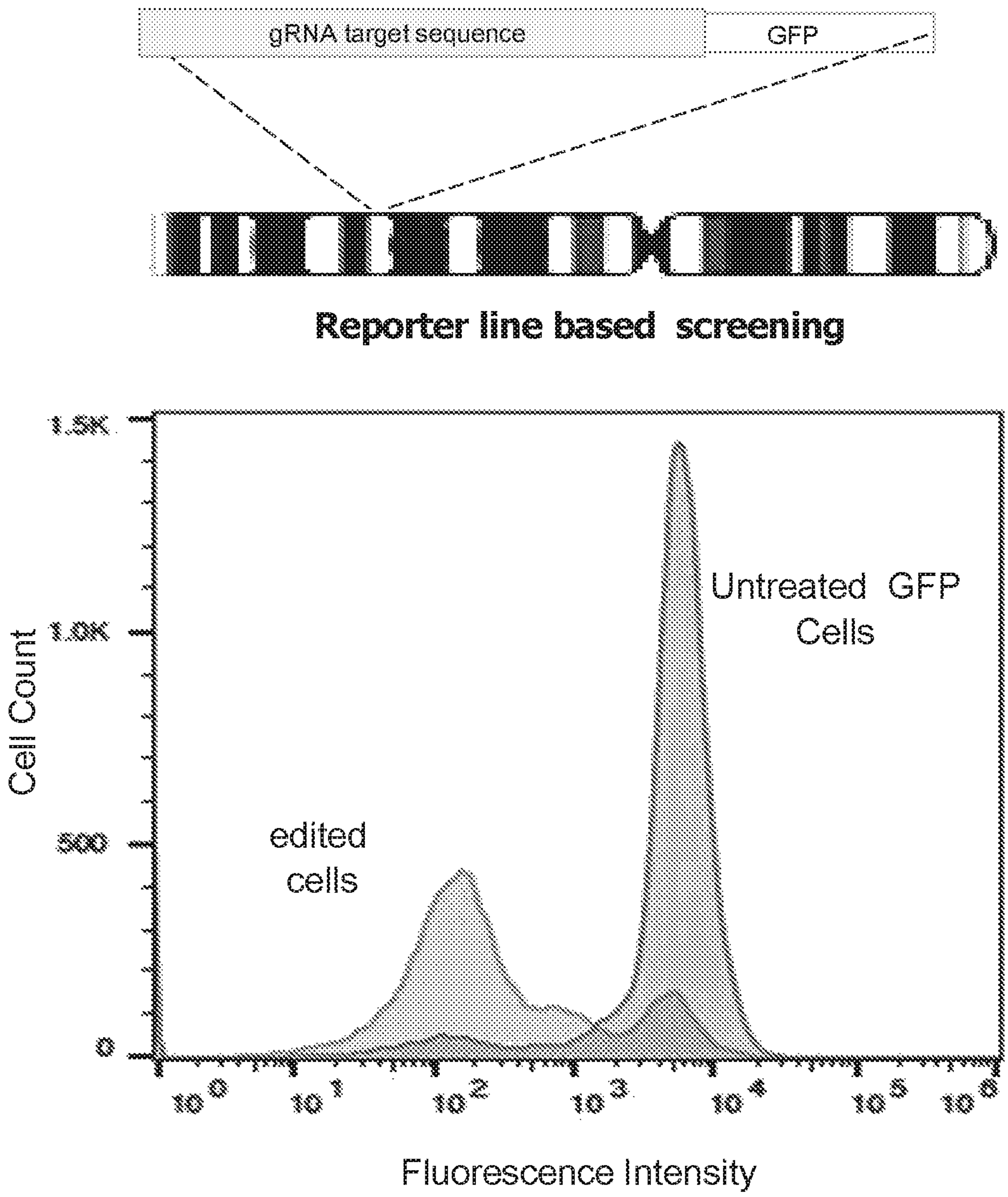
FIG. 19 is a diagram and an example fluorescence activated cell sorting (FACS) plot illustrating an exemplary method for assaying the effectiveness of a reference CasX protein or single guide RNA (sgRNA), or variants thereof, as described in Example 17. A reporter (e.g., GFP reporter) coupled to a gRNA target sequence, complementary to the gRNA spacer, is integrated into a reporter cell line. Cells are transformed or transfected with a CasX protein and/or sgRNA variant, with the spacer motif of the sgRNA complementary to and targeting the gRNA target sequence of the reporter. Ability of the CasX:sgRNA ribonucleoprotein complex to cleave the target sequence is assayed by FACS. Cells that lose reporter expression indicate occurrence of CasX: sgRNA ribonucleoprotein complex-mediated cleavage and indel formation.

Lentiviral Based Screen EGFP Screen:

Lentiviral particles were produced in HEK293 cells at a confluency of 70%-90% at time of transfection. Cells were transfected using polyethylenimine based transfection of plasmids containing a CasX DME library. Lentiviral vectors were co-transfected with the lentiviral packaging plasmid and the VSV-G envelope plasmids for particle production. Media was changed 12 hours post-transfection, and virus harvested at 36-48 hours post-transfection. Viral supernatants were filtered using 0.45 mm membrane filters, diluted in cell culture media if appropriate, and added to target cells HEK cells with an Integrated GFP reporter. Polybrene was supplemented to enhance transduction efficiency, if necessary. Transduced cells were selected for 24-48 hours post-transduction using puromycin and grown for 7-10 days. Cells were then sorted for GFP disruption & collected for highly functional CasX sgNA or protein variants (see FIG. 19). Libraries were then Amplified via PCR directly from the genome and collected for deep sequencing on a highseq. This DNA could also be re-cloned and re-transformed onto plates and individual clones were picked for further analysis.

Example 18: Assaying Editing Efficiency of an HEK EGFP Reporter

To assay the editing efficiency of CasX reference sgNAs and proteins and variants thereof, EGFP HEK293T reporter cells were seeded into 96-well plates and transfected according to the manufacturer's protocol with lipofectamine 3000 (Life Technologies) and 100-200 ng plasmid DNA encoding a reference or CasX variant protein, P2A-puromycin fusion and the reference or variant sgNA. The next day cells were selected with 1.5 μg/ml puromycin for 2 days and analyzed by fluorescence-activated cell sorting (FACS) 7 days after selection to allow for clearance of EGFP protein from the cells. EGFP disruption via editing was traced using an Attune NxT Flow Cytometer and high-throughput autosampler.

Example 19: Cleavage Efficiency of CasX Reference sgRNA

The reference CasX sgRNA of SEQ ID NO:4 (below) is described in WO 2018064371 and U.S. Ser. No. 10/570,415B2, the contents of which are incorporated herein by reference:

(SEQ ID NO: 4)

ACAUCUGGCGCGUUUAUUCCAUUACUUUGGAGCCAGUCCCAGCGACUAUG

UCGUAUGGACGAAGCGCUUAUUUAUCGGAGAGAAACCGAUAAGUAAAACG

CAUCAAAG.

It was found that alterations to the sgRNA reference sequence of SEQ ID NO:4, producing SEQ ID NO:5 (below) were able to improve CasX cleavage efficiency. The sequence is:

(SEQ ID NO: 5)
UACUGGCGCUUUUAUCUCAUUACUUUGAGAGCCAUCACCAGCGACUAUGU

CGUAUGGGUAAAGCGCUUAUUUAUCGGAGAGAAAUCCGAUAAAUAAGAAG

CAUCAAAG.

To assay the editing efficiency of CasX reference sgRNAs and variants thereof, EGFP HEK293T reporter cells were seeded into 96-well plates and transfected according to the manufacturer's protocol with lipofectamine 3000 (Life Technologies) and 100-200 ng plasmid DNA encoding a reference CasX protein, P2A-puromycin fusion and the sgRNA. The next day cells were selected with 1.5 μg/ml puromycin for 2 days and analyzed by fluorescence-activated cell sorting (FACS) 7 days after selection to allow for clearance of EGFP protein from the cells. EGFP disruption via editing was traced using an Attune NxT Flow Cytometer and high-throughput autosampler.

When testing cleavage of an EGFP reporter by CasX reference and sgNA variants, the following spacer target sequences were used:

E6 (TGTGGTCGGGGTAGCGGCTG (SEQ ID NO: 17))
and

E7 (TCAAGTCCGCCATGCCCGAA (SEQ ID NO: 18)).

Figure 20:
FIG. 20 shows results of gene editing in an EGFP disruption assay, as described in Example 19. Editing was measured by indel formation and GFP disruption in HEK293 cells carrying a GFP reporter.

An example of the increased cleavage efficiency of the sgRNA of SEQ ID NO:5 compared to the sgRNA of SEQ ID NO:4 is shown in FIG. 20. Editing efficiency of SEQ ID NO: 5 was improved 176% compared to SEQ ID NO: 4. Accordingly, SEQ ID NO: 5 was chosen as reference sgRNA for DME and additional sgNA variant design, described below.

Example 20: Design, Creation and Evaluation of gNA Variants with Improved Target Cleavage Guide nucleic acid (gNA) variants were designed and tested in order to assess improvements in cleavage activity relative to reference gNAs. These guides were discovered via DME or rational design and replacement or addition of guide parts such as the extended stem or the addition of ribozymes at the termini, as described herein.

Experimental design: All guides were tested In HEK293T or a HEK293T reporter line as follows. Mammalian cells were maintained in a 37° C. incubator, at 5% CO2. HEK293T Human kidney cells and derivatives thereof were grown in Dulbecco's Modified Eagle Medium (DMEM; Corning Cellgro, #10-013-CV) supplemented with 10% fetal bovine serum (FBS; Seradigm, #1500-500), and 100 Units/ml penicillin and 100 mg/ml streptomycin (100×-Pen-Strep; GIBCO #15140-122), and can additionally include sodium pyruvate (100×, Thermofisher #11360070), Non-essential amino acids (100× Thermofisher #11140050), HEPES buffer (100× Thermofisher #15630080), and 2-mercaptoethanol (1000× Thermofisher #21985023). Cells were seeded at 20-30 thousand cells per well into 96-well plates and transfected using 0.25-1 uL of Lipofectamine 3000 (Thermo Fisher Scientific #L3000008), 50-500 ng of a plasmid containing CasX and the reference or variant CasX guide targeting the reporter or target gene following the manufacturer's protocol. 24-72 hours later the media was changed and 0.3-3.0 ug/ml puromycin (Sigma #P8833) was added to select for transformation. 24-96 hours following selection the cells were analyzed by flow cytometry and gated for the appropriate forward and side scatter, selected for single cells and then gated for green fluorescent protein (GFP) or antibody reporter expression (Attune Nxt Flow Cytometer, Thermo Fisher Scientific) to quantify the expression levels of fluorophores. At least 10,000 events were collected for each sample. For the HEK293T-GFP genome editing reporter cell line, flow cytometry was used to quantify the percentage of GFP-negative (edited) cells and the number of cells with GFP disruption for each variant was compared to the reference guide to generate a fold change measurement.

Figure 21:
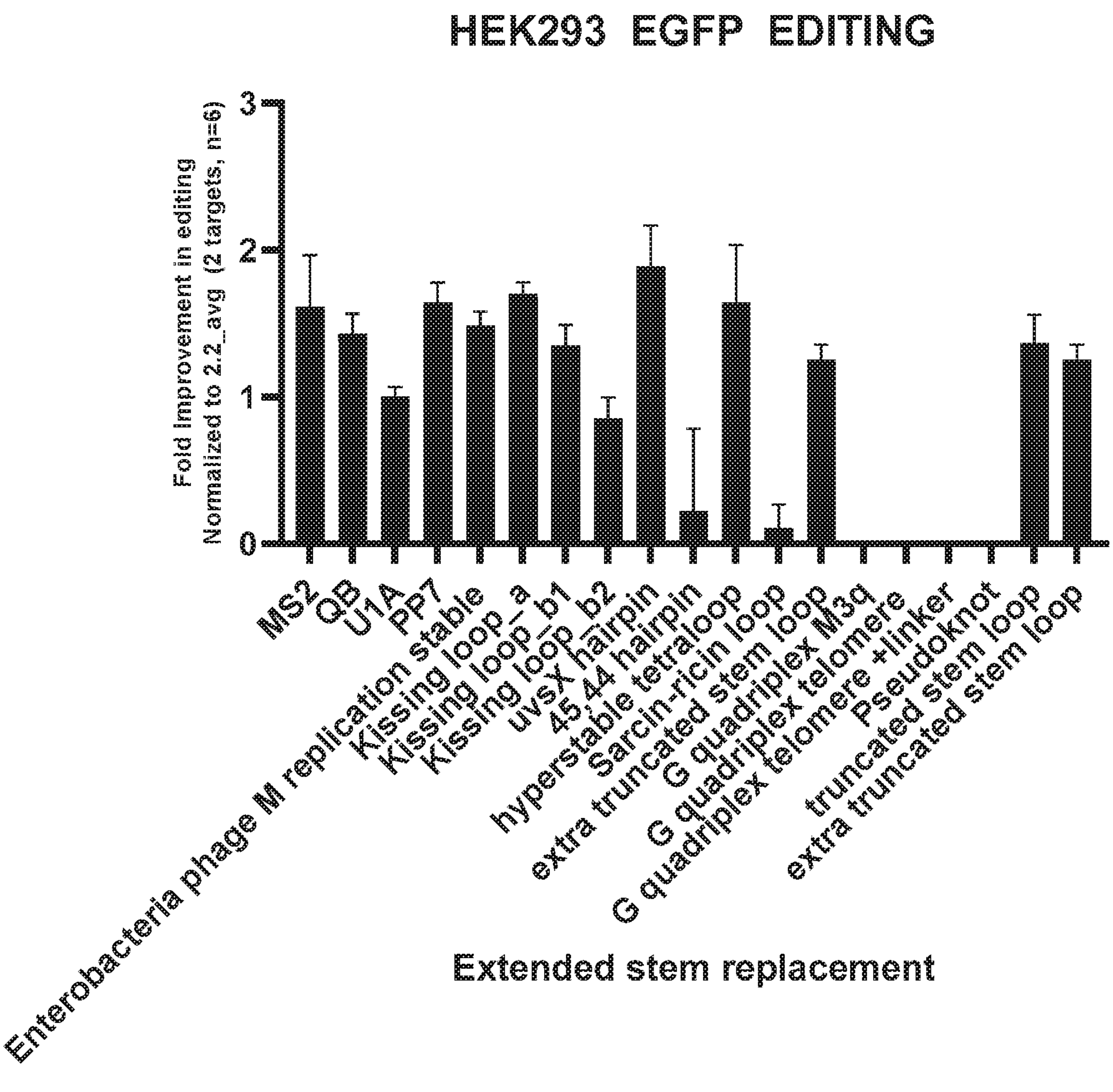
FIG. 21 shows results of gene editing in an EGFP disruption assay where further editing improvements were obtained in the sgRNA scaffold of SEQ ID NO:5 by swapping the extended stem loop sequence (indicated in the X-axis) for additional sequences to generate the scaffolds whose sequences are shown in Table 2, as described in Example 20.
Figure 22:
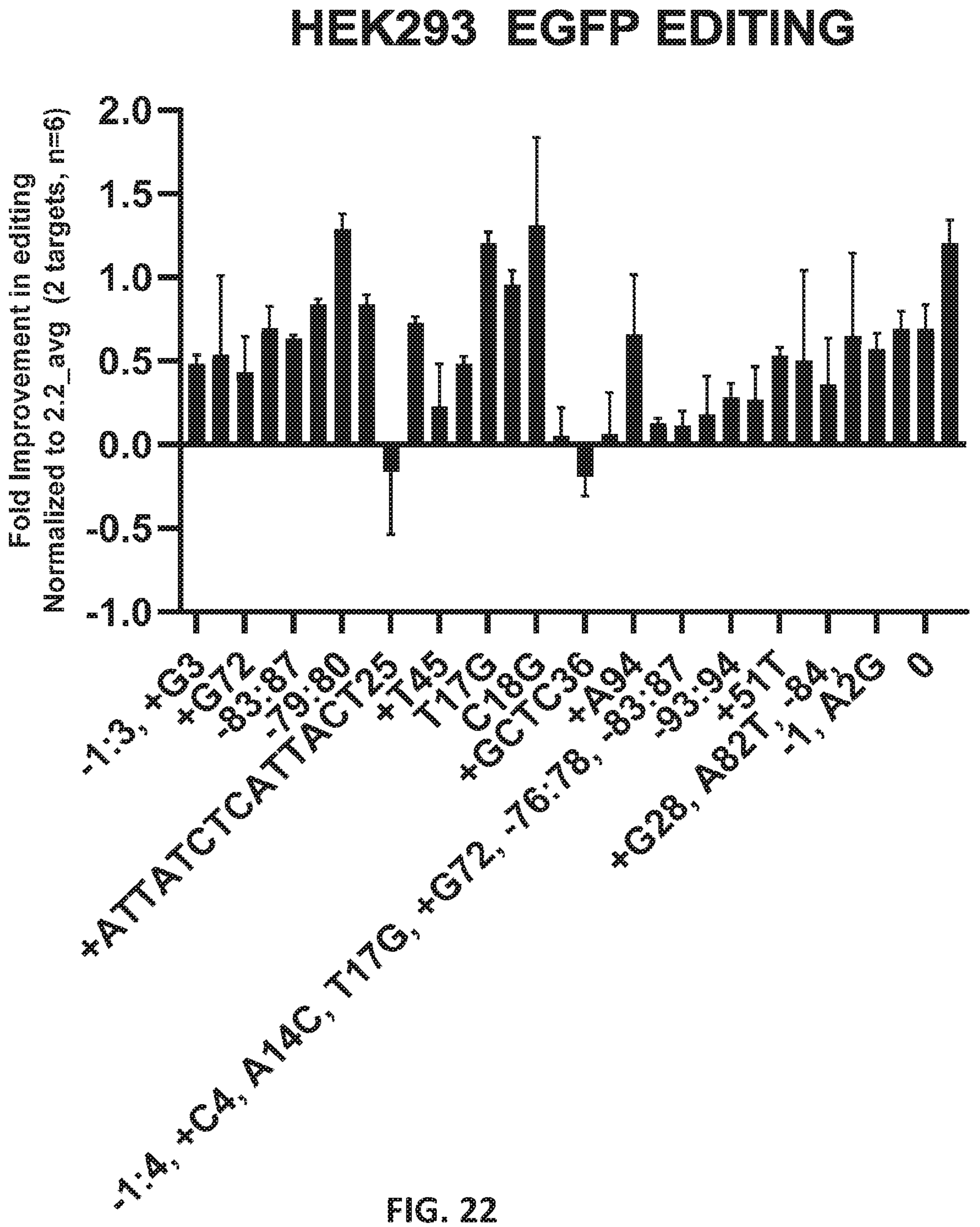
FIG. 22 is a graph showing the fold improvement of sgRNA variants generated by DME mutations normalized to SEQ ID NO:5 as the CasX reference sgRNA, as described in Example 20.
Figure 23:
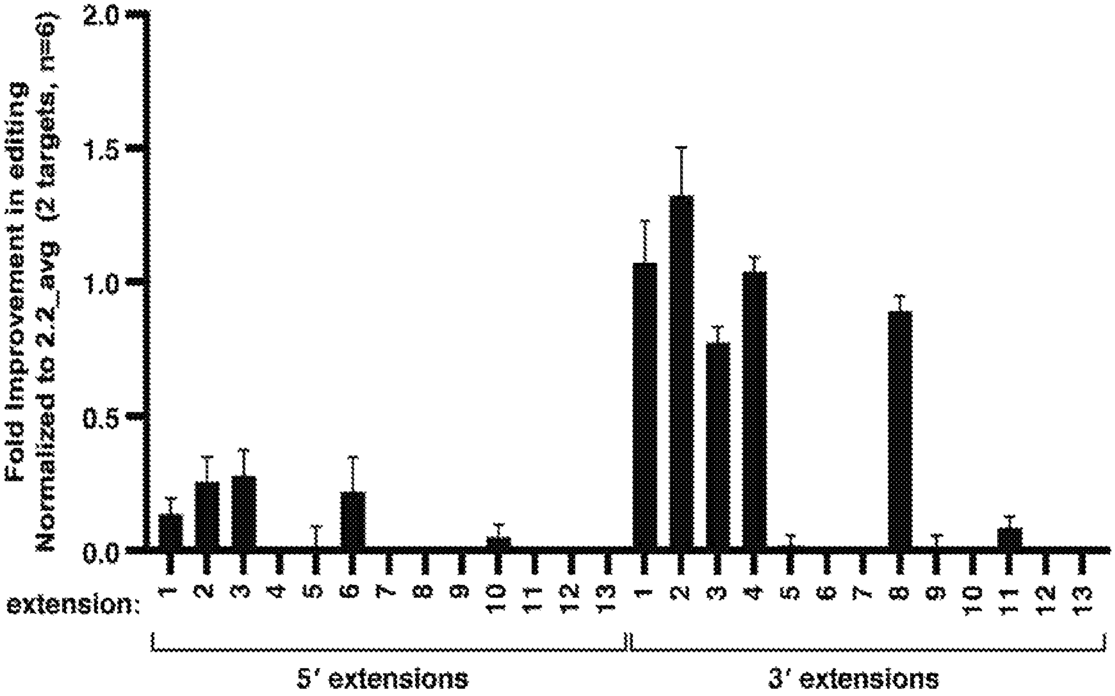
FIG. 23 is a graph showing the fold improvement normalized to the SEQ ID NO:5 reference CasX sgRNA of variants created by both combining (stacking) scaffold stem mutations showing improved cleavage, DME mutations showing improved cleavage, and using ribozyme appendages showing improved cleavage (the appendages and their sequences are listed in Table 15 in Example 20). The resulting sgRNA variants yield 2-fold or greater improvement in cleavage compared to SEQ ID NO:5 in this assay. EGFP editing assays were performed with spacer target sequences of E6 (TGTGGTCGGGGTAGCGGCTG (SEQ ID NO: 17)) and E7 (TCAAGTCCGCCATGCCCGAA (SEQ ID NO: 18)) described in Example 19.

Results: Results from the sgNA variants generated via DME were measured and compared to the reference gNA of SEQ ID NO: 4 are presented in FIG. 22, with most variants showing improvements from 0.1 to nearly 1.5-fold compared to the reference gNA. Results of the variants generated via rational design and replacement or addition of guide parts (such as the extended stem or the addition of ribozymes at the termini) are shown in FIGS. 21 and 23 respectively; again showing improvements with many of the constructs. The additions to the variants, along with their encoding sequences, portrayed by number in FIG. 23 are listed in Table 15, below. We observed that single mutations such as the C18G improve guide activity when compared to the reference. Additionally, rationally swapping in different stem loops for the extended stem loop, such as MS2, QB, PP7, UvsX, etc. improved activity when compared to the reference guide, as does truncating the original extended stem loop. Finally, we demonstrate that while most ribozymes disrupt activity, the addition of a 3' HDV to the reference guide RNA can improve activity up to 20-50%.

TABLE 15

Extensions added to 3' and 5" ends of gNA

| Extension Number | Extension Name | Extension Encoding Sequence |
|---|---|---|
| 1 | HDV antigenomic ribozyme | GGGTCGGCATGGCATCTCCACCTCCTCG CGGTCCGACCTGGGCATCCGAAGGAGGA CGCACGTCCACTCGGATGGCTAAGGGAG AGCCA (SEQ ID NO: 598) |
| 2 | HDV genomic ribozyme | GGCCGGCATGGTCCCAGCCTCCTCGCTG GCGCCGGCTGGGCAACATTCCGAGGGGA CCGTCCCCTCGGTAATGGCGAATGGGAC CC (SEQ ID NO: 599) |
| 3 | HDV ribozyme (v1) | GATGGCCGGCATGGTCCCAGCCTCCTCG CTGGCGCCGGCTGGGCAACACCTTCGGG TGGCGAATGGGAC (SEQ ID NO: 600) |
| 4 | HDV ribozyme (v2) | TTTTGGCCGGCATGGTCCCAGCCTCCTC GCTGGCGCCGGCTGGGCAACATGCTTCG GCATGGCGAATGGGACCCCGGG (SEQ ID NO: 601) |
| 5 | Hatchet | CATTCCTCAGAAAATGACAAACCTGTGG GGCGTAAGTAGATCTTCGGATCTATGAT CGTGCAGACGTTAAAATCAGGT (SEQ ID NO: 602) |
| 6 | env25 pistol ribozyme (with CUUCGG loop) | CGTGGTTAGGGCCACGTTAAATAGTTGC TTAAGCCCTAAGCGTTGATCTTCGGATC AGGTGCAA (SEQ ID NO: 603) |

TABLE 15-continued

| Extensions added to 3' and 5" ends of gNA | | |
|---|---|---|
| Extension Number | Extension Name | Extension Encoding Sequence |
| 7 | HH15 Minimal Hammerhead ribozyme | GGGAGCCCCGCTGATGAGGTCGGGGAGA CCGAAAGGGACTTCGGTCCCTACGGGGC TCCC (SEQ ID NO: 604) |
| 8 | sTRSV WT viral Hammerhead ribozyme | CCTGTCACCGGATGTGCTTTCCGGTCTG ATGAGTCCGTGAGGACGAAACAGG (SEQ ID NO: 605) |
| 9 | Hammerhead ribozyme | CGACTACTGATGAGTCCGTGAGGACGAA ACGAGTAAGCTCGTCTAGTCGCGTGTAG CGAAGCA (SEQ ID NO: 606) |
| 10 | Hammerhead ribozyme, smaller scar | CGACTACTGATGAGTCCGTGAGGACGAA ACGAGTAAGCTCGTCTAGTCG (SEQ ID NO: 607) |
| 11 | Hammerhead ribozyme, guide scaffold scar | CCAGTACTGATGAGTCCGTGAGGACGAA ACGAGTAAGCTCGTCTACTGGCGCTTTT ATCTCAT (SEQ ID NO: 608) |
| 12 | Twisted Sister 1 | ACCCGCAAGGCCGACGGCATCCGCCGCC GCTGGTGCAAGTCCAGCCGCCCCTTCGG GGGCGGGCGCTCATGGGTAAC (SEQ ID NO: 609) |
| 13 | Env-9 Twister | GGCAATAAAGCGGTTACAAGCCCGCAAA AATAGCAGAGTAATGTCGCGATAGCGCG GCATTAATGCAGCTTTATTG (SEQ ID NO: 610) |
| 14 | RBMX recruiting motif | CCACCCCCACCACCACCCCCACCCCCAC CACCACCC (SEQ ID NO: 611) |

Conclusions: The results support the conclusion that DME and rational design can be used to improve the performance of the gNAs and that many of these variant RNAs can now be used with the targeting sequences as a component of the CasX:gNA systems described herein to edit target nucleic acid sequences.

Example 21: CasX Editing of B2M Locus

Goal: Experiments were performed in order to identify optimal CasX and gNA molecules to edit the B2M locus Materials and Methods:

1. Generating B2M Targeting Constructs:

In order to generate the B2M targeting constructs, the codon-optimized CasX 2 (construct 2.2) and construct 119.64 molecules (CasX sequence in Table 16; guide sequences are listed in Tables 1 and 2) and fused NLS (referred to as "StX" herein), guide scaffold, and non-targeting targeting sequences were cloned, using the encoding DNA sequences, into a mammalian expression plasmid (pStX) using standard cloning methods. pStX includes a selection marker for both puromycin and carbenicillin. Sequences encoding the targeting sequences that target the gene of interest were designed based on StX PAM locations (Table 17, listing the RNA targeting sequences; plasmids were created with the corresponding DNA encoding sequences). Targeting sequence DNA was ordered as single-stranded DNA (ssDNA) oligos (Integrated DNA Technologies) consisting of the targeting sequence and the reverse complement of this sequence. These two oligos were annealed together and cloned into pStx individually or in bulk by Golden Gate assembly using T4 DNA Ligase (New England BioLabs Cat #M0202L) and an appropriate restriction enzyme for the plasmid. Golden Gate products were transformed into chemically or electro-competent cells such as NEB Turbo competent *E. coli* (NEB Cat #C2984I), plated on Lb-Agar plates (LB: Teknova Cat #L9315, Agar: Quartzy Cat #214510) containing carbenicillin. Individual colonies were picked and miniprepped using Qiagen Qiaprep spin Miniprep Kit (Qiagen Cat #27104) and following the manufacturer's protocol. The resultant plasmids were sequenced using Sanger sequencing to ensure correct ligation. SaCas9 and SpyCas9 control plasmids were prepared similarly to pStx plasmids described above, with the protein and guide regions of pStx exchanged for the respective protein and guide. Targeting sequences for SaCas9 and SpyCas9 were either obtained from the literature or were rationally designed according to established methods.

2. Assessing B2M Editing Activity in Mammalian Cell Lines:

Activity of the two StX variants were assessed in mammalian cells, including human embryonic kidney (HEK293T) cells and human T lymphocyte cells (Jurkats). Mammalian cells were maintained in a 37° C. incubator at 5% CO2. HEK293T cells and derivatives thereof were grown in Dulbecco's Modified Eagle Medium (DMEM; Corning Cellgro, #10-013-CV) supplemented with 10% fetal bovine serum (FBS; Seradigm, #1500-500), and 100 Units/ml penicillin and 100 mg/ml streptomycin (100×-Pen-Strep; GIBCO #15140-122), and can additionally include sodium pyruvate (100×, Thermofisher #11360070), non-essential amino acids (100× Thermofisher #11140050), HEPES buffer (100× Thermofisher #15630080), and 2-mercaptoethanol (1000× Thermofisher #21985023). Jurkats and K562s were cultured in RPMI medium supplemented with 10% fetal bovine serum (FBS; Seradigm, #1500-500), and 100 units/ml penicillin and 100 mg/ml streptomycin (100×-Pen-Strep; GIBCO #15140-122), and can additionally include sodium pyruvate (100×, Thermofisher #11360070), non-essential amino acids (100× Thermofisher #11140050), HEPES buffer (100× Thermofisher #15630080), and 2-mercaptoethanol (1000× Thermofisher #21985023). Adherent cells, such as HEK293 Ts, were seeded at 20-30 thousand cells per well into 96-well plates and transfected using 0.25-1 uL of Lipofectamine 3000 (Thermo Fisher Scientific #L3000008), 50-500 ng of a plasmid containing CasX and the reference or variant CasX guide targeting the reporter or target gene following the manufacturer's protocol. Alternatively, suspension cells such as Jurkats were nucleofected with 0.5-4.0 ug plasmid DNA/200 k cells using Lonza 4D-nucleofector following manufacturer's protocol. After nucleofection, suspension cells such as Jurkats were cultured in 96 well plates. 24-72 hours later the media was changed and 0.3-3.0 ug/ml puromycin (Sigma #P8833) was added to select for transformation. The following controls, or a combination thereof, were used for each transfection or nucleofection experiment: StX molecules with non-targeting targeting sequences, Sa.Cas9 and/or SpyCas9 targeting B2M, and Sa.Cas9 and Spy.Cas9 with non-targeting targeting sequences. 24-96 hours following selection, or later, the cells were analyzed by flow cytometry and gated for the appropriate forward and side scatter, selected for single cells and then gated for antibody reporter expression (Attune Nxt Flow Cytometer, Thermo Fisher Scientific) to quantify the expression levels of fluorophores. At least 10,000 events were collected for each sample. The data were then used to calculate the percentage of antibody-label negative (edited) cells.

Additionally, editing in cells from each experimental sample were assayed using T7E1 and NGS. For this, a subset of cells from each experimental sample was lysed and genomic DNA extracted using Quikextract solution (Lucigen Cat #QE09050) following the manufacturer's protocol. For T7E1, genomic DNA is first amplified via PCR with primers at the target genomic location of interest. This amplified DNA was then processed following the New England Biolabs T7E1 protocol and analyzed by gel electrophoresis.

3. NGS Analysis

For NGS analysis, genomic DNA was amplified via PCR with primers specific to the target genomic location of interest to form a target amplicon. These primers contain additional sequence at the 5' ends to introduce Illumina read1 and 2 sequences. Further, they contain a 16 nt randomer sequence that functions as a unique molecular identifier (UMI). Quality and quantification of the amplicon was assessed using a Fragment Analyzer DNA analyzer kit (Agilent, dsDNA 35-1500 bp). Amplicons were sequenced on the Illumina Miseq according to manufacturer's instructions.

Raw fastq files from sequencing were processed as follows: (1) the sequences were trimmed for quality and for adapter sequences using the program cutadapt (v. 2.1); (2) the sequences from read 1 and read 2 were merged into a single insert sequence using the program flash2 (v2.2.00); (3) inserts with the same UMI sequence were merged into a single sequence. In a first step, a single consensus sequence was generated from all individual inserts with the same UMI, using a per-base voting strategy. In a second step, the individual inserts were compared to the consensus sequence. If more than 67% of inserts exactly match the consensus sequence, the consensus sequence was taken for that UMI. If not, the individual insert with the highest sequencing quality is taken for that UMI; and (4) the consensus insert sequences were run through the program CRISPResso2 (v 2.0.29), along with the expected amplicon sequence and the targeting sequence. This program quantifies the percent of reads that are modified in a window around the 3' end of the targeting sequence (20 bp window centered at −3 bp from 3' end of targeting sequence). The percent modified of an StX molecule was quantified by the total percent of reads that contain insertions and/or deletions in this window.

TABLE 16

Sequences of Stx CasX Constructs

| Construct | Amino Acid Sequence |
|---|---|
| 2.2 | QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV(SEQ ID NO: 612) |
| 119.64 | QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV(SEQ ID NO: 613) |

TABLE 17

HLA1 Editing by CasX or Cas9 with Targeting Sequences

| Nuclease | Name* | Sequence | % HLA Negative* |
|---|---|---|---|
| CasX | TTC 7 | UCCAUCCGACAUUGAAGUUG (SEQ ID NO: 614) | 0 |
| | TTC 8 | AUCUCUU-GUAC UACAC UGAA (SEQ ID NO: 615) | 0 |
| | TTC 9 | GUGUAGUACAAGAGAUAGAA (SEQ ID NO: 616) | 6.00 |
| | TTC 10 | CACGGCAGGCAUACUCAUCU (SEQ ID NO: 617) | 0 |
| | TTC 11 | UAGAUCGAGACAUGUAAGCA (SEQ ID NO: 618) | 9.67 |

TABLE 17-continued

HLA1 Editing by CasX or Cas9 with Targeting Sequences

| Nuclease | Name* | Sequence | % HLA Negative* |
|---|---|---|---|
| | TTC 12 | AAUUUACAUACUCUGC UUAG (SEQ ID NO: 619) | 0 |
| | TTC 13 | AAGCAGAGUAUGUAAA UUGG (SEQ ID NO: 620) | 0.33 |
| | TTC 14 | UGAAGCUGACAGCAUU CGGG (SEQ ID NO: 621) | 4.67 |
| | TTC 16 | GGUUUACUCACGUCAU CCAG (SEQ ID NO: 622) | 2.33 |
| | TTC 17 | CUCUCCAUUCUUCAGU AAGU (SEQ ID NO: 623) | 0 |
| | TTC 18 | GACUUGUCUUUCAGCA AGGA (SEQ ID NO: 624) | 0.67 |
| | TTC 19 | CCCCCACUGAAAAAGA UGAG (SEQ ID NO: 625) | 0 |
| | TTC 20 | UAGAUCGAGACAUGUA AGCA (SEQ ID NO: 626) | 6.67 |
| | TTC 21 | CCACUGUCUUUUUCAU AGAU (SEQ ID NO: 627) | 0 |
| | TTC 22 | UUGCUAACCUUUUUCU UUUC (SEQ ID NO: 628) | 3.00 |
| | TTC 23 | UUUCUUUUCAGGUUUG AAGA (SEQ ID NO: 629) | 0 |
| | TTC 24 | UUUCAGGUUUGAAGAU GCCG (SEQ ID NO: 630) | 0 |
| | TTC 25 | GGUUUGAAGAUGCCG CAUUU (SEQ ID NO: 631) | 0 |
| | TTC 26 | AACCUGAAAAGAAAAG AAAA (SEQ ID NO: 632) | 0 |
| | TTC 27 | UCCAAUCCAAAUGCGG CAUC (SEQ ID NO: 633) | 0 |
| | TTC 28 | UGGUCAAAUAAACAAA GCUG (SEQ ID NO: 634) | 0 |
| | TTC 29 | CAUUUUCCAGAUUAGG AAUC (SEQ ID NO: 635) | 0 |
| | TTC 30 | GGAAUGCCCGCCAGC GCGAC (SEQ ID NO: 636) | 0 |

TABLE 17-continued

HLA1 Editing by CasX or Cas9 with Targeting Sequences

| Nuclease | Name* | Sequence | % HLA Negative* |
|---|---|---|---|
| | TTC 31 | UGAAGCUGACAGCAUU CGGG (SEQ ID NO: 637) | 0 |
| | TTC 32 | CAAGGUCAAAAACUUA CCUC (SEQ ID NO: 638) | 1.67 |
| | TTC 34 | UUUCUUUUCAGGUUUG AAGA (SEQ ID NO: 639) | 0 |
| | TTC 35 | AGGCAUAGUUUUAUAC CUGA (SEQ ID NO: 640) | 0 |
| | TTC 37 | GGCCGAGAUGUCUCG CUCCG (SEQ ID NO: 641) | 11.00 |
| | CTC 38 | AUGUUUGAUGUAUCUG AGCA (SEQ ID NO: 642) | 0 |
| | CTC 39 | GAUACAUCAAACAUGG AGAC (SEQ ID NO: 643) | 0 |
| | CTC 40 | AUGAUGCUGCUUACAU GUCU (SEQ ID NO: 644) | 0 |
| | CTC 41 | CGUCAUCCAGCAGAGA AUGG (SEQ ID NO: 645) | 0 |
| | CTC 42 | GCUGGAUGACGUGAG UAAAC (SEQ ID NO: 646) | 0 |
| | CTC 43 | AGGCCAGAAAGAGAGA GUAG (SEQ ID NO: 647) | 3.67 |
| | CTC 44 | ACUGUCUUUUUCAUAG AUCG (SEQ ID NO: 648) | 0 |
| | CTC 45 | AGGUCAAAAACUUACC UCCA (SEQ ID NO: 649) | 0 |
| | CTC 46 | AUGAUGCUGCUUACAU GUCU (SEQ ID NO: 650) | 0 |
| | CTC 47 | ACUUAUAUUAAACGCG UGCC (SEQ ID NO: 651) | 0 |
| | ATC 48 | CGGCCCGAAUGCUGU CAGCU (SEQ ID NO: 652) | 0 |
| | ATC 49 | AGCGUGAGUCUCUCCU ACCC (SEQ ID NO: 653) | 0 |
| | ATC 50 | UUGGAGUACCUGAGGA AUAU (SEQ ID NO: 654) | 0 |

TABLE 17-continued

HLA1 Editing by CasX or Cas9 with Targeting Sequences

| Nuclease | Name* | Sequence | % HLA Negative* |
|---|---|---|---|
| | ATC 52 | AUCCGACAUUGAAGUUGACU (SEQ ID NO: 655) | 0 |
| | ATC 53 | GACAUUGAAGUUGACUUACU (SEQ ID NO: 656) | 0 |
| | ATC 54 | CUUGUACUACACUGAAUUCA (SEQ ID NO: 657) | 0 |
| | ATC 55 | UUUUCAGUGGGGGUGAAUUC (SEQ ID NO: 658) | 0 |
| | ATC 56 | UGGGCUGUGACAAAGUCACA (SEQ ID NO: 659) | 0 |
| | ATC 57 | AGACAUGUAAGCAGCAUCAU (SEQ ID NO: 660) | 0 |
| | ATC 58 | UCAAACCUGAAAAGAAAAGA (SEQ ID NO: 661) | 0 |
| | ATC 59 | AAAUGCGGCAUCUUCAAACC (SEQ ID NO: 662) | 0 |
| | ATC 60 | AAUCCAAAUGCGGCAUCUUC (SEQ ID NO: 663) | 0 |
| | ATC 61 | GAGCAGGUUGCUCCACAGGU (SEQ ID NO: 664) | 0 |
| | ATC 62 | UAAAACUUGAUGUGUUAUCU (SEQ ID NO: 665) | 0 |
| | ATC 63 | AACAUCAACAUCUUGGUCAG (SEQ ID NO: 666) | 0 |
| | ATC 64 | CGGCCCGAAUGCUGUCAGCU (SEQ ID NO: 667) | 0 |
| | GTC 65 | UGAUUGGCUGGGCACGCGUU (SEQ ID NO: 668) | 0 |
| | GTC 66 | CGCUCCGUGGCCUUAGCUGU (SEQ ID NO: 669) | 0 |
| | GTC 67 | AAUAAACAAAGCUGGCCAUC (SEQ ID NO: 670) | 0 |
| | GTC 68 | UAUAAGAUUCAUAUUUACUU (SEQ ID NO: 671) | 0 |
| | ATT 69 | GGGCCGAGAUGUCUCGCUCC (SEQ ID NO: 672) | 0 |
| | CTT 70 | AAUGUCGGAUGGAUGAAACC (SEQ ID NO: 673) | 0 |
| | CTT 71 | GCUGUGCUCGCGCUACUCUC (SEQ ID NO: 674) | 0 |
| | CTT 72 | CUGGCCUGGAGGCUAUCCAG (SEQ ID NO: 675) | 0 |
| | CTT 73 | CCAUUCUCUGCUGGAUGACG (SEQ ID NO: 676) | 0 |
| | CTT 74 | CUGAAGAAUGGAGAGAGAAU (SEQ ID NO: 677) | 0 |
| | CTT 75 | CCUCCAUGAUGCUGCUUACA (SEQ ID NO: 678) | 0 |
| | CTT 76 | CAAUUUACAUACUCUGCUUA (SEQ ID NO: 679) | 0 |
| | CTT 77 | CACUCAAAGCUUGUUAAGAU (SEQ ID NO: 680) | 0 |
| | CTT 78 | ACAAGCUUUGAGUGCAAGAG (SEQ ID NO: 681) | 0 |
| Cas9 | SaCas9 79 | UCGGCCCGAAUGCUGUCAGCUUC (SEQ ID NO: 682) | 6.30 |
| | SaCas9 80 | GCCACGGAGCGAGACAUCUCGGC (SEQ ID NO: 683) | 49.46 |
| | SaCas9 81 | GGAUAGCCUCCAGGCCAGAAAGA (SEQ ID NO: 684) | 69.53 |
| | SaCas9 82 | UUCUGGCCUGGAGGCUAUCCAGC (SEQ ID NO: 685) | 69.70 |
| | SaCas9 83 | CGGGAGGGUAGGAGAGACUCACG (SEQ ID NO: 686) | 31.56 |
| | SaCas9 84 | AACCUGAAUCUUUGGAGUACCUG (SEQ ID NO: 687) | 76.00 |
| | SaCas9 85 | UGACGUGAGUAAACCUGAAUCUU (SEQ ID NO: 688) | 1.69 |
| | SaCas9 86 | UCUGCUGGAUGACGUGAGUAAAC (SEQ ID NO: 689) | 6.93 |
| | SaCas9 87 | AGGUUUACUCACGUCAUCCAGCA (SEQ ID NO: 690) | 30.26 |

TABLE 17-continued

HLA1 Editing by CasX or Cas9 with Targeting Sequences

| Nuclease | Name* | Sequence | % HLA Negative* |
|---|---|---|---|
| | SaCas9 88 | CUUUCCAUUCUCUGCUGGAUGAC (SEQ ID NO: 691) | 1.89 |
| | SaCas9 90 | CAGAGAAUGGAAAGUCAAAUUUC (SEQ ID NO: 692) | 1.05 |
| | SaCas9 91 | AAAUUUCCUGAAUUGCUAUGUGU (SEQ ID NO: 693) | 43.46 |
| | SaCas9 92 | CAGUAAGUCAACUUCAAUGUCGG (SEQ ID NO: 694) | 24.13 |
| | SaCas9 93 | CCGACAUUGAAGUUGACUUACUG (SEQ ID NO: 695) | 18.03 |
| | SaCas9 95 | GUUGACUUACUGAAGAAUGGAGA (SEQ ID NO: 696) | 79.06 |
| | SaCas9 96 | CCAGUCCUUGCUGAAAGACAAGU (SEQ ID NO: 697) | 33.70 |
| | SaCas9 97 | GUCUUUCUAUCUCUUGUACUACA (SEQ ID NO: 698) | 7.20 |
| | SaCas9 98 | UGAAUUCACCCCCACUGAAAAAG (SEQ ID NO: 699) | 64.33 |
| | SaCas9 99 | CAUACUCAUCUUUUUCAGUGGGG (SEQ ID NO: 700) | 4.57 |
| | SaCas9 100 | CAGGCAUACUCAUCUUUUUCAGU (SEQ ID NO: 701) | 0.90 |
| | SaCas9 101 | UGUCACAGCCCAAGAUAGUUAAG (SEQ ID NO: 702) | 49.33 |
| | SaCas9 102 | UUUCAGGUUUGAAGAUGCCGCAU (SEQ ID NO: 703) | 0.76 |
| | SaCas9 103 | UUCAGGUUUGAAGAUGCCGCAUU (SEQ ID NO: 704) | 0.30 |
| | SaCas9 104 | GGUUUGAAGAUGCCGCAUUUGGA (SEQ ID NO: 705) | 2.11 |
| | SaCas9 105 | UGAAGAUGCCGCAUUUGGAUUGG (SEQ ID NO: 706) | 1.82 |
| | SaCas9 106 | UAAAUUUUCCCCCAAAUUCUAAG (SEQ ID NO: 707) | 1.28 |
| | SaCas9 108 | UCGGCCCGAAUGCUGUCAGCUUC (SEQ ID NO: 708) | 2.13 |
| | SaCas9 109 | GCCACGGAGCGAGACAUCUCGGC (SEQ ID NO: 709) | 0.86 |
| | SpyCas9 110 | GGAUAGCCUCCAGGCCAGAAAGA (SEQ ID NO: 710) | 87.64 |

*Mean value of at least 3 replicate assays

Figure 24:
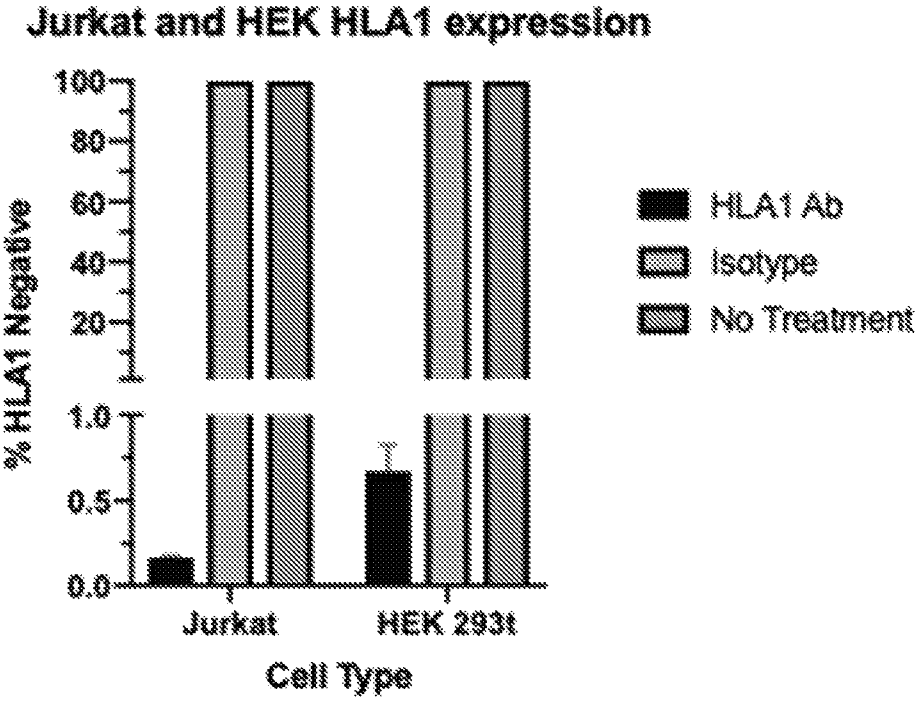
FIG. 24 is a graph showing the expression levels of HLA1 in Jurkat and HEK 293T, as described in Example 21. Cells were analyzed via flow cytometry using a fluorescent antibody targeting HLA1.
Figure 25:
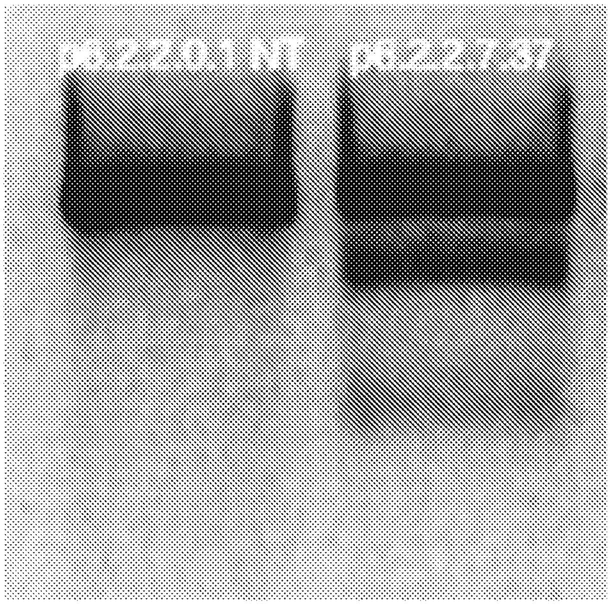
FIG. 25 is an agarose gel showing T7E1 of HEK 293T genomic DNA treated with Stx 2.2, as described in Example 21. Editing is occurring at the B2M locus with a targeting spacer (p6.2.2.7.37), but not with a nontargeting spacer (p6.2.2.0.1).

Results:

The level of HLA1 expression was first assessed in multiple human cell lines (FIG. 24). The basis of this assay is the reduction in the level of HLA1 expression due to the knockout of B2M, an essential structural protein of HLAL. The T7E1 assay verified editing of the B2M locus in HEK cells (FIG. 25). We screened for this using a fluorescent antibody specific to HLA 1. An initial screen in HEK293T cells of 68 B2M targeting sequences (see Table 17) with various PAM specificities were tested with our initial Stx molecule 2.2 using SpyCas9 as a control, and a) similar screen was then performed with 26 B2M targeting sequences compatible (see Table 17) with SaCas9 to establish controls for this target with the SaCas9 molecule. The results of the editing assay are presented in Table 17, expressed as the percent change in HLA1 expression.

Figure 26:
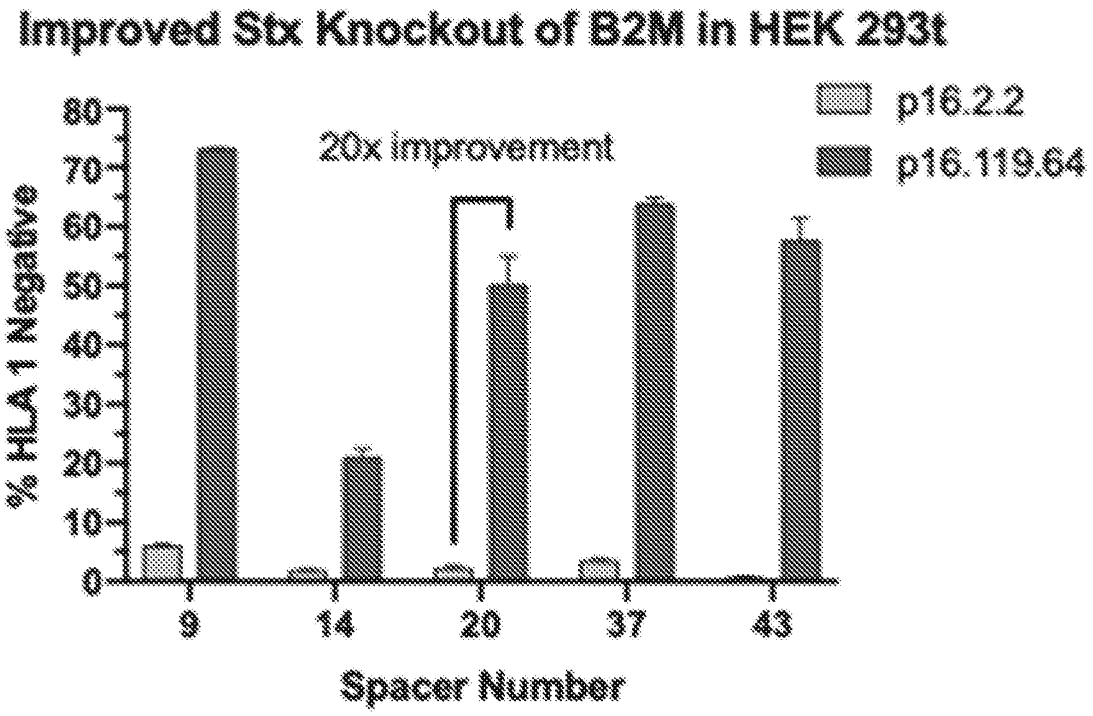
FIG. 26 is a graph showing the relative improvement in edited (knock-out) of B2M in HEK 293T cells using Stx molecule 119.64 (numbers refer to CasX and guide, respectively), compared to Stx 2.2, as described in Example 21.
Figure 27:
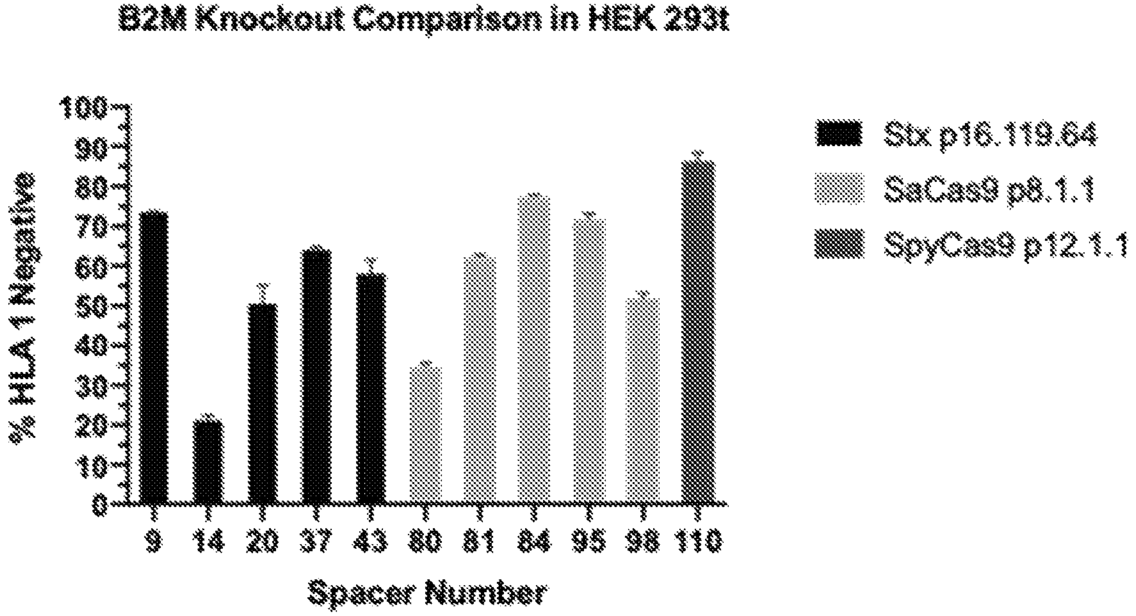
FIG. 27 is a graph showing the comparison in edited (knock-out) of B2M in HEK 293T cells using Stx 119.64 in comparison with the five high-performing SaCas9 spacers, showing comparable levels of editing, as described in Example 21.
Figure 28:
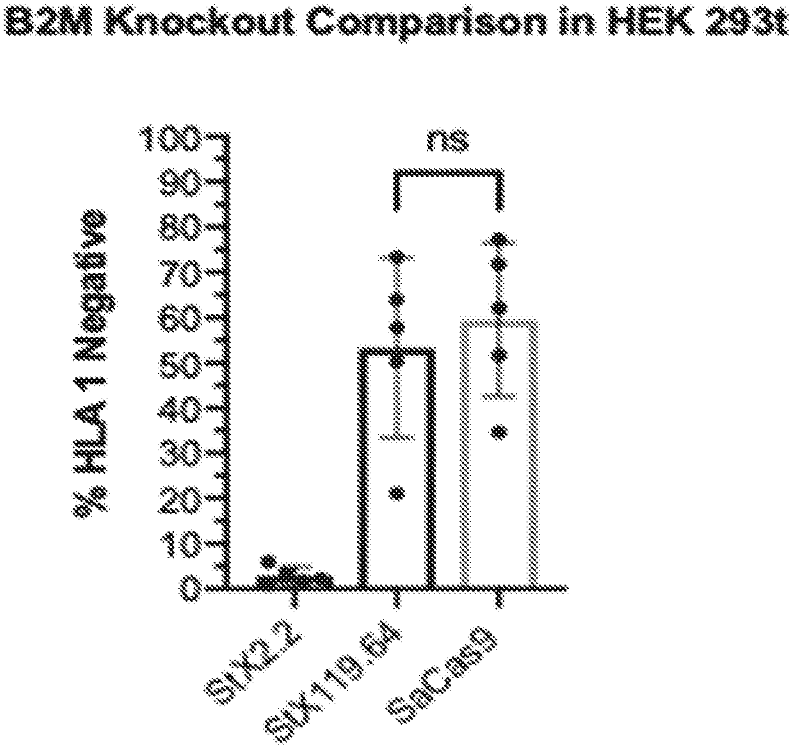
FIG. 28 is a graph showing the relative improvement in edited (knock-out) of B2M in HEK 293T cells using Stx molecule 119.64.7 (numbers refer to CasX, guide, and spacer, respectively) compared to Stx 2.2, with results comparable to SaCas9, as described in Example 21.
Figure 29:
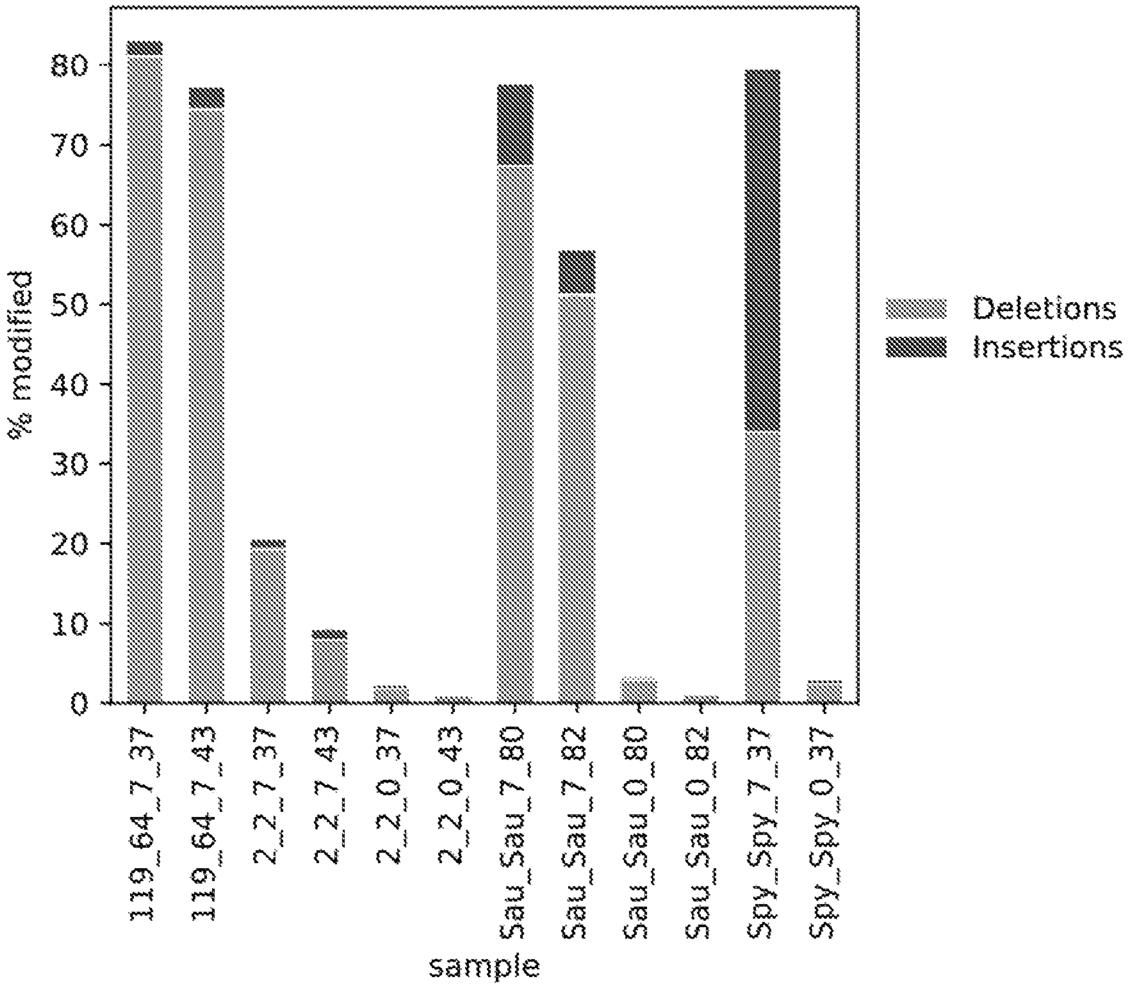
FIG. 29 is a graph showing NGS analysis of percentage editing of the HEK 293T B2M locus, with up to 80% modification with Stx 119.64, as described in Example 21.

The Stx 119.64 variant shows substantial improvement over Stx 2.2, editing at the endogenous B2M locus in HEK cells with up to 20-fold higher efficiency as measured via flow cytometry in HEK293T cells (FIG. 26). A comparison of Stx 119.64 with the five best SaCas9 spacers targeting endogenous B2M in HEK 293T cells shows comparable levels of editing (FIGS. 27 and 28). NGS analysis of HEK 293tTB2M locus shows up to 80% modification with Stx 119.64 (FIG. 29). These modifications are predominantly deletions, in contrast to SpyCas9 which are primarily insertions.

Conclusions: The results support that the editing performance of Stx CasX can be improved by selective mutations introduced into the sequence of Stx 2.2.

Example 22: Genetic Disruption of B2M in Cells Genetically Engineered to Express a Chimeric Antigen Receptor (CAR) and TCR Primary human CD4+ and CD8+ T cells will be isolated by immunoaffinity-based selection from human PBMC samples obtained from healthy donors. The resulting cells will be stimulated by culturing with an anti-CD3/anti-CD28 reagent in media containing human serum, IL-2 (100 U/mL), IL-7 (10 ng/mL) and IL-15 (5 ng/mL) at 37° C. prior to engineering with a chimeric antigen receptor (CAR) by lentiviral transduction for 24-48 hours. The cells will be transduced using a lentiviral vector containing a nucleic acid molecule encoding an exemplary anti-CD19 CAR and a nucleic acid encoding a truncated EGFR (EGFRt), for use as a surrogate marker for transduction, separated by a sequence encoding a T2A ribosome switch. The CAR will include an anti-CD19 scFv (such as an anti-CD19 sequence of Table 5 wherein the VH and VL are joined by short linkers), an Ig-derived spacer, a human CD28-derived transmembrane domain, a human 4-1BB-derived intracellular signaling domain and a human CD3 zeta-derived signaling domain.

For introduction of the engineered T cell receptor (TCR), the cells will be transduced using a lentiviral vector containing a nucleic acid molecule encoding a human full length T-cell receptor a chain linked to an anti-CD19 sequence of Table 5 (which may be the same or different compared to the CAR anti-CD19 sequence) by a linker sequence, and further containing an intracellular signaling domain of CD3 epsilon or CD3 gamma.

Following transduction, the cells will be cultured for 36-48 hours in media containing human serum and IL-2 (50 U/mL), IL-7 (5 ng/mL) and IL-15 (0.5 ng/mL). The cells will then be electroporated with RNP prepared using the B2M-targeted gNA with the targeting sequence GUGUAGUACAAGAGAUAGAA (TTC 9 of Table 17 (SEQ ID NO: 616)) and CasX 119 with guide 174. The cells then will be cultured in the same media containing IL-2, IL-7 and IL-15 at the same concentrations, overnight at 30° C., and then at 37° C. through day 12-15 post-electroporation.

CAR and B2M Expression

Cell surface expression of B2M, TCR and CAR expression (as indicated via the surrogate marker) will be assessed on day 12 after electroporation, following a 24 hour restimulation with beads conjugated with anti-CD3/anti-CD28 antibodies. Cells will be stained with anti-EGFR antibody to verify CAR expression (as indicated by surface expression of the surrogate marker, EGFRt), an anti-TCR alpha to verify TCR expression, and an anti-B2M antibody to verify and knock-down expression of B2M on the surface by flow cytometry. By flow cytometry, the majority of cells would be expected to show reduced expression of B2M, i and expression of the CAR-expressing populations (as indicated by the EGFRt marker), and expression of the TCR in the TCR-expressing populations.

Phenotypic characteristics of the modified engineered CD4+ and CD8+ T cells also will be assessed by flow cytometry assessing surface expression of various markers, including those indicative of phenotype, differentiation state and/or activation state. Cells will be stained with antibodies specific for -C motif chemokine receptor 7 (CCR7), 4-1BB, TIM-3, CD27, CD45RA, C-D45RO, Lag-3, (CD62L, CD25 and CD69 in addition to those for recognizing B2M and the EGFRt marker (surrogate for CAR expression) as described above.

Example 23: Cytotoxicity Assay

JVM-2 cells (human chronic B-cell leukemia cell line expressing CD19) and the CAR-T cell line of Example 22 will be cultured in RPMI 1640 (Life Technologies, Rockville, MD) supplemented with 10% FCS (Bio Whittaker, Walkersville, MD), 100 IU/mL penicillin, and 100 μg/mL streptomycin (Life Technologies). Cytotoxicity will be measured in a standard $^{51}$Cr-release assay. CAR-T cells will be seeded with Chromium 51 ($^{51}$Cr)-labeled target cells (5×103 cells per well) at various effector/target cell ratios in 96-well U-bottomed microtiter plates (triplicate wells per sample). Plates will be incubated for 6 hours at 37° C., 5% CO2. $^{51}$Cr-release will be measured in 100 μL supernatant using a liquid scintillation counter. Maximum release will be obtained from detergent-released target cell counts and spontaneous release from target cell counts in the absence of effector cells. Cellular cytotoxicity will be calculated as follows: % specific lysis=[(experimental release−spontaneous release)/(maximum release−spontaneous release)]. It is expected that the data will confirm the ability of the CAR-T cells to effect lysis on the CD19+ target cells.

Example 24: Editing at B2M Locus

Materials and Methods

CasX variants 119, 488, and 491 were expressed and purified as described in the Examples above. Single guide RNAs with scaffold 174 and spacers 7.9 (having sequence GUGUAGUACAAGAGAUAGAA (SEQ ID NO: 616)) and 7.37 (having sequence GGCCGAGAUGUCUCGCUCCG (SEQ ID NO: 592)) were transcribed and purified as described in the Examples, above. Individual RNPs were assembled by mixing protein with a 1.2-fold molar excess of guide in buffer containing 25 mM sodium phosphate buffer (pH 7.25), 150 mM NaCl, 1 mM $MgCl_2$, and 200 mM trehalose (Buffer 1). RNPs were incubated at 37° C. for 10 minutes and then purified via size exclusion chromatography. The concentration of the RNP was determined following purification using the Pierce 660 nm protein assay.

Purified RNPs were tested for editing at the B2M locus in Jurkat cells. RNPs were delivered by electroporation using the Lonza 4-D nucleofector system. 700,000 cells were resuspended in 20 uL of Lonza buffer P3 and added to RNP diluted in Buffer 1 to the appropriate concentration and a final volume of 5 uL, unless otherwise specified. Cells were electroporated using the Lonza 96-well shuttle system using the protocol EH-115. Cells were recovered in pre-equilibrated RPMI and then each electroporation condition was split into three wells of a 96-well plate. Media was changed on days 1 and 4 following the nucleofection. On day 7 post-nucleofection, cells were stained with a fluorescent anti-HLA 1 antibody and assessed for elimination of surface HLA using an Attune Nxt flow cytometer. If next-generation sequencing was carried out, half of the cells from each condition were passaged for an additional three days before harvesting. Genomic DNA was isolated and the relevant regions of the B2M gene (exon 1 for 7.37, exon 2 for 7.9) were PCR amplified and sequenced using an Illumina MiSeq. The resulting sequence reads were analyzed for editing profiles using Crispresso.

Results

Figure 30:
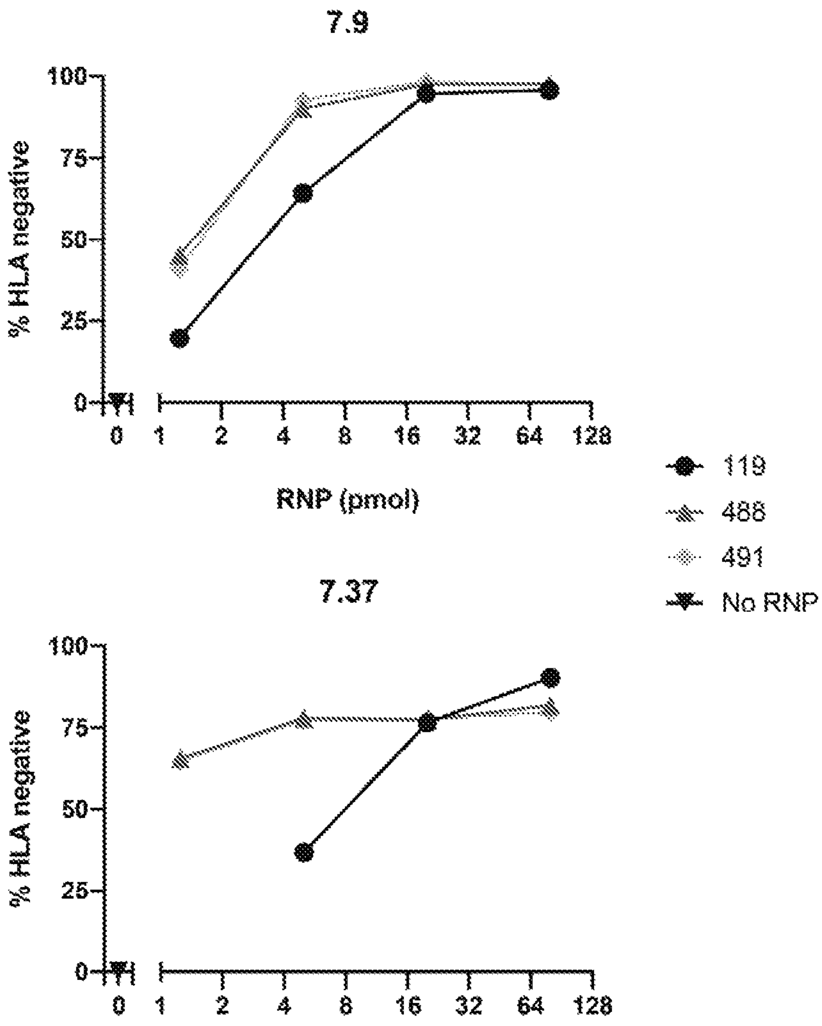
FIG. 30 shows the results of RNP-mediated editing at the B2M locus, as described in Example 24. Jurkat cells were electroporated with the indicated dose and variant of CasX with a guide with either spacer 7.9 or 7.37. HLA knockdown was determined with antibody staining and flow cytometry.
Figure 31:
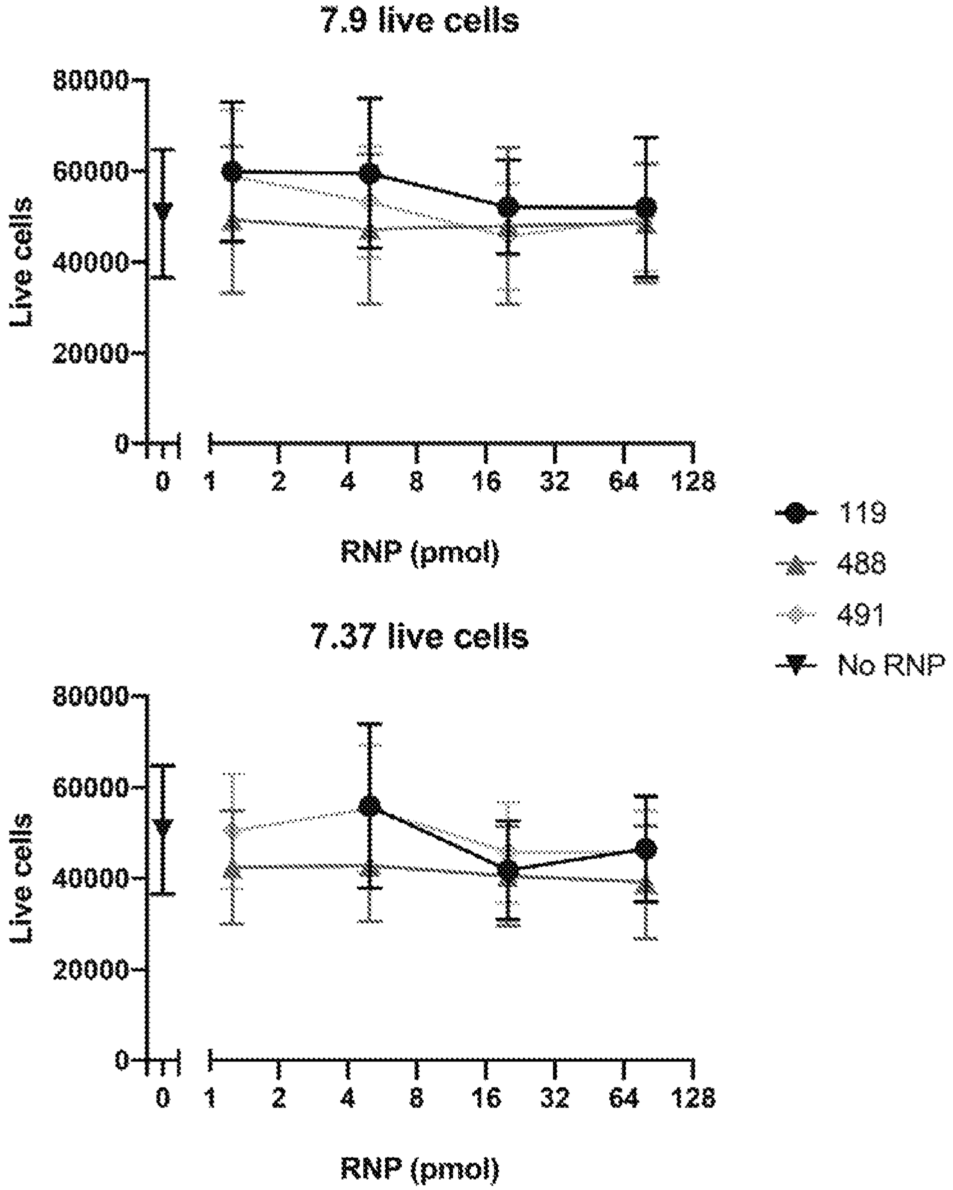
FIG. 31 shows the results of cell viability assays following electroporation of CasX RNPs, as described in Example 24, with spacer 7.9 (top) and 7.37 (bottom). Live cells were counted via DAPI staining and flow cytometry at the time of HLA knockdown analysis.

CasX RNPs composed of either CasX variant 119, 488, or 491 and B2M-targeting guides 174.7.9 or 174.7.37 were nucleofected into Jurkat cells at doses of 1.25, 5, 20, and 80 pmol per 25 uL nucleofection condition. The 1.25 pmol dose for RNP 119.174.7.37 was omitted due to space constraints. RNPs targeting 7.9 eliminated surface HLA in >90% of cells for all protein variants at 20 and 80 pmol doses (FIG. 30). At lower doses CasX 488 and 491 RNPs outperformed CasX 119 RNPs. The 7.37-targeting RNPs appeared to have an editing ceiling of ~80%, with a substantial decrease in editing for 119 at the 5 pmol dose but relatively little decline in editing at even the lowest dose for 488 and 491 (FIG. 30). Across all doses, performance of 488 and 491-based RNPs were nearly identical. None of the RNPs exhibited pronounced RNP-dependent toxicity, as measured by the number of viable cells following treatment with RNP vs a buffer-only control (FIG. 31). 491 potentially had better viability than 488, though the differences were small relative to the standard deviation of the measurement, and it also has better production characteristics (data not shown), making it the preferred candidate for future RNP editing experiments.

Figure 32:
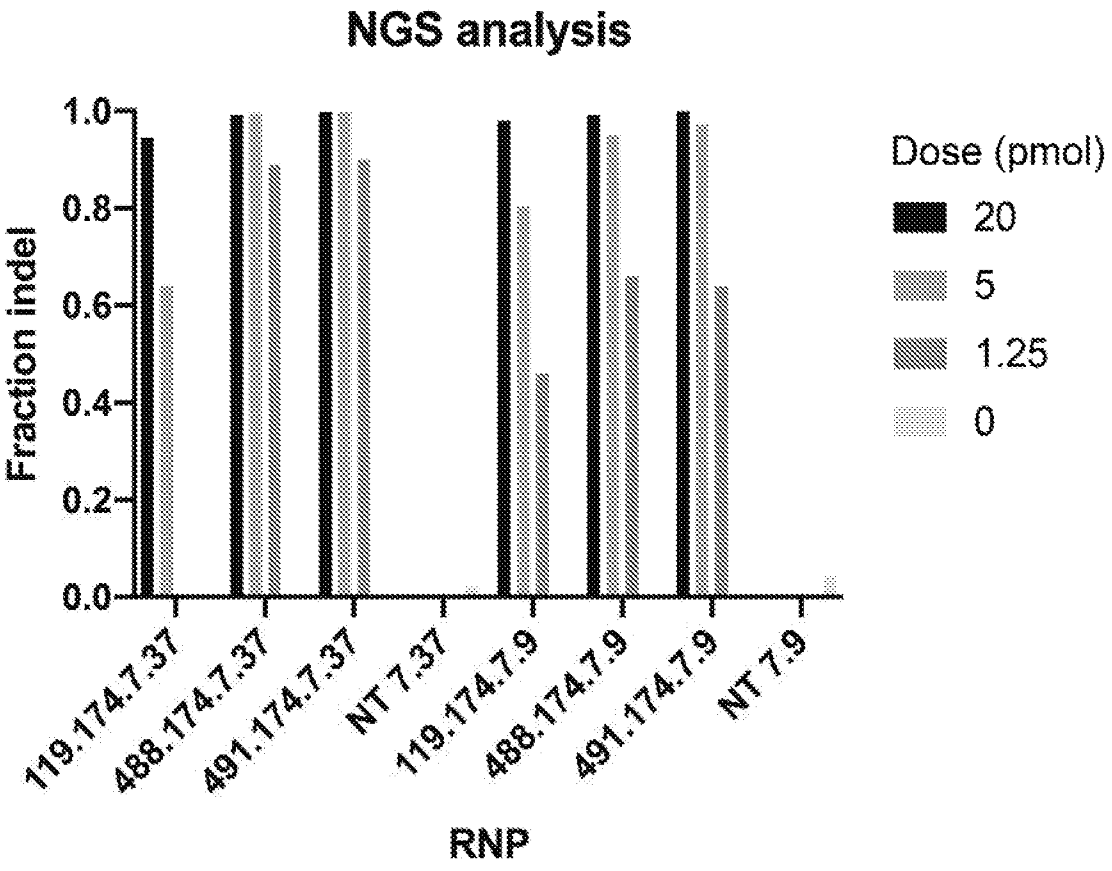
FIG. 32 shows the results of NGS analysis of RNP-mediated editing at the B2M locus, as described in Example 24. Jurkat cells were electroporated with the indicated dose of RNP and analyzed for indel formation via NGS.

To validate the phenotypic knockdown of HLA, deep sequencing of the targeted regions of B2M was performed for the 1.25, 5, and 20 pmol doses of each RNP. The 488.174.7.9 (CasX 488, gNA 174 and spacer 7.9) and 491.174.7.9 (CasX 491, gNA 174 and spacer 7.9) RNPs produced indels in >99% of B2M loci at the 20 pmol dose and in 95% and 97% of B2M loci at the 5 pmol dose, respectively (FIG. 32). The corresponding 7.37 RNPs resulted in >99% indels at both the 20 pmol dose and the 5 pmol dose, indicating that many of the edits at this location still result in functional B2M production and cause the apparent ceiling on phenotypic knockout. The NGS data is consistent with the phenotypic analysis in showing consistently higher editing with 488 and 491 relative to 119-based RNPs, as well as demonstrating efficient editing with very low doses of RNP, in the picomolar range.

Example 25. NHEJ and HDR at TRAC locus

Methods and Materials

RNPs composed of CasX variant 491 and either gRNA 174.15.3 or 174.15.5 were assembled and purified as described above. Templates for homology-directed repair were generated by PCR-amplifying homology arms from human genomic DNA corresponding to roughly 500 bp on either side of the cut site and an eGFP sequence with flanking P2A and T2A self-cleaving peptide sequences (primers used are in Table 18). The fragments were combined using overlap extension PCR, such that the resulting template included the P2A-eGFP-T2A construct in-frame with TRAC. The assembled template sequence was then cloned into a plasmid backbone using PstI and HindIII restriction sites. To produce double-stranded DNA templates, the appropriate plasmid was PCR-amplified using the indicated primers and the product was purified by phenol-chloroform extraction and ethanol precipitation. To produce single-stranded DNA templates, the plasmid was PCR-amplified using the same primers but with one of the two containing a 5' phosphate. The resulting product was purified and digested using lambda exonuclease, which degrades the strand with the 5' phosphate, yielding predominantly ssDNA of the desired strand. The ssDNA product was purified by phenol-chloroform extraction and ethanol precipitation.

Electroporations were carried out largely as described above, except that template DNA diluted in water to the desired concentration for a final volume of 2 uL was added to reactions where appropriate. 50 pmol of RNP was used, and template DNA amounts were varied from 2 to 8 ug for dsDNA and 1 to 4 ug for ssDNA. Seven days post-nucleofection, cells were stained using fluorescent anti-TCR α/β antibodies and assessed for TCR knockout and GFP expression using an Attune Nxt flow cytometer. Jurkat cells have a significant TCR negative population in the absence of editing at the locus. To correct for this, we assumed that cells not expressing TCR were edited at the TRAC locus at a comparable rate to cells with regular TCR expression and presentation and applied the formula E, $=(\mathrm{TCRNeg}_{Obs}-\mathrm{TCRNeg}_{ctrl})/(1-\mathrm{TCRNeg}_{ctrl})$, where E, is corrected editing, $\mathrm{TCRNeg}_{Obs}$ is the fraction of TCR negative cells observed, and $\mathrm{TCRNeg}_{ctrl}$ is the average fraction of TCR negative cells observed in buffer-only controls. No correction was applied to GFP+ cells, though it is possible that silencing of the TCRα locus results in an underestimation of our HDR efficiency.

TABLE 18

Primers used for HDR template generation

| Primer | DNA Sequence |
|---|---|
| 15.3 left homology arm FWD | AGAGAGCTGCAGTGGCCAAGATTGATAGCTT GTGCCTG (SEQ ID NO: 711) |
| 15.3 left homology arm REV | AGAGATCCCCTGCCCTCTCCGGATCCGGACG ACACATTTGTTTGAGAATCAAAATCGGTG (SEQ ID NO: 712) |
| 15.3 right homology arm FWD | GCCGGCGACGTGGAGGAGAACCCCGGCCCCA GTAAGGATTCTGATGTGTATATCACAGAC (SEQ ID NO: 713) |
| 15.3 right homology arm REV | GAGAGAAAGCTTGGGTTTTGGTGGCAATGGA TAAGG (SEQ ID NO: 714) |
| 15.5 left homology arm FWD | AGAGAGCTGCAGGCATCTGGACTCCAGCCTG GG (SEQ ID NO: 715) |
| 15.5 left homology arm REV | GTAAGGAGAGATCCCCTGCCCTCTCCGGATC CGGAATTTGCACATGCAAAGTCAGATTTG (SEQ ID NO: 716) |
| 15.5 right homology arm FWD | CAGGCCGGCGACGTGGAGGAGAACCCCGGCC CCAGTAACAGCATTATTCCAGAAGACACC (SEQ ID NO: 717) |
| 15.5 right homology arm REV | GAGAGAAAGCTTAACTCAGTTGGAGAGACTG AGG (SEQ ID NO: 718) |
| eGFP FWD | GGAGAGGGCAGGGGATCTCTCCTTACTTGTG GCGACGTGGAGGAGAACCCCGGCCCCATGGT GAGCAAGGGCGAGGAG (SEQ ID NO: 719) |
| eGFP REV | GGGGTTCTCCTCCACGTCGCCGGCCTGCTTC AGCAGGCTGAAGTTGGTGGCTCCGGATCCGG ACTTGTACAGCTCGTCCATGCCG (SEQ ID NO: 720) |
| 15.3 amplification FWD | TGGCCAAGATTGATAGCTTG (SEQ ID NO: 721) |
| 15.3 amplification REV | GGGTTTTGGTGGCAATGG (SEQ ID NO: 722) |
| 15.5 amplification FWD | GCATCTGGACTCCAGCCTGGG (SEQ ID NO: 723) |
| 15.5 amplification REV | AACTCAGTTGGAGAGACTGAGG (SEQ ID NO: 724) |

Results

Figure 33:
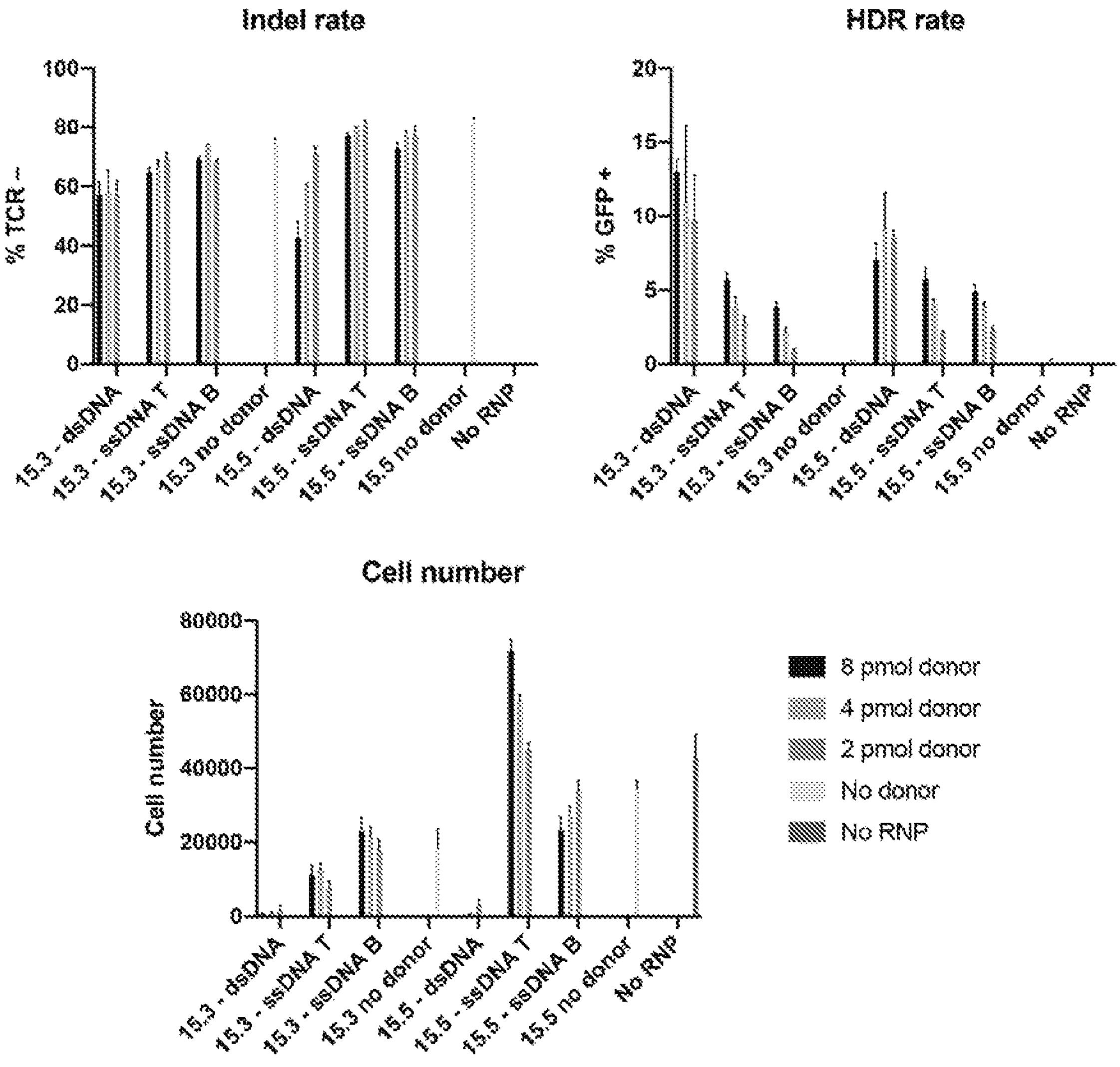
FIG. 33 shows the results of indel and HDR rates by editing at the TRAC locus analyzed for loss of surface expression of TCR a/p, which indicates indel formation, expression of GFP, which indicates HDR, and number of viable cells, as described in Example 25. "T" and "B" indicate whether the ssDNA is the top or bottom strand relative to the direction of the TRAC gene.

TRAC-targeting RNPs in the absence of donor eliminated surface TCR a/3 in 75% and 83% of cells with a 50 pmol dose of spacer 15.3 and 15.5, respectively (FIG. 33). dsDNA appeared to generate the highest HDR rate, reaching over 10%, but also led to the death of nearly all the cells. ssDNA had a much lower effect on viability, in some cases appearing to increase viability relative to no donor and buffer-only controls. HDR rates with ssDNA varied with dose of both RNP and donor from 1%-6%, with the highest rates being achieved with spacer 15.5 and the top strand of the donor DNA. For both spacers, the donor DNA derived from the top strand of the template resulted in higher levels of HDR, though it is not yet clear whether this is a consistent characteristic of ssDNA templates in this system.

Example 26. Simultaneous Editing at B2M and TRAC Loci

Methods and Materials

RNPs were assembled as described above with CasX 491 and guides 174.7.9, 174.7.37, and 174.15.3. RNPs were purified using anion exchange, rather than size-exclusion chromatography.

Electroporations were carried out largely as described above. Co-electroporations of RNPs targeting B2M and TRAC were carried out by mixing equimolar amounts of each RNP in a final volume of 5 uL. RNP doses were made in 2-fold dilutions from 20 pmol to 0.3725 pmol for each RNP alone, and from 20 pmol to 0.625 pmol for the co-electroporation conditions. Molar amounts refer to the individual RNPs, rather than the combined amount of both RNPs in a condition. When measuring TRAC knockout only, a background correction was applied as described above. When determining the fraction of double-knockouts, we assumed that editing at TRAC and B2M were independent of each other and the TCR state of the cell and applied the formula $DblNeg_c=(DblNeg_{obs}-TCRNeg_{ctrl}*HLANeg_{obs})/(1-TCRNeg_{ctrl})$, where $DblNeg_c$ is the corrected double negative fraction, $DblNeg_{obs}$ is the observed TCR-/HLA-fraction for a given sample, $TCRNeg_{ctrl}$ is the total TCR—fraction in the buffer only control, and $HLANeg_{obs}$ is the observed total HLA—fraction for a given sample.

Results

Figure 34:
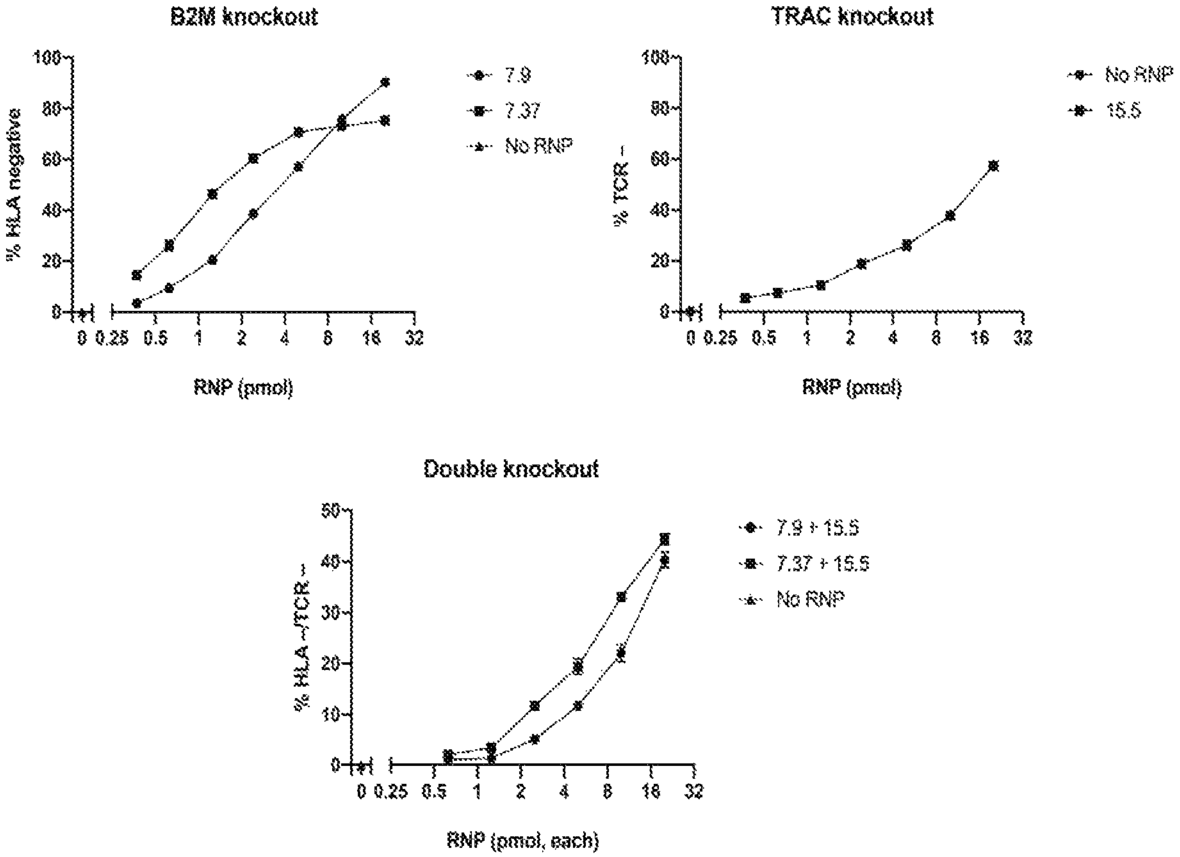
FIG. 34 shows the results of co-editing of B2M and TRAC loci, as described in Example 26. Jurkat cells were electroporated with the indicated dose of RNP, and editing of B2M and TRAC was identified by staining for HLA-1 and TCR a/P and detected by flow cytometry.

Editing at B2M and TRAC showed a good dose response across varying RNP levels. Editing at the TRAC locus was generally lower than at the B2M locus, with a maximum editing rate of 57% (FIG. 34). Double-knockout rates reached 45% at the highest RNP dose. The double-knockout rates at each dose are consistent with the expectation that the two loci are edited independently. The rate of co-editing could likely continue to be improved by increasing the dose of TRAC-targeting RNP to compensate for the reduced efficiency of editing at that site.

SEQUENCE LISTING (55572 sequences)

SEQ ID NO: 1 - protein, 986 aa, Unknown
  Deltaproteobacteria sp.
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 2 - protein, 978 aa, Unknown
  Planctomycetes sp.
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 3 - protein, 855 aa, Unknown
  Candidatus Sungbacteria sp.
MDNANKPSTKSLVNTTRISDHFGVTPGQVTRVFSFGIIPTKRQYAIIERWFAAVEAARERLYGMLYAHFQENPPAYLKEKFSYETFFKGRPVLNGLRDIDPTIMTSAVFTALRHKAEGAMAAFHTNHRRLFEEARKKMREYAECLKANEALLRGAADIDWDKIVNALRTRLNTCLAPEYDAVIADFGALCAFRALIAETNALKGAYNHALNQMLPALVKVDEPEEAEESPRLRFFNGRINDLPKFPVAERETPPDTETIIRQLEDMARVIPDTAEILGYIHRIRHKAARRKPGSAVPLPQRVALYCAIRMERNPEEDPSTVAGHFLGEIDRVCEKRRQGLVRTPFDSQIRARYMDIISFRATLAHPDRWTEIQFLRSNAASRRVRAETISAPFEGFSWTSNRTNPAPQYGMALAKDANAPADAPELCICLSPSSAAFSVREKGGDLIYMRPTGGRRGKDNPGKEITWVPGSFDEYPASGVALKLRLYFGRSQARRMLTNKTWGLLSDNPRVFAANAELVGKKRNPQDRWKLFFHMVISGPPPVEYLDFSSDVRSRARTVIGINRGEVNPLAYAVVSVEDGQVLEEGLLGKKEYIDQLIETRRRISEYQSREQTPPRDLRQRVRHLQDTVLGSARAKIHSLIAFWKGILAIERLDDQFHGREQKIIPKKTYLANKTGFMNALSFSGAVRVDKKGNPWGGMIEIYPGGISRTCTQCGTVWLARRPKNPGHRDAMVVIPDIVDDAAATGFDNVDCDAGTVDYGELFTLSREWVRLTPRYSRVMRGTLGDLERAIRQGDDRKSRQMLELALEPQPQWGQFFCHRCGFNGQSDVLAATNLARRAISLIRRLPDTDTPPTP

SEQ ID NO: 4 - RNA, 108 nt, Artificial Sequence
  gRNA sequence
acaucuggcgcguuuauuccauuacuuuggagccagucccagcgacuaugucguauggacgaagcgcuuauuuaucggagagaaaccgauaaguaaaacgcaucaaag

SEQ ID NO: 5 - RNA, 108 nt, Artificial Sequence
  gRNA sequence
uacuggcgcuuuuaucucauuacuuugagagccaucaccagcgacuaugucguauggguaaagcgcuuauuuaucggagagaaauccgauaaauaagaagcaucaaag

SEQ ID NO: 6 - RNA, 81 nt, Artificial Sequence
  gRNA sequence
acaucuggcgcguuuauuccauuacuuuggagccagucccagcgacuaugucguauggacgaagcgcuuauuuaucggaga

SEQ ID NO: 7 - RNA, 78 nt, Artificial Sequence
  gRNA sequence
acaucuggcgcguuuauuccauuacuuuggagccagucccagcgacuaugucguauggacgaagcgcuuauuuaucgg

SEQ ID NO: 8 - RNA, 80 nt, Artificial Sequence
  gRNA sequence
uacuggcgcuuuuaucucauuacuuugagagccaucaccagcgacuaugucguauggguaaagcgcuuauuuaucggaga

SEQ ID NO: 9 - RNA, 77 nt, Artificial Sequence
  gRNA sequence
uacuggcgcuuuuaucucauuacuuugagagccaucaccagcgacuaugucguauggguaaagcgcuuauuuaucgg

SEQ ID NO: 10 - RNA, 25 nt, Artificial Sequence
  gRNA sequence
guuuacacacucccucucauagggu

SEQ ID NO: 11 - RNA, 25 nt, Artificial Sequence
  gRNA sequence
guuuacacacucccucucaugaggu

SEQ ID NO: 12 - RNA, 25 nt, Artificial Sequence
  gRNA sequence
uuuuacauacccccucucaugggau

SEQ ID NO: 13 - RNA, 25 nt, Artificial Sequence
  gRNA sequence
guuuacacacucccucucauggggg

SEQ ID NO: 14 - RNA, 20 nt, Artificial Sequence
  gRNA sequence
ccagcgacuaugucguaugg

SEQ ID NO: 15 - RNA, 39 nt, Artificial Sequence
  gRNA sequence
gcgcuuauuuaucggagagaaauccgauaaauaagaagc

SEQ ID NO: 16 - RNA, 74 nt, Artificial Sequence
  gRNA sequence
ggcgcuuuuaucucauuacuuugagagccaucaccagcgacuaugucguauggguaaagcgcuuauuuaucgga

SEQ ID NO: 17 - DNA, 20 bp, Artificial Sequence
  spacer target sequence
tgtggtcggggtagcggctg

SEQ ID NO: 18 - DNA, 20 bp, Artificial Sequence
  spacer target sequence
tcaagtccgccatgcccgaa

SEQ ID NO: 19 - RNA, 21 nt, Artificial Sequence
  stem loop sequence
  misc_feature (4)..(18): n is any ribonucleotide
  misc_feature (8)..(18): These individual nucleotides may be absent
uuunnnnnnnnnnnnnnnuuu

SEQ ID NO: 20 - RNA, 20 nt, Artificial Sequence
  scaffold stem loop
ccagcgacuaugucguaugg

SEQ ID NO: 21 - RNA, 39 nt, Artificial Sequence; identical to SEQ ID NO: 15
  extended stem loop

SEQ ID NO: 22 - RNA, 81 nt, Unknown; identical to SEQ ID NO: 6
  Deltaproteobacter sp.

SEQ ID NO: 23 - RNA, 78 nt, Unknown; identical to SEQ ID NO: 7
  Deltaproteobacter sp.

SEQ ID NO: 24 - RNA, 23 nt, Unknown
  Deltaproteobacter sp.
ccgauaaguaaaacgcaucaaag

SEQ ID NO: 25 - RNA, 80 nt, Unknown; identical to SEQ ID NO: 8
  Planctomycetes sp.

SEQ ID NO: 26 - RNA, 77 nt, Unknown; identical to SEQ ID NO: 9
  Planctomycetes sp.

SEQ ID NO: 27 - RNA, 26 nt, Unknown
  Planctomycetes sp.
ucuccgauaaauaagaagcaucaaag

SEQ ID NO: 28 - RNA, 25 nt, Unknown
  Candidatus Sungbacteria sp.
guuuacacacucccucucauagggu

SEQ ID NO: 29 - RNA, 25 nt, Unknown
  Candidatus Sungbacteria sp.
guuuacacacucccucucaugaggu

SEQ ID NO: 30 - RNA, 25 nt, Unknown
  Candidatus Sungbacteria sp.
uuuuacauacccccucucaugggau

SEQ ID NO: 31 - RNA, 25 nt, Unknown
  Candidatus Sungbacteria sp.
guuuacacacucccucucauggggg

SEQ ID NO: 32 - RNA, 21 nt, Artificial Sequence
  extended stem loop
ccagcgacuaugucguagugg

SEQ ID NO: 33 - RNA, 89 nt, Artificial Sequence
  gNA scaffold
acuggcgcuuuuaucugauuacuuugagagccaucaccagcgacuaugucguaguggguaaagcucccucuucggagggagcaucaaag

SEQ ID NO: 34 - RNA, 31 nt, Artificial Sequence
  stem loop sequence
  misc_feature (4)..(28): n is any ribonucleotide
  misc_feature (8)..(28): These individual nucleotides may be absent
uuunnnnnnnnnnnnnnnnnnnnnnnnnuuu

SEQ ID NO: 35 - RNA, 19 nt, Unknown
  exogenous stem loop region
acaugaggauuacccaugu

SEQ ID NO: 36 - RNA, 18 nt, Unknown
  exogenous stem loop region
ugcaugucuaagacagca

SEQ ID NO: 37 - RNA, 20 nt, Unknown
  exogenous stem loop region
aauccauugcacuccggauu

SEQ ID NO: 38 - RNA, 12 nt, Unknown
  exogenous stem loop region
ccucuucggagg

SEQ ID NO: 39 - RNA, 21 nt, Unknown
  exogenous stem loop region
aggaguuucuauggaaacccu

SEQ ID NO: 40 - RNA, 30 nt, Unknown
  exogenous stem loop region
aggugggacgaccucucggucguccuaucu

SEQ ID NO: 41 - RNA, 19 nt, Unknown
  exogenous stem loop region
ugcucgcuccguucgagca

SEQ ID NO: 42 - RNA, 21 nt, Unknown
  exogenous stem loop region
ugcucgacgcguccucgagca

SEQ ID NO: 43 - RNA, 22 nt, Unknown
  exogenous stem loop region
ugcucguuugcggcuacgagca

SEQ ID NO: 44 - RNA, 17 nt, Unknown
  exogenous stem loop region
agggagggagggagagg

SEQ ID NO: 45 - RNA, 19 nt, Unknown
  exogenous stem loop region
gguuaggguuaggguuagg

SEQ ID NO: 46 - RNA, 25 nt, Unknown
  exogenous stem loop region
cugcucaguacgagaggaaccgcag

SEQ ID NO: 47 - RNA, 78 nt, Unknown
  exogenous stem loop region
uacacugggaucgcugaauuagagaucggcguccuuucauucuauauacuuuggaguuuuaaaaugucucuaaguaca

SEQ ID NO: 48 - protein, 4 aa, Unknown
  zinc finger/ribbon domain
  MISC_FEATURE (2)..(3): Xaa is any amino acid
CXXC

SEQ ID NO: 49 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 50 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLRSQEYKKYQTNKTTGNTDKRAFVETWQSFYRKKLKEVWKPAV

SEQ ID NO: 51 - protein, 985 aa, Artificial Sequence
  CasX Variant
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 52 - protein, 986 aa, Artificial Sequence
  CasX Variant
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLNSNSTEFKSYKSGKQPFVGAWQAFYKRRLKEVWKPNA

SEQ ID NO: 53 - protein, 921 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHA

SEQ ID NO: 54 - protein, 920 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHA

SEQ ID NO: 55 - protein, 977 aa, Artificial Sequence
  CasX Variant
MQEIKRINKIRRRLVKDSNTKKAGKTGPMKTLLVRVMTPDLRERLENLRKKPENIPQPISNNAANNLRMLLDDYTKMKEAILQVYWQEFKDDHVGLMCKFAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 56 - protein, 986 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57 - protein, 925 aa, Artificial Sequence
  CasX Variant
MISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 58 - protein, 975 aa, Artificial Sequence
  CasX Variant
MEKRINKIRKKLSADNATKPVSRSGPMKTLLVRVMTDDLKKRLEKRRKKPEVMPQVISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 59 - protein, 982 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 60 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 61 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFAAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPA

SEQ ID NO: 62 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 63 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDQLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 64 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFQAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 65 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLIAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTVRDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 66 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFNAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 67 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTTRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 68 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGSLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 69 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 70 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEKEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 71 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 72 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 73 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFNAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 74 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSESDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 75 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 76 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGDPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 77 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEFLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 78 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTVRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 79 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTVRDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 80 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 81 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIIIEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFNAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 82 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAKTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 83 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRNEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 84 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIMENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 85 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 86 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 87 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 88 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 89 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQVRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 90 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 91 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 92 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 93 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 94 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 95 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 96 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 97 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 98 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQLGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 99 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 100 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 101 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 102 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFSRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTLLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 103 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 104 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 105 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 106 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 107 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 108 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPNDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 109 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLANDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 110 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 111 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 112 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPNDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 113 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 114 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 115 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSENDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 116 - protein, 977 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 117 - protein, 976 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 118 - protein, 977 aa, Artificial Sequence; identical to SEQ ID NO: 72
  CasX Variant

SEQ ID NO: 119 - protein, 977 aa, Artificial Sequence; identical to SEQ ID NO: 72
  CasX Variant

SEQ ID NO: 120 - protein, 977 aa, Artificial Sequence; identical to SEQ ID NO: 72
  CasX Variant

SEQ ID NO: 121 - protein, 977 aa, Artificial Sequence; identical to SEQ ID NO: 72
  CasX Variant

SEQ ID NO: 122 - protein, 977 aa, Artificial Sequence; identical to SEQ ID NO: 72
  CasX Variant

SEQ ID NO: 123 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTMSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 124 - protein, 977 aa, Artificial Sequence; identical to SEQ ID NO: 72
  CasX Variant

SEQ ID NO: 125 - protein, 977 aa, Artificial Sequence; identical to SEQ ID NO: 72
  CasX Variant

SEQ ID NO: 126 - protein, 977 aa, Artificial Sequence; identical to SEQ ID NO: 72
  CasX Variant

SEQ ID NO: 127 - protein, 977 aa, Artificial Sequence; identical to SEQ ID NO: 72
  CasX Variant

SEQ ID NO: 128 - protein, 977 aa, Artificial Sequence; identical to SEQ ID NO: 72
  CasX Variant

SEQ ID NO: 129 - protein, 977 aa, Artificial Sequence; identical to SEQ ID NO: 72
  CasX Variant

SEQ ID NO: 130 - protein, 977 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 131 - protein, 976 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 132 - protein, 976 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 133 - protein, 976 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 134 - protein, 976 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 135 - protein, 977 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 136 - protein, 977 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 137 - protein, 977 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 138 - protein, 977 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 139 - protein, 977 aa, Artificial Sequence
  CasX Variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 140 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLGVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 141 - protein, 986 aa, Artificial Sequence; identical to SEQ ID NO: 56
  CasX Variant

SEQ ID NO: 142 - protein, 978 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 143 - protein, 972 aa, Artificial Sequence
  CasX Variant
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLNSNSTEFKSYKSGKQPFVGAWQAFYKRRLKEVWKPNA

SEQ ID NO: 144 - protein, 84 aa, Artificial Sequence
  chloroplast transit peptide
MASMISSSAVTTVSRASRGQSAAMAPFGGLKSMTGFPVRKVNTDITSITSNGGRVKCMQVWPPIGKKKFETLSYLPPLTRDSRA

SEQ ID NO: 145 - protein, 57 aa, Artificial Sequence
  chloroplast transit peptide
MASMISSSAVTTVSRASRGQSAAMAPFGGLKSMTGFPVRKVNTDITSITSNGGRVKS

SEQ ID NO: 146 - protein, 85 aa, Artificial Sequence
  chloroplast transit peptide
MASSMLSSATMVASPAQATMVAPFNGLKSSAAFPATRKANNDITSITSNGGRVNCMQVWPPIEKKKFETLSYLPDLTDSGGRVNC

SEQ ID NO: 147 - protein, 76 aa, Artificial Sequence
  chloroplast transit peptide
MAQVSRICNGVQNPSLISNLSKSSQRKSPLSVSLKTQQHPRAYPISSSWGLKKSGMTLIGSELRPLKVMSSVSTAC

SEQ ID NO: 148 - protein, 76 aa, Artificial Sequence
  chloroplast transit peptide
MAQVSRICNGVWNPSLISNLSKSSQRKSPLSVSLKTQQHPRAYPISSSWGLKKSGMTLIGSELRPLKVMSSVSTAC

SEQ ID NO: 149 - protein, 72 aa, Artificial Sequence
  chloroplast transit peptide
MAQINNMAQGIQTLNPNSNFHKPQVPKSSSFLVFGSKKLKNSANSMLVLKKDSIFMQLFCSFRISASVATAC

SEQ ID NO: 150 - protein, 69 aa, Artificial Sequence
  chloroplast transit peptide
MAALVTSQLATSGTVLSVTDRFRRPGFQGLRPRNPADAALGMRTVGASAAPKQSRKPHRFDRRCLSMVV

SEQ ID NO: 151 - protein, 77 aa, Artificial Sequence
  chloroplast transit peptide
MAALTTSQLATSATGFGIADRSAPSSLLRHGFQGLKPRSPAGGDATSLSVTTSARATPKQQRSVQRGSRRFPSVVVC

SEQ ID NO: 152 - protein, 57 aa, Artificial Sequence
  chloroplast transit peptide
MASSVLSSAAVATRSNVAQANMVAPFTGLKSAASFPVSRKQNLDITSIASNGGRVQC

SEQ ID NO: 153 - protein, 65 aa, Artificial Sequence
  chloroplast transit peptide
MESLAATSVFAPSRVAVPAARALVRAGTVVPTRRTSSTSGTSGVKCSAAVTPQASPVISRSAAAA

SEQ ID NO: 154 - protein, 72 aa, Artificial Sequence
  chloroplast transit peptide
MGAAATSMQSLKFSNRLVPPSRRLSPVPNNVTCNNLPKSAAPVRTVKCCASSWNSTINGAAATTNGASAASS

SEQ ID NO: 155 - protein, 20 aa, Unknown
  endosomal escape polypeptide
  SITE (4)..(4): Xaa can be any naturally occurring amino acid
  SITE (8)..(8): Xaa can be any naturally occurring amino acid
  SITE (11)..(11): Xaa can be any naturally occurring amino acid
  SITE (15)..(15): Xaa can be any naturally occurring amino acid
  SITE (19)..(19): Xaa can be any naturally occurring amino acid
GLFXALLXLLXSLWXLLLXA

SEQ ID NO: 156 - protein, 20 aa, Unknown
  endosomal escape polypeptide
GLFHALLHLLHSLWHLLLHA

SEQ ID NO: 157 - protein, 9 aa, Unknown
  endosomal escape polypeptide
HHHHHHHHH

SEQ ID NO: 158 - protein, 7 aa, Betapolyomavirus macaca mulatta polyomavirus 1
PKKKRKV

SEQ ID NO: 159 - protein, 16 aa, Unknown
  nuclear localization signal
KRPAATKKAGQAKKKK

SEQ ID NO: 160 - protein, 9 aa, Homo sapiens
PAAKRVKLD

SEQ ID NO: 161 - protein, 11 aa, Homo sapiens
RQRRNELKRSP

SEQ ID NO: 162 - protein, 38 aa, Unknown
  nuclear localization signal
NQSSNFGPMKGGNFGGRSSGPYGGGGQYFAKPRNQGGY

SEQ ID NO: 163 - protein, 42 aa, Unknown
  nuclear localization signal
RMRIZFKNKGKDTAELRRRRVEVSVELRKAKKDEQILKRRNV

SEQ ID NO: 164 - protein, 8 aa, Unknown
  nuclear localization signal
VSRKRPRP

SEQ ID NO: 165 - protein, 8 aa, Unknown
  nuclear localization signal
PPKKARED

SEQ ID NO: 166 - protein, 8 aa, Homo sapiens
PQPKKKPL

SEQ ID NO: 167 - protein, 12 aa, Mus musculus
SALIKKKKKMAP

SEQ ID NO: 168 - protein, 5 aa, Alphainfluenzavirus influenza A virus
DRLRR

SEQ ID NO: 169 - protein, 7 aa, Alphainfluenzavirus influenza A virus
PKQKKRK

SEQ ID NO: 170 - protein, 10 aa, Deltavirus  hepatitis delta virus
RKLKKKIKKL

SEQ ID NO: 171 - protein, 10 aa, Mus musculus
REKKKFLKRR

SEQ ID NO: 172 - protein, 20 aa, Homo sapiens
KRKGDEVDGVDEVAKKKSKK

SEQ ID NO: 173 - protein, 17 aa, Homo sapiens
RKCLQAGMNLEARKTKK

SEQ ID NO: 174 - protein, 8 aa, Orthobornavirus mammalian 1 orthobornavirus
PRPRKIPR

SEQ ID NO: 175 - protein, 9 aa, Hepacivirus  hepacivirus C
PPRKKRTVV

SEQ ID NO: 176 - protein, 12 aa, Unknown
  nuclear localization signal
NLSKKKKRKREK

SEQ ID NO: 177 - protein, 10 aa, Unknown
  nuclear localization signal
RRPSRPFRKP

SEQ ID NO: 178 - protein, 8 aa, Lymphocryptovirus human gammaherpesvirus 4
KRPRSPSS

SEQ ID NO: 179 - protein, 19 aa, Alphainfluenzavirus influenza A virus
KRGINDRNFWRGENERKTR

SEQ ID NO: 180 - protein, 11 aa, Homo sapiens
PRPPKMARYDN

SEQ ID NO: 181 - protein, 8 aa, Unknown
  nuclear localization signal
KRSFSKAF

SEQ ID NO: 182 - protein, 9 aa, Unknown
  nuclear localization signal
KLKIKRPVK

SEQ ID NO: 183 - protein, 19 aa, Unknown
  nuclear localization signal
PKKKRKVPPPPAAKRVKLD

SEQ ID NO: 184 - protein, 17 aa, Deltaretrovirus human T-lymphotropic virus 1
PKTRRRPRRSQRKRPPT

SEQ ID NO: 185 - protein, 25 aa, Caenorhabditis elegans
MSRRRKANPTKLSENAKKLAKEVEN

SEQ ID NO: 186 - protein, 16 aa, Unknown
  nuclear localization signal
KTRRRPRRSQRKRPPT

SEQ ID NO: 187 - protein, 13 aa, Unknown
  nuclear localization signal
RRKKRRPRRKKRR

SEQ ID NO: 188 - protein, 14 aa, Unknown
  nuclear localization signal
PKKKSRKPKKKSRK

SEQ ID NO: 189 - protein, 17 aa, Unknown
  nuclear localization signal
HKKKHPDASVNFSEFSK

SEQ ID NO: 190 - protein, 18 aa, Unknown
  nuclear localization signal
QRPGPYDRPQRPGPYDRP

SEQ ID NO: 191 - protein, 16 aa, Unknown
  nuclear localization signal
LSPSLSPLLSPSLSPL

SEQ ID NO: 192 - protein, 18 aa, Unknown
  nuclear localization signal
RGKGGKGLGKGGAKRHRK

SEQ ID NO: 193 - protein, 14 aa, Unknown
  nuclear localization signal
PKRGRGRPKRGRGR

SEQ ID NO: 194 - protein, 17 aa, Unknown
  nuclear localization signal
PKKKRKVPPPPKKKRKV

SEQ ID NO: 195 - protein, 11 aa, Human immunodeficiency virus 1
YGRKKRRQRRR

SEQ ID NO: 196 - protein, 8 aa, Human immunodeficiency virus 1
RKKRRQRR

SEQ ID NO: 197 - protein, 11 aa, Human immunodeficiency virus 1
YARAAARQARA

SEQ ID NO: 198 - protein, 11 aa, Human immunodeficiency virus 1
THRLPRRRRRR

SEQ ID NO: 199 - protein, 11 aa, Human immunodeficiency virus 1
GGRRARRRRRR

SEQ ID NO: 200 - protein, 50 aa, Artificial Sequence
  peptide transduction domain
  MISC_FEATURE (4)..(50): These individual amino acid residues may be present or absent
RRRRRRRRRRRRRRRRRRRRRRRRRRRRRRRRRRRRRRRRRRRRRRRRRR

SEQ ID NO: 201 - protein, 12 aa, Artificial Sequence
  peptide transduction domain
RRQRRTSKLMKR

SEQ ID NO: 202 - protein, 27 aa, Artificial Sequence
  peptide transduction domain
GWTLNSAGYLLGKINLKALAALAKKIL

SEQ ID NO: 203 - protein, 33 aa, Artificial Sequence
  peptide transduction domain
KALAWEAKLAKALAKALAKHLAKALAKALKCEA

SEQ ID NO: 204 - protein, 16 aa, Artificial Sequence
  peptide transduction domain
RQIKIWFQNRRMKWKK

SEQ ID NO: 205 - protein, 5 aa, Artificial Sequence
  linker polypeptide
GSGGS

SEQ ID NO: 206 - protein, 6 aa, Artificial Sequence
  linker polypeptide
GGSGGS

SEQ ID NO: 207 - protein, 4 aa, Artificial Sequence
  linker polypeptide
GGGS

SEQ ID NO: 208 - protein, 4 aa, Artificial Sequence
  linker polypeptide
GGSG

SEQ ID NO: 209 - protein, 5 aa, Artificial Sequence
  linker polypeptide
GGSGG

SEQ ID NO: 210 - protein, 5 aa, Artificial Sequence
  linker polypeptide
GSGSG

SEQ ID NO: 211 - protein, 5 aa, Artificial Sequence
  linker polypeptide
GSGGG

SEQ ID NO: 212 - protein, 5 aa, Artificial Sequence
  linker polypeptide
GGGSG

SEQ ID NO: 213 - protein, 5 aa, Artificial Sequence
  linker polypeptide
GSSSG

SEQ ID NO: 214 - protein, 4 aa, Artificial Sequence
  linker polypeptide
GPGP

SEQ ID NO: 215 - protein, 6 aa, Artificial Sequence
  linker polypeptide
PPAPPA

SEQ ID NO: 216 - protein, 7 aa, Artificial Sequence
  linker polypeptide
PPPGPPP

SEQ ID NO: 217 - protein, 119 aa, Artificial Sequence [sequence omitted]

SEQ ID NO: 218 - protein, 107 aa, Artificial Sequence
  Antibody VL sequence
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITR

SEQ ID NO: 219 - protein, 122 aa, Artificial Sequence [sequence omitted]

SEQ ID NO: 220 - protein, 107 aa, Artificial Sequence [sequence omitted]

SEQ ID NO: 221 - protein, 119 aa, Artificial Sequence
  Antibody VH sequence
QVQLVQSGGGVVQPGRSLRLSCKASGYTFTSYTMHWVRQAPGKGLEWIGYINPSSGYTKYNQKFKDRFTISADKSKSTAFLQMDSLRPEDTGVYFCARWQDYDVYFDYWGQGTPVTVSS

SEQ ID NO: 222 - protein, 107 aa, Artificial Sequence
  Antibody VL sequence
DIQMTQSPSSLSASVGDRVTMTCRASSSVSYMHWYQQTPGKAPKPWIYATSNLASGVPSRFSGSGSGTDYTLTISSLQPEDIATYYCQQWSSNPPTFGQGTKLQITR

SEQ ID NO: 223 - protein, 119 aa, Artificial Sequence [sequence omitted]

SEQ ID NO: 224 - protein, 107 aa, Artificial Sequence
  Antibody VL sequence
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 225 - protein, 119 aa, Artificial Sequence
  Antibody VH sequence
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 226 - protein, 106 aa, Artificial Sequence
  Antibody VL sequence
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 227 - protein, 119 aa, Artificial Sequence
  Antibody VH sequence
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 228 - protein, 106 aa, Artificial Sequence
  Antibody VL sequence
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 229 - protein, 125 aa, Artificial Sequence
  Antibody VH sequence
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 230 - protein, 109 aa, Artificial Sequence
  Antibody VL sequence
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 231 - protein, 125 aa, Artificial Sequence
  Antibody VH sequence
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 232 - protein, 109 aa, Artificial Sequence
  Antibody VL sequence
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 233 - protein, 125 aa, Artificial Sequence
  Antibody VH sequence
EVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 234 - protein, 109 aa, Artificial Sequence
  Antibody VL sequence
ELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVL

SEQ ID NO: 235 - protein, 125 aa, Artificial Sequence
  Antibody VH sequence
EVKLLESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSS

SEQ ID NO: 236 - protein, 109 aa, Artificial Sequence
  Antibody VL sequence
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 237 - protein, 123 aa, Artificial Sequence [sequence omitted]

SEQ ID NO: 238 - protein, 106 aa, Artificial Sequence [sequence omitted]

SEQ ID NO: 239 - protein, 122 aa, Artificial Sequence
  Antibody VH sequence
EVQLVESGGGLVQPGGSLRLSCAASGFTFSSYDIHWVRQATGKGLEWVSAIGPAGDTYYPGSVKGRFTISRENAKNSLYLQMNSLRAGDTAVYYCARGLITFGGLIAPFDYWGQGTLVTVSS

SEQ ID NO: 240 - protein, 107 aa, Artificial Sequence
  Antibody VL sequence
EIVLTQSPGTLSLSPGERATLSCRASQSVSSTYLAWYQQKPGQAPRLLIYGASSRATGIPDRFSGSGSGTDFTLTISRLEPEDFAVYYCQHYDNSQTFGQGTKVEIK

SEQ ID NO: 241 - protein, 120 aa, Artificial Sequence
  Antibody VH sequence
QVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSS

SEQ ID NO: 242 - protein, 106 aa, Artificial Sequence
  Antibody VL sequence
ENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIK

SEQ ID NO: 243 - protein, 121 aa, Artificial Sequence
  Antibody VH sequence
EVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSS

SEQ ID NO: 244 - protein, 111 aa, Artificial Sequence
  Antibody VL sequence
DIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIK

SEQ ID NO: 245 - protein, 121 aa, Artificial Sequence
  Antibody VH sequence
EVQLVESGGGLVQPGGSLRLSCAASGFNIKDTYMHWVRQAPGKGLEWVARIDPANGNSKYVPKFQGRATISADTSKNTAYLQMNSLRAEDTAVYYCAPFGYYVSDYAMAYWGQGTLVTVSS

SEQ ID NO: 246 - protein, 111 aa, Artificial Sequence; identical to SEQ ID NO: 244
  Antibody VL sequence

SEQ ID NO: 247 - protein, 119 aa, Artificial Sequence
  Antibody VH sequence
EVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSS

SEQ ID NO: 248 - protein, 106 aa, Artificial Sequence
  Antibody VL sequence
DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIK

SEQ ID NO: 249 - protein, 121 aa, Artificial Sequence
  Antibody VH sequence
EVKLVESGGGLVQPGGSLRLSCATSGFTFTDYYMNWVRQPPGKALEWLGFIGNKANGYTTEYSASVKGRFTISRDKSQSILYLQMNTLRAEDSATYYCTRDRGLRFYFDYWGQGTTLTVSS

SEQ ID NO: 250 - protein, 107 aa, Artificial Sequence
  Antibody VL sequence
QTVLSQSPAILSASPGEKVTMTCRASSSVTYIHWYQQKPGSSPKSWIYATSNLASGVPARFSGSGSGTSYSLTISRVEAEDAATYYCQHWSSKPPTFGGGTKLEIKR

SEQ ID NO: 251 - protein, 121 aa, Artificial Sequence
  Antibody VH sequence
EVQLVESGGGLVQPGRSLRLSCAASGFTVSSYWMHWVRQAPGKGLEWVGFIRNKANGGTTEYAASVKGRFTISRDDSKNTLYLQMNSLRAEDTAVYYCARDRGLRFYFDYWGQGTTVTVSS

SEQ ID NO: 252 - protein, 116 aa, Artificial Sequence
  Antibody VL sequence
QAVLTQPASLSASPGASASLTCTLRRGINVGAYSIYWYQQKPGSPPQYLLRYKSDSDKQQGSGVSSRFSASKDASANAGILLISGLQSEDEADYYCMIWHSGASAVFGGGTKLTVL

SEQ ID NO: 253 - protein, 124 aa, Artificial Sequence
  Antibody VH sequence
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 254 - protein, 111 aa, Artificial Sequence
  Antibody VL sequence
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 255 - protein, 122 aa, Artificial Sequence
  Antibody VH sequence
EVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 256 - protein, 107 aa, Artificial Sequence
  Antibody VL sequence
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIK

SEQ ID NO: 257 - protein, 122 aa, Artificial Sequence
  Antibody VH sequence
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSG

SEQ ID NO: 258 - protein, 106 aa, Artificial Sequence [sequence omitted]

SEQ ID NO: 259 - protein, 119 aa, Artificial Sequence
  Antibody VH sequence
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 260 - protein, 112 aa, Artificial Sequence
  Antibody VL sequence
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIK

SEQ ID NO: 261 - protein, 122 aa, Artificial Sequence [sequence omitted]

SEQ ID NO: 262 - protein, 106 aa, Artificial Sequence [sequence omitted]

SEQ ID NO: 263 - protein, 121 aa, Artificial Sequence [sequence omitted]

SEQ ID NO: 264 - protein, 106 aa, Artificial Sequence [sequence omitted]

SEQ ID NO: 265 - protein, 122 aa, Artificial Sequence [sequence omitted]

SEQ ID NO: 266 - protein, 106 aa, Artificial Sequence [sequence omitted]

SEQ ID NO: 267 - protein, 114 aa, Artificial Sequence
  Antibody VH sequence
QLVQSGAEVKKPGSSVKVSCKASGYTITDSNIHWVRQAPGQSLEWIGYIYPYNGGTDYNQKFKNRATLTVDNPTNTAYMELSSLRSEDTDFYYCVNGNPWLAYWGQGTLVTVSS

SEQ ID NO: 268 - protein, 111 aa, Artificial Sequence [sequence omitted]

SEQ ID NO: 269 - protein, 122 aa, Artificial Sequence [sequence omitted]

SEQ ID NO: 270 - protein, 107 aa, Artificial Sequence [sequence omitted]

SEQ ID NO: 271 - protein, 118 aa, Artificial Sequence
  Antibody VH sequence
QIQLVQSGPEVKKPGETVKISCKASGYTFTNYGMNWVKQAPGKGLKWMGWINTYTGEPTYADAFKGRFAFSLETSASTAYLQINNLKNEDTATYFCARDYGDYGMDYWGQGTSVTVSS

SEQ ID NO: 272 - protein, 111 aa, Artificial Sequence
  Antibody VL sequence
DIVLTQSPASLAVSLGQRATISCRASKSVSTSGYSFMHWYQQKPGQPPKLLIYLASNLESGVPARFSGSGSGTDFTLNIHPVEEEDAATYYCQHSREVPWTFGGGTKLEIK

SEQ ID NO: 273 - protein, 118 aa, Artificial Sequence
  Antibody VH sequence
QVQLQQSGTELMTPGASVTMSCKTSGYTFSTYWIEWVKQRPGHGLEWIGEILGPSGYTDYNEKFKAKATFTADTSSNTAYMQLSSLASEDSAVYYCARWDRLYAMDYWGGGTSVTVSS

SEQ ID NO: 274 - protein, 111 aa, Artificial Sequence
  Antibody VL sequence
DIVLTQSPASLTVSLGQKTTISCRASKSVSTSGYSFMHWYQLKPGQSPKLLIYLASDLPSGVPARFSGSGSGTDFTLKIHPVEEEDAATYYCQHSREIPYTFGGGTKLEIT

SEQ ID NO: 275 - protein, 118 aa, Artificial Sequence
  Antibody VH sequence
QVQLVESGGGVVQPGRSLRLSCAASGFTFSSYIMHWVRQAPGKGLEWVAVISYDGRNKYYADSVKGRFTISRDNSKNTLYLQMNSLRAEDTAVYYCARDTDGYDFDYWGQGTLVTVSS

SEQ ID NO: 276 - protein, 107 aa, Artificial Sequence
  Antibody VL sequence
EIVLTQSPATLSLSPGERATLSCRASQSVSSYLAWYQQKPGQAPRLLIYDASNRATGIPARFSGSGSGTDFTLTISSLEPEDFAVYYCQQRTNWPLTFGGGTKVEIK

SEQ ID NO: 277 - protein, 119 aa, Artificial Sequence
  Antibody VH sequence
QIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSS

SEQ ID NO: 278 - protein, 107 aa, Artificial Sequence
  Antibody VL sequence
AIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIK

SEQ ID NO: 279 - protein, 118 aa, Artificial Sequence
  Antibody VH sequence
QVQLVESGGGVVQPGRSLRLSCATSGFTFSDYGMHWVRQAPGKGLEWVAVIWYDGSNKYYADSVKGRFTISRDNSKKTLSLQMNSLRAEDTAVYYCARDSIMVRGDYWGQGTLVTVSS

SEQ ID NO: 280 - protein, 107 aa, Artificial Sequence
  Antibody VL sequence
DIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK

SEQ ID NO: 281 - protein, 118 aa, Artificial Sequence
  Antibody VH sequence
QVQLVESGGGVVQPGRSLRLSCAASGFTFSDHGMHWVRQAPGKGLEWVAVIWYDGSNKYYADSVKGRFTISRDNSKNTLYLQMNSLRAEDTAVYYCARDSIMVRGDYWGQGTLVTVSS

SEQ ID NO: 282 - protein, 107 aa, Artificial Sequence; identical to SEQ ID NO: 280
  Antibody VL sequence

SEQ ID NO: 283 - protein, 122 aa, Artificial Sequence
  Antibody VH sequence
QVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSS

SEQ ID NO: 284 - protein, 107 aa, Artificial Sequence
  Antibody VL sequence
EIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIK

SEQ ID NO: 285 - protein, 117 aa, Artificial Sequence
  Antibody VH sequence
QVQLVQSGAEVKKPGASVKVSCKASGYTFTSYGFSWVRQAPGQGLEWMGWISASNGNTYYAQKLQGRVTMTTDTSTSTAYMELRSLRSDDTAVYYCARVYADYADYWGQGTLVTVSS

SEQ ID NO: 286 - protein, 107 aa, Artificial Sequence
  Antibody VL sequence
DIQMTQSPSSVSASVGDRVTITCRASQGINTWLAWYQQKPGKAPKLLIYAASSLKSGVPSRFSGSGSGTDFTLTISSLQPEDFATYYCQQANSFPLTFGGGTKVEIK

SEQ ID NO: 287 - protein, 115 aa, Artificial Sequence [sequence omitted]

SEQ ID NO: 288 - protein, 108 aa, Artificial Sequence [sequence omitted]

SEQ ID NO: 289 - protein, 119 aa, Artificial Sequence [sequence omitted]

SEQ ID NO: 290 - protein, 113 aa, Artificial Sequence [sequence omitted]

SEQ ID NO: 291 - protein, 125 aa, Artificial Sequence
  Antibody VH sequence
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSS

SEQ ID NO: 292 - protein, 107 aa, Artificial Sequence
  Antibody VL sequence
DIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIK

SEQ ID NO: 293 - protein, 118 aa, Artificial Sequence
  Antibody VH sequence
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 294 - protein, 108 aa, Artificial Sequence
  Antibody VL sequence
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 295 - protein, 123 aa, Artificial Sequence
  Antibody VH sequence
QVQLQESGPGLVKPSQTLSLTCTVSGGSISSGGYYWSWIRQHPGKGLEWIGIIYYSGSTYYNPSLKSRVTISVDTSKNQFSLKLNSVTAADTAVFYCARVAIVTTIPGGMDVWGQGTTVTVSS

SEQ ID NO: 296 - protein, 107 aa, Artificial Sequence
  Antibody VL sequence
EIVLTQSPDFQSVTPKEKVTITCRASQSIGISLHWYQQKPDQSPKLLIKYASQSFSGVPSRFSGSGSGTDFTLTINSLEAEDAATYYCHQSRSFPWTFGQGTKVEIK

SEQ ID NO: 297 - protein, 120 aa, Artificial Sequence
  Antibody VH sequence
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSS

SEQ ID NO: 298 - protein, 113 aa, Artificial Sequence
  Antibody VL sequence
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIK

SEQ ID NO: 299 - protein, 127 aa, Artificial Sequence
  Antibody VH sequence
EVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSS

SEQ ID NO: 300 - protein, 107 aa, Artificial Sequence
  Antibody VL sequence
ELQMTQSPSSLSASVGDRVTITCRTSQSISSYLNWYQQKPGQPPKLLIYWASTRESGVPDRFSGSGSGTDFTLTISSLQPEDSATYYCQQSYDIPYTFGQGTKLEIK

SEQ ID NO: 301 - protein, 116 aa, Artificial Sequence
  Antibody VH sequence
QVQLQQSGAELVRPGTSVKVSCKASGYAFTNYLIEWVKQRPGQGLEWIGVINPGSGGTNYNEKFKGKATLTADKSSSTAYMQLSSLTSDDSAVYFCARDGPWFAYWGQGTLVTVSA

SEQ ID NO: 302 - protein, 107 aa, Artificial Sequence
  Antibody VL sequence
NIVMTQSPKSMSMSVGERVTLTCKASENVVTYVSWYQQKPEQSPKLLIYGASNRYTGVPDRFTGSGSATDFTLTISSVQAEDLADYHCGQGYSYPYTFGGGTKLEIK

SEQ ID NO: 303 - protein, 116 aa, Artificial Sequence
  Antibody VH sequence
QIQLVQSGPELKKPGETVKISCKASGYTFTNYGMNWVRQAPGKGLKWMGWINTYTGEPTYADDFKGRFVFSLETSASTAFLQLNNLRSEDTATYFCVRFISKGDYWGQGTSVTVSS

SEQ ID NO: 304 - protein, 106 aa, Artificial Sequence
  Antibody VL sequence
QILLTQSPAIMSASPGEKVTMTCSASSSVSYMLWYQQKPGSSPKPWIFDTSNLASGFPARFSGSGSGTSYSLIISSMEAEDAATYYCHQRSGYPYTFGGGTKLEIK

SEQ ID NO: 305 - protein, 114 aa, Artificial Sequence
  Antibody VH sequence
VQLQQSDAELVKPGASVKISCKASGYTFTDHAIHWVKQNPEQGLEWIGYFSPGNDDFKYNERFKGKATLTADKSSSTAYVQLNSLTSEDSAVYFCTRSLNMAYWGQGTSVTVSS

SEQ ID NO: 306 - protein, 113 aa, Artificial Sequence
  Antibody VL sequence
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSYPLTFGGGTKVKES

SEQ ID NO: 307 - protein, 116 aa, Artificial Sequence
  Antibody VH sequence
EVQLVQSGPEVKKPGASVKVSCKASGYTFTNYGMNWVRQAPGQGLEWMGWINTYTGEPTYGEDFKGRFAFSLDTSASTAYMELSSLRSEDTAVYFCARFGNYVDYWGQGSLVTVSS

SEQ ID NO: 308 - protein, 112 aa, Artificial Sequence
  Antibody VL sequence
DIVMTQSPLSLPVTPGEPASISCRSSINKKGSNGITYLYWYLQKPGQSPQLLIYQMSNLASGVPDRFSGSGSGTDFTLKISRVEAEDVGVYYCAQNLEIPRTFGQGTKVEIK

SEQ ID NO: 309 - protein, 116 aa, Artificial Sequence
  Antibody VH sequence
EVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSS

SEQ ID NO: 310 - protein, 112 aa, Artificial Sequence
  Antibody VL sequence
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIK

SEQ ID NO: 311 - protein, 116 aa, Artificial Sequence; identical to SEQ ID NO: 309
  Antibody VH sequence

SEQ ID NO: 312 - protein, 112 aa, Artificial Sequence
  Antibody VL sequence
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVELK

SEQ ID NO: 313 - protein, 128 aa, Artificial Sequence
  Antibody VH sequence
EVQLLESGGGLVQPGGSLRLSCAASGFTFSHYMMAWVRQAPGKGLEWVSRIGPSGGPTHYADSVKGRFTISRDNSKNTLYLQMNSLRAEDTAVYYCAGYDSGYDYVAVAGPAEYFQHWGQGTLVTVSS

SEQ ID NO: 314 - protein, 107 aa, Artificial Sequence
  Antibody VL sequence
DIQMTQSPSSLSASVGDRVTITCRASQSISTWLAWYQQKPGKAPKLLIYKASNLHTGVPSRFSGSGSGTEFSLTISGLQPDDFATYYCQQYNSYSRTFGQGTKVEIK

SEQ ID NO: 315 - protein, 119 aa, Artificial Sequence
  Antibody VH sequence
EVQLVESGGGVVQPGRSLRLSCSASGFTFSGYGLSWVRQAPGKGLEWVAMISSGGSYTYYADSVKGRFAISRDNAKNTLFLQMDSLRPEDTGVYFCARHGDDPAWFAYWGQGTPVTVSS

SEQ ID NO: 316 - protein, 110 aa, Artificial Sequence
  Antibody VL sequence
DIQLTQSPSSLSASVGDRVTITCSVSSSISSNNLHWYQQKPGKAPKPWIYGTSNLASGVPSRFSGSGSGTDYTFTISSLQPEDIATYYCQQWSSYPYMYTFGQGTKVEIK

SEQ ID NO: 317 - protein, 118 aa, Artificial Sequence
  Antibody VH sequence
QVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSS

SEQ ID NO: 318 - protein, 111 aa, Artificial Sequence
  Antibody VL sequence
DIVLTQSPLSLAVSLGQPAIISCKASQSVSFAGTSLMHWYHQKPGQQPRLLIYRASNLEAGVPDRFSGSGSKTDFTLNISPVEAEDAATYYCQQSREYPYTFGGGTKLEIK

SEQ ID NO: 319 - protein, 118 aa, Artificial Sequence; identical to SEQ ID NO: 317
  Antibody VH sequence

SEQ ID NO: 320 - protein, 111 aa, Artificial Sequence
  Antibody VL sequence
DIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIK

SEQ ID NO: 321 - protein, 109 aa, Artificial Sequence
  Antibody VH sequence
GPELVKPGASVKISCKASDYSFTGYFMNWVMQSHGKSLEWIGRIFPYNGDTFYNQKFKGRATLTVDKSSSTAHMELRSLASEDSAVYFCARGTHYFDYWGQGTTLTVSS

SEQ ID NO: 322 - protein, 100 aa, Artificial Sequence
  Antibody VL sequence
PASLSASVGETVTITCRTSENIFSYLAWYQQKQGISPQLLVYNAKTLAEGVPSRFSGSGSGTQFSLKINSLQPEDFGSYYCQHHYAFPWTFGGGSKLEIK

SEQ ID NO: 323 - protein, 115 aa, Artificial Sequence
  Antibody VH sequence
QVQLVQSGAEVKKPGASVKVSCKASGYTFTDYEMHWVRQAPGQGLEWMGALDPKTGDTAYSQKFKGRVTLTADKSTSTAYMELSSLTSEDTAVYYCTRFYSYTYWGQGTLVTVSS

SEQ ID NO: 324 - protein, 112 aa, Artificial Sequence
  Antibody VL sequence
DVVMTQSPLSLPVTPGEPASISCRSSQSLVHSNGNTYLHWYLQKPGQSPQLLIYKVSNRFSGVPDRFSGSGSGTDFTLKISRVEAEDVGVYYCSQNTHVPPTFGQGTKLEIK

SEQ ID NO: 325 - protein, 117 aa, Artificial Sequence
  Antibody VH sequence
EVQLVQSGAEVKKPGESLKISCKGSGYSFTSYWIAWVRQMPGKGLEWMGIIFPGDSDTRYSPSFQGQVTISADRSIRTAYLQWSSLKASDTALYYCARTREGYFDYWGQGTLVTVSS

SEQ ID NO: 326 - protein, 107 aa, Artificial Sequence
  Antibody VL sequence
EIVLTQSPGTLSLSPGERATLSCRAVQSVSSSYLAWYQQKPGQAPRLLIYGASSRATGIPDRFSGSGSGTDFTLTISRLEPEDFAVYYCQQYGSSPTFGGGTKVEIK

SEQ ID NO: 327 - protein, 117 aa, Artificial Sequence
  Antibody VH sequence
EVQLVQSGAEVKKPGESLKISCKGSGYSFTNYWIAWVRQMPGKGLEWMGIIYPGDSDTRYSPSFQGQVTISADKSIRTAYLQWSSLKASDTAMYYCARTREGYFDYWGQGTLVTVSS

SEQ ID NO: 328 - protein, 107 aa, Artificial Sequence
  Antibody VL sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIK

SEQ ID NO: 329 - protein, 117 aa, Artificial Sequence
  Antibody VH sequence
EVQLVQSGADVTKPGESLKISCKVSGYRFTNYWIGWMRQMSGKGLEWMGIIYPGDSDTRYSPSFQGHVTISADKSINTAYLRWSSLKASDTAIYYCARTREGFFDYWGQGTPVTVSS

SEQ ID NO: 330 - protein, 107 aa, Artificial Sequence
  Antibody VL sequence
EILLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTKVEIK

SEQ ID NO: 331 - protein, 124 aa, Artificial Sequence
  Antibody VH sequence
QVQLVESGGGVVQSGRSLRLSCAASGFTFRNYGMHWVRQAPGKGLEWVAVIWYDGSDKYYADSVRGRFTISRDNSKNTLYLQMNSLRAEDTAVYYCARDGYDILTGNPRDFDYWGQGTLVTVSS

SEQ ID NO: 332 - protein, 112 aa, Artificial Sequence
  Antibody VL sequence
DTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGQGTKVEIK

SEQ ID NO: 333 - protein, 119 aa, Artificial Sequence
  Antibody VH sequence
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 334 - protein, 107 aa, Artificial Sequence
  Antibody VL sequence
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 335 - protein, 120 aa, Artificial Sequence [sequence omitted]

SEQ ID NO: 336 - protein, 106 aa, Artificial Sequence [sequence omitted]

SEQ ID NO: 337 - protein, 125 aa, Artificial Sequence [sequence omitted]

SEQ ID NO: 338 - protein, 107 aa, Artificial Sequence [sequence omitted]

SEQ ID NO: 339 - protein, 121 aa, Artificial Sequence [sequence omitted]

SEQ ID NO: 340 - protein, 107 aa, Artificial Sequence [sequence omitted]

SEQ ID NO: 341 - protein, 121 aa, Artificial Sequence
  Antibody VH sequence
QVQLVQSGAEVKKPGSSVKVSCKASGGTFSSYAISWVRQAPGQGLEWMGSIIPIFGTVNYAQKFQGRVTITADESTSTAYMELSSLRSEDTAVYYCARDPSVNLYWYFDLWGRGTLVTVSS

SEQ ID NO: 342 - protein, 107 aa, Artificial Sequence
  Antibody VL sequence
DIQMTQSPSTLSASVGDRVTITCRASQSISSWWAWYQQKPGKAPKLLIYDASSLESGVPSRFSGSGSGTEFTLTISSLQPDDFATYYCQQYHAHPTTFGGGTKVEIK

SEQ ID NO: 343 - protein, 119 aa, Artificial Sequence
  Antibody VH sequence
QVQLVQSGAEVKKPGSSVKVSCKASGGTFGSYAISWVRQAPGQGLEWMGSIIPIFGAANPAQKSQGRVTITADESTSTAYMELSSLRSEDTAVYYCAKMGRGKVAFDIWGQGTMVTVSS

SEQ ID NO: 344 - protein, 113 aa, Artificial Sequence
  Antibody VL sequence
DIVMTQSPDSLAVSLGERATINCKSSQSVLYSPNNKNYLAWYQQKPGQPPKLLIYWASTRESGVPDRFSGSGSGTDFTLTISSLQAEDVAVYYCQQYYGSPITFGGGTKVEIK

SEQ ID NO: 345 - protein, 123 aa, Artificial Sequence
  Antibody VH sequence
QVQLVQSGAEVKKPGASVKVSCKASGYAFTSYGINWVRQAPGQGLEWMGWISAYNGNTYYAQKLRGRVTMTTDTSTSTAYMELRSLRSDDTAVYYCARDLGGYGSGSVPFDPWGQGTLVTVSS

SEQ ID NO: 346 - protein, 108 aa, Artificial Sequence
  Antibody VL sequence
EIVMTQSPATLSVSPGERATLSCRASQSVSSNLAWYQQKPGQAPRLLIYGASTRATGIPARFSGSGSGTEFTLTISSLQSEDFAVYYCQDYRTWPRRVFGGGTKVEIK

SEQ ID NO: 347 - protein, 123 aa, Artificial Sequence [sequence omitted]

SEQ ID NO: 348 - protein, 112 aa, Artificial Sequence [sequence omitted]

SEQ ID NO: 349 - protein, 119 aa, Artificial Sequence [sequence omitted]

SEQ ID NO: 350 - protein, 107 aa, Artificial Sequence [sequence omitted]

SEQ ID NO: 351 - protein, 118 aa, Artificial Sequence
  Antibody VH sequence
QIQLVQSGPELKKPGETVKISCKASGYTFTEYPIHWVKQAPGKGFKWMGMIYTDIGKPTYAEEFKGRFAFSLETSASTAYLQINNLKNEDTATYFCVRDRYDSLFDYWGQGTTLTVSS

SEQ ID NO: 352 - protein, 112 aa, Artificial Sequence
  Antibody VL sequence
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIK

SEQ ID NO: 353 - protein, 121 aa, Artificial Sequence
  Antibody VH sequence
EMQLVESGGGFVKPGGSLKLSCAASGFAFSHYDMSWVRQTPKQRLEWVAYIASGGDITYYADTVKGRFTISRDNAQNTLYLQMSSLKSEDTAMFYCSRSSYGNNGDALDFWGQGTSVTVSS

SEQ ID NO: 354 - protein, 111 aa, Artificial Sequence
  Antibody VL sequence
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVLTFGSGTKLEIK

SEQ ID NO: 355 - protein, 119 aa, Artificial Sequence
  Antibody VH sequence
QVQLVESGGGLVQPGGSLRLSCAASGFTFSSYAMGWVRQAPGKGLEWVSSISGSSRYIYYADSVKGRFTISRDNSKNTLYLQMNSLRAEDTAVYYCAKMDASGSYFNFWGQGTLVTVSS

SEQ ID NO: 356 - protein, 102 aa, Artificial Sequence
  Antibody VL sequence
QSPSFLSAFVGDRITITCRASPGIRNYLAWYQQKPGKAPKLLIYAASTLQSGVPSRFSGSGSGTDFTLTISSLQPEDFATYYCQQYNSYPLSFGGGTKVEIK

SEQ ID NO: 357 - protein, 115 aa, Artificial Sequence
  Antibody VH sequence
QVQLLQSAAEVKKPGESLKISCKGSGYSFTSYWIGWVRQMPGKGLEWMGIIYPGDSDTRYSPSFQGQVTISADKSISTAYLQWSSLKASDTAVYYCARWRDSPLWGQGTLVTVSS

SEQ ID NO: 358 - protein, 110 aa, Artificial Sequence
  Antibody VL sequence
QAVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGQYVFGGGTKLTVL

SEQ ID NO: 359 - protein, 120 aa, Artificial Sequence [sequence omitted]

SEQ ID NO: 360 - protein, 107 aa, Artificial Sequence [sequence omitted]

SEQ ID NO: 361 - protein, 120 aa, Artificial Sequence
  Antibody VH sequence
QVQLQQSGPELVKPGASLKLSCTASGFNIKDTYIHWVKQRPEQGLEWIGRIYPTNGYTRYDPKFQDKATITADTSSNTAYLQVSRLTSEDTAVYYCSRWGGDGFYAMDYWGQGASVTVSS

SEQ ID NO: 362 - protein, 107 aa, Artificial Sequence
  Antibody VL sequence
DIVMTQSHKFMSTSVGDRVSITCKASQDVNTAVAWYQQKPGHSPKLLIYSASFRYTGVPDRFTGSRSGTDFTFTISSVQAEDLAVYYCQQHYTTPPTFGGGTKVEIK

SEQ ID NO: 363 - protein, 119 aa, Artificial Sequence
  Antibody VH sequence
QVQLVESGGGLVQPGGSLRLSCAASGFTFRSYAMSWVRQAPGKGLEWVSAISGRGDNTYYADSVKGRFTISRDNSKNTLYLQMNSLRAEDTAVYYCAKMTSNAFAFDYWGQGTLVTVSS

SEQ ID NO: 364 - protein, 111 aa, Artificial Sequence
  Antibody VL sequence
QSVLTQPPSVSGAPGQRVTISCTGSSSNIGAGYGVHWYQQLPGTAPKLLIYGNTNRPSGVPDRFSGFKSGTSASLAITGLQAEDEADYYCQFYDSSLSGWVFGGGTKLTVL

SEQ ID NO: 365 - protein, 119 aa, Artificial Sequence [sequence omitted]

SEQ ID NO: 366 - protein, 107 aa, Artificial Sequence [sequence omitted]

SEQ ID NO: 367 - protein, 119 aa, Artificial Sequence [sequence omitted]

SEQ ID NO: 368 - protein, 111 aa, Artificial Sequence [sequence omitted]

SEQ ID NO: 369 - protein, 121 aa, Artificial Sequence [sequence omitted]

SEQ ID NO: 370 - protein, 107 aa, Artificial Sequence [sequence omitted]

SEQ ID NO: 371 - protein, 118 aa, Artificial Sequence
  Antibody VH sequence
QVQLQESGGGLVKPGGSLRLSCAASGFTFSSYWMSWVRQAPGKGLEWVANINRDGSASYYVDSVKGRFTISRDDAKNSLYLQMNSLRAEDTAVYYCARDRGVGYFDLWGRGTLVTVSS

SEQ ID NO: 372 - protein, 111 aa, Artificial Sequence
  Antibody VL sequence
QSALTQPASVSGSPGQSITISCTGTSSDVGGYNFVSWYQQHPGKAPKLMIYDVSDRPSGVSDRFSGSKSGNTASLIISGLQADDEADYYCSSYGSSSTHVIFGGGTKVTVL

SEQ ID NO: 373 - protein, 129 aa, Artificial Sequence
  Antibody VH sequence
QVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCTDRTCAKWPEWLGVWGQGTLVTVSS

SEQ ID NO: 374 - protein, 110 aa, Artificial Sequence
  Antibody VL sequence
QSVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKLTVL

SEQ ID NO: 375 - protein, 119 aa, Artificial Sequence
  Antibody VH sequence
EVQLVESGGGVVQPGRSLRLSCSTSGFTFSDYYMYWVRQAPGKGLEWVAYMSNVGAITDYPDTVKGRFTISRDNSKNTLFLQMDSLRPEDTGVYFCARGTRDGSWFAYWGQGTPVTVSS

SEQ ID NO: 376 - protein, 112 aa, Artificial Sequence
  Antibody VL sequence
DIQMTQSPSSLSASVGDRVTITCRSSQRIVHSNGNTYLEWYQQTPGKAPKLLIYKVSNRFSGVPSRFSGSGSGTDFTFTISSLQPEDIATYYCFQGSHVPFTFGQGTKLQIT

SEQ ID NO: 377 - protein, 120 aa, Artificial Sequence
  Antibody VH sequence
QVELVQSGAEVKKPGESLKISCKGSGYSFTSYWIGWVRQAPGKGLEWMGIIDPGDSRTRYSPSFQGQVTISADKSISTAYLQWSSLKASDTAMYYCARGQLYGGTYMDGWGQGTLVTVSS

SEQ ID NO: 378 - protein, 111 aa, Artificial Sequence
  Antibody VL sequence
DIALTQPASVSGSPGQSITISCTGTSSDIGGYNSVSWYQQHPGKAPKLMIYGVNNRPSGVSNRFSGSKSGNTASLTISGLQAEDEADYYCSSYDIESATPVFGGGTKLTVL

SEQ ID NO: 379 - protein, 119 aa, Artificial Sequence
  Antibody VH sequence
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSS

SEQ ID NO: 380 - protein, 106 aa, Artificial Sequence
  Antibody VL sequence
DIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEIK

SEQ ID NO: 381 - protein, 122 aa, Artificial Sequence
  Antibody VH sequence
QVYLVESGGGVVQPGRSLRLSCAASGITFSIYGMHWVRQAPGKGLEWVAVIWYDGSHEYYADSVKGRFTISRDNSKNTLYLLMNSLRAEDTAVYYCARDGDYYDSGSPLDYWGQGTLVTVSS

SEQ ID NO: 382 - protein, 107 aa, Artificial Sequence
  Antibody VL sequence
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK

SEQ ID NO: 383 - protein, 122 aa, Artificial Sequence
  Antibody VH sequence
QVHLVESGGGVVQPGRSLRLSCVASGITFRIYGMHWVRQAPGKGLEWVAVLWYDGSHEYYADSVKGRFTISRDNSKNTLYLQMNSLRAEDTAIYYCARDGDYYDSGSPLDYWGQGTLVTVSS

SEQ ID NO: 384 - protein, 107 aa, Artificial Sequence; identical to SEQ ID NO: 382
  Antibody VL sequence

SEQ ID NO: 385 - protein, 131 aa, Artificial Sequence
  Antibody VH sequence
EVHLVESGGGLVQPGGSLRLSCAASGFTFSRYWMSWVRQAQGKGLEWVASIKQAGSEKTYVDSVKGRFTISRDNAKNSLSLQMNSLRAEDTAVYYCAREGAYYYDSASYYPYYYYYSMDVWGQGTTVTVSS

SEQ ID NO: 386 - protein, 108 aa, Artificial Sequence
  Antibody VL sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSQYTFGQGTKLEIK

SEQ ID NO: 387 - protein, 119 aa, Artificial Sequence
  Antibody VH sequence
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGSGTPVTVSS

SEQ ID NO: 388 - protein, 106 aa, Artificial Sequence
  Antibody VL sequence
DIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGSGTKVEIK

SEQ ID NO: 389 - protein, 119 aa, Artificial Sequence
  Antibody VH sequence
EVQLQESGPELVKPGASVKMSCKASGYTFPSYVLHWVKQKPGQGLEWIGYINPYNDGTQYNEKFKGKATLTSDKSSSTAYMELSRLTSEDSAVYYCARGFGGSYGFAYWGQGTLITVSA

SEQ ID NO: 390 - protein, 108 aa, Artificial Sequence
  Antibody VL sequence
DIVMTQSPAIMSASPGEKVTMTCSASSSVSSSYLYWYQQKPGSSPKLWIYSTSNLASGVPARFSGSGSGTSYSLTISSMEAEDAASYFCHQWNRYPYTFGGGTKLEIK

SEQ ID NO: 391 - protein, 119 aa, Artificial Sequence
  Antibody VH sequence
QVQLQQSGAEVKKFGASVKVSCEASGYTFPSYVLHWVKQAPGQGLEWIGYINPYNDGTQTNKKFKGKATLTRDTSINTAYMELSRLRSDDTAVYYCARGFGGSYGFAYNGQGTLVTVSS

SEQ ID NO: 392 - protein, 108 aa, Artificial Sequence
  Antibody VL sequence
DIQLTQSPSSLSASVGDRVTMTCSASSSVSSSYLYWYQQKPGKAPKLWIYSTSNLASGVPARFSGSGSGTDFTLTISSLQPEDSASYFCHQWNRYPYTFGGGTRLEIK

SEQ ID NO: 393 - protein, 117 aa, Artificial Sequence
  Antibody VH sequence
QAQLQVSGAEVVKPGASVKMSCKASGYTFTSYNMHWVKQTPGQGLEWIGYIYPGNGATNYNQKFQGKATLTADTSSSTAYMQISSLTSEDSAVYFCARGDSVPFAYWGQGTLVTVSA

SEQ ID NO: 394 - protein, 106 aa, Artificial Sequence
  Antibody VL sequence
EIVLTQSPATMSASPGERVTITCSAHSSVSFMHWFQQKPGTSPKLWIYSTSSLASGVPARFGGSGSGTSYSLTISSMEAEDAATYYCQQRSSFPLTFGAGTKLELK

SEQ ID NO: 395 - protein, 118 aa, Artificial Sequence
  Antibody VH sequence
QVQLQQSGAELMKPGASVKISCKATGYTFSAYWIEWVKQRPGHGLEWIGEILPGSNNSRYNEKFKGKATFTADTSSNTAYMQLSSLTSEDSAVYYCSRSYDFAWFAYWGQGTPVTVSA

SEQ ID NO: 396 - protein, 113 aa, Artificial Sequence
  Antibody VL sequence
DIVMSQSPSSLAVSVGEKVTMSCKSSQSLLYSSNQKIYLAWYQQKPGQSPKLLIYWASTRESGVPDRFTGGGSGTDFTLTISSVKAEDLAVYYCQQYYRYPRTFGGGTKLEIK

SEQ ID NO: 397 - protein, 118 aa, Artificial Sequence
  Antibody VH sequence
QVQLVQSGAEVKKPGASVKVSCKASGYTFSAYWIEWVRQAPGKGLEWVGEILPGSNNSRYNEKFKGRVTVTRDTSTNTAYMELSSLRSEDTAVYYCARSYDFAWFAYWGQGTLVTVSS

SEQ ID NO: 398 - protein, 113 aa, Artificial Sequence
  Antibody VL sequence
DIQMTQSPSSLSASVGDRVTITCKSSQSLLYSSNQKIYLAWYQQKPGKAPKLLIYWASTRESGVPSRFSGSGSGTDFTFTISSLQPEDIATYYCQQYYRYPRTFGQGTKVEIK

SEQ ID NO: 399 - protein, 123 aa, Artificial Sequence
  Antibody VH sequence
QVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSS

SEQ ID NO: 400 - protein, 106 aa, Artificial Sequence
  Antibody VL sequence
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 401 - protein, 121 aa, Artificial Sequence
  Antibody VH sequence
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSS

SEQ ID NO: 402 - protein, 108 aa, Artificial Sequence
  Antibody VL sequence
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIK

SEQ ID NO: 403 - protein, 118 aa, Artificial Sequence [sequence omitted]

SEQ ID NO: 404 - protein, 107 aa, Artificial Sequence [sequence omitted]

SEQ ID NO: 405 - protein, 120 aa, Artificial Sequence
  Antibody VH sequence
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSS

SEQ ID NO: 406 - protein, 110 aa, Artificial Sequence
  Antibody VL sequence
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL

SEQ ID NO: 407 - protein, 115 aa, Artificial Sequence
  Antibody VH sequence
EVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSS

SEQ ID NO: 408 - protein, 107 aa, Artificial Sequence
  Antibody VL sequence
DIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIK

SEQ ID NO: 409 - protein, 121 aa, Artificial Sequence
  Antibody VH sequence
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSS

SEQ ID NO: 410 - protein, 107 aa, Artificial Sequence
  Antibody VL sequence
DIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIK

SEQ ID NO: 411 - protein, 121 aa, Artificial Sequence
  Antibody VH sequence
QEQLVESGGRLVTPGGSLTLSCKASGFDFSAYYMSWVRQAPGKGLEWIATIYPSSGKTYYATWVNGRFTISSDNAQNTVDLQMNSLTAADRATYFCARDSYADDGALFNIWGPGTLVTISS

SEQ ID NO: 412 - protein, 112 aa, Artificial Sequence
  Antibody VL sequence
ELVLTQSPSVSAALGSPAKITCTLSSAHKTDTIDWYQQLQGEAPRYLMQVQSDGSYTKRPGVPDRFSGSSSGADRYLIIPSVQADDEADYYCGADYIGGYVFGGGTQLTVTG

SEQ ID NO: 413 - protein, 119 aa, Artificial Sequence
  Antibody VH sequence
EVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSS

SEQ ID NO: 414 - protein, 107 aa, Artificial Sequence
  Antibody VL sequence
DIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMK

SEQ ID NO: 415 - protein, 117 aa, Artificial Sequence
  Antibody VH sequence
QSLEESGGRLVTPGTPLTLTCTVSGIDLNSHWMSWVRQAPGKGLEWIGIIAASGSTYYANWAKGRFTISKTSTTVDLRIASPTTEDTATYFCARDYGDYRLVTFNIWGPGTLVTVSS

SEQ ID NO: 416 - protein, 108 aa, Artificial Sequence
  Antibody VL sequence
ELVMTQTPSSVSAAVGGTVTINCQASQSIGSYLAWYQQKPGQPPKLLIYYASNLASGVPSRFSGSGSGTEYTLTISGVQREDAATYYCLGSLSNSDNVFGGGTELEIL

SEQ ID NO: 417 - protein, 116 aa, Artificial Sequence
  Antibody VH sequence
QSVKESEGDLVTPAGNLTLTCTASGSDINDYPISWVRQAPGKGLEWIGFINSGGSTWYASWVKGRFTISRTSTTVDLKMTSLTTDDTATYFCARGYSTYYCDFNIWGPGTLVTISS

SEQ ID NO: 418 - protein, 110 aa, Artificial Sequence
  Antibody VL sequence
ELVMTQTPSSTSGAVGGTVTINCQASQSIDSNLAWFQQKPGQPPTLLIYRASNLASGVPSRFSGSRSGTEYTLTISGVQREDAATYYCLGGVGNVSYRTSFGGGTEVVVK

SEQ ID NO: 419 - protein, 115 aa, Artificial Sequence
  Antibody VH sequence
QVQLVQSGAEVVKPGASVKISCKASGYTFTDHAIHWVKQNPGQRLEWIGYFSPGNDDFKYNERFKGKATLTADTSASTAYVELSSLRSEDTAVYFCTRSLNMAYWGQGTLVTVSS

SEQ ID NO: 420 - protein, 113 aa, Artificial Sequence
  Antibody VL sequence
DIVMSQSPDSLAVSLGERVTLNCKSSQSLLYSGNQKNYLAWYQQKPGQSPKLLIYWASARESGVPDRFSGSGSGTDFTLTISSVQAEDVAVYYCQQYYSYPLTFGAGTKLELK

SEQ ID NO: 421 - protein, 119 aa, Artificial Sequence
  Antibody VH sequence
  SITE (68)..(68): Xaa can be any naturally occurring amino acid
QIQLVQSGPELKKPGETVKISCKASGYTFTNFGMNWVKQGPGEGLKWMGWINTNTGEPRYAEEFKGRXAFSLETTASTAYLQINNLKNEDTATYFCARDWDGAYFFDYWGQGTTLTVSS

SEQ ID NO: 422 - protein, 107 aa, Artificial Sequence
  Antibody VL sequence
SIVMTQTPKFLLVSAGDRVTITCKASQSVSNDVAWYQQKPGQSPKLLINFATNRYTGVPNRFTGSGYGTDFTFTISTVQAEDLALYFCQQDYSSPWTFGGGTKLEIK

SEQ ID NO: 423 - protein, 117 aa, Artificial Sequence
  Antibody VH sequence
QVQLQQSRPELVKPGASVKMSCKASGYTFTDYVISWVKQRTGQGLEWIGEIYPGSNSIYYNEKFKGRATLTADKSSSTAYMQLSSLTSEDSAVYFCAMGGNYGFDYWGQGTTLTVSS

SEQ ID NO: 424 - protein, 115 aa, Artificial Sequence
  Antibody VL sequence
SVIMSRGQIVLTQSPAIMSASLGERVTLTCTASSSVNSNYLHWYQQKPGSSPKLWIYSTSNLASGVPARFSGSGSGTSYSLTISSMEAEDAATYYCHQYHRSPLTFGAGTKLELK

SEQ ID NO: 425 - protein, 122 aa, Artificial Sequence
  Antibody VH sequence
  SITE (97)..(97): Xaa can be any naturally occurring amino acid
EVQLVESGGGLVQPKGSLKLSCAASGFTFNTYAMNWVRQAPGKGLEWVARIRSKSNNYATYYADSVKDRFTISRDDSQSMLYLQMNNLKTEDTAMYXCVRQWDYDVRAMNYWGQGTSVTVSS

SEQ ID NO: 426 - protein, 107 aa, Artificial Sequence
  Antibody VL sequence
DIVMTQSHIFMSTSVGDRVSITCKASQDVDTAVAWYQQKPGQSPKLLIYWASTRLTGVPDRFTGSGSGTDFTLTISNVQSEDLADYFCQQYSSYPYTFGGGTKLEIK

SEQ ID NO: 427 - protein, 121 aa, Artificial Sequence
  Antibody VH sequence
QVQLQQSGSELKKPGASVKVSCKASGYTFTNYGMNWVKQAPGQGLKWMGWINTYTGEPTYTDDFKGRFAFSLDTSVSTAYLQISSLKADDTAVYFCARGGFGSSYWYFDVWGQGSLVTVSS

SEQ ID NO: 428 - protein, 107 aa, Artificial Sequence
  Antibody VL sequence
DIQLTQSPSSLSASVGDRVSITCKASQDVSIAVAWYQQKPGKAPKLLIYSASYRYTGVPDRFSGSGSGTDFTLTISSLQPEDFAVYYCQQHYITPLTFGAGTKVEIK

SEQ ID NO: 429 - protein, 126 aa, Artificial Sequence
  Antibody VH sequence
QAQVVESGGGVVQSGRSLRLSCAASGFAFSSYGMHWVRQAPGKGLEWVAVIWYDGSNKYYADSVRGRFTISRDNSENTLYLQMNSLRAEDTAVYYCARDHYGSGVHHYFYYGLDVWGQGTTVTVSS

SEQ ID NO: 430 - protein, 108 aa, Artificial Sequence
  Antibody VL sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 431 - protein, 117 aa, Artificial Sequence
  Antibody VH sequence
EVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVTDAFDIWGQGTMVTVSSA

SEQ ID NO: 432 - protein, 107 aa, Artificial Sequence [sequence omitted]

SEQ ID NO: 433 - protein, 117 aa, Artificial Sequence
  Antibody VH sequence
EVQLVESGGGLVQPGGSLRLSCAASGFTFSSYGMSWVRQAPGKGLEWVATITSGGSYTYYVDSVKGRFTISRDNAKNTLYLQMNSLRAEDTAVYYCVRIGEDALDYWGQGTLVTVSS

SEQ ID NO: 434 - protein, 107 aa, Artificial Sequence
  Antibody VL sequence
DIQMTQSPSSLSASVGDRVTITCRASQDIAGSLNWLQQKPGKAIKRLIYATSSLDSGVPKRFSGSRSGSDYTLTISSLQPEDFATYYCLQYGSFPPTFGQGTKVEIK

SEQ ID NO: 435 - protein, 118 aa, Artificial Sequence
  Antibody VH sequence
KVQLQQSGTELVKPGASVKVSCKASGYIFTEYIIHWVKQRSGQGLEWIGWLYPESNIIKYNEKFKDKATLTADKSSSTVYMELSRLTSEDSAVYFCTRHDGTNFDYWGQGTTLTVSSA

SEQ ID NO: 436 - protein, 111 aa, Artificial Sequence
  Antibody VL sequence
DIVLTQSPASLAVSLGQRATISCRASESVDSYGNSFMHWYQQKPGQPPKLLIYRASNLESGIPARFSGSGSRTDFTLTINPVEADDVATYYCQQSNEDPLTFGAGTKLELK

SEQ ID NO: 437 - DNA, 3120 bp, Artificial Sequence
  CasX variant Stx2
atggctccgaagaagaagcgaaaggtcagccaggaaattaaacgcatcaacaagatccgccgtcgtctggtaaaagacagcaatacgaaaaaagccggaaaaaccggtccgatgaaaacgctgctggtgcgcgtgatgacgccggatctccgcgaacgtcttgagaatttgcgtaagaaacctgaaaatattccgcaaccgatttctaacacctcgcgcgccaatctgaataaactgctgaccgattacaccgaaatgaagaaagcgattctgcacgtttactgggaagagttccagaaagacccggtcggtctgatgagccgcgttgcgcaacctgcgccgaaaaatatcgatcagcgcaagttaatcccggttaaagatggtaatgaacgtttaacctccagcggctttgcctgcagtcagtgctgccagccactttatgtttataaacttgaacaggttaacgataaagggaaaccccataccaattatttcggccgctgcaatgtcagcgaacatgaacgcctgattttgttaagcccgcataaaccggaagcgaatgacgaactggtgacctattccctgggtaaatttggtcagcgggcgctggatttttacagcattcatgtgacgcgggaaagtaaccatccggtaaagccactggaacaaatcggcggtaacagctgcgcctctggcccggttggcaaagcgcttagcgatgcctgtatgggcgcggtggcgagctttctgacaaaataccaggatattatcctggagcatcagaaggtgatcaaaaagaacgagaaacgtctggcaaatttaaaggatattgcctccgctaacggcctggcgttcccgaagattaccttaccgccgcagccgcacaccaaagaaggtatcgaagcgtataacaacgttgttgcccagatcgtcatctgggtgaatctcaacctgtggcaaaaactgaaaattggtcgtgatgaagcaaaaccgttgcagcgactgaaaggattcccgtcgtttccgctggttgaacgacaggcgaacgaagtggattggtgggatatggtttgtaacgtcaaaaaattgatcaacgaaaaaaaggaagatggcaaagttttctggcaaaatctggcgggttacaaacgtcaggaggcgttgcttccgtatctctcttcagaagaagatcgcaaaaaaggcaagaagtttgctcgctatcagtttggcgatttattactgcatctggaaaaaaaacacggcgaagactggggcaaagtgtacgatgaagcctgggagcgtatcgacaaaaaagtggaaggtttgtcgaaacatattaaactcgaagaagagcgccgcagtgaagatgcgcagtcaaaagcagcgctgacggactggttacgtgcgaaagccagttttgtgattgaaggattaaaagaagctgataaagatgaattttgccgttgcgaactgaaactgcaaaaatggtatggcgacctgcgcggcaaaccgttcgccattgaggcagaaaatagcatccttgatatctccggtttcagcaaacaatataactgcgcgtttatttggcagaaagacggcgtgaaaaagcttaacctgtatctgatcattaactattttaaaggcgggaaactgcgtttcaagaaaatcaagccggaagcatttgaagccaatcgtttttataccgttattaataaaaaaagcggtgaaatcgtgccgatggaagttaattttaactttgatgatccgaacttgattattctgccgctggcattcggtaaacggcagggccgtgagtttatctggaacgacctgttatcgctggaaacgggcagcctgaaattagccaacggtcgcgtcattgaaaaaacgctctacaaccgccgcacccgccaggatgagccggcactgtttgtcgcgctgacctttgaacggcgtgaagtcctcgatagcagcaacatcaaaccaatgaaccttatcggtattgatcgtggtgaaaacattcctgccgttatcgccctgactgatccagaaggctgcccgctttctcgcttcaaagattcactgggcaacccgacccatatcctccgtattggcgagagctacaaagagaaacagcgtaccattcaggcagccaaagaagtggagcagcgtcgcgcgggcggctatagccgtaaatatgccagcaaagctaaaaacctggcggatgacatggtgcgtaacacggcgcgcgatttgctgtactacgccgtcacccaggacgcgatgctgatttttgagaacctctcccgcggttttgggcgtcagggtaaacgcacgtttatggcggaacgccagtatacgcgtatggaggactggctgaccgcgaagctggcctatgaaggcttgccgtctaaaacttacctgagcaagaccctggctcagtacaccagtaaaacctgtagtaattgcggctttaccatcaccagcgccgattatgaccgcgtgctggaaaagctgaagaaaaccgccaccggctggatgaccaccatcaatggtaaagagcttaaagtcgaagggcagattacttattacaaccgttataagcggcaaaacgtggtgaaagatctgtcggttgagctggaccgtttgtctgaagaaagcgtgaacaatgatatcagctcctggaccaaaggtcgttccggcgaagcgttaagtctgttgaaaaagcgctttagccatcgcccggtgcaggaaaaattcgtttgcctgaactgtggcttcgaaacccacgccgacgagcaagcggcgctcaatattgcgcgtagctggctgttcctgcgcagccaggaatataaaaaatatcaaaccaacaaaacaactggcaataccgacaagcgtgcctttgttgaaacctggcagagcttctatcgcaaaaaactgaaagaggtctggaaaccggcggtagcgccaaagaaaaaacgcaaagtgagcgaaaatctttattttcaaggtagcgcatggagtcatcctcaattcgagaaaggtggaggttctggcggtggatcgggaggttcagcgtggagccacccgcagttcgaaaaaggaaggggatccggctgctaa

SEQ ID NO: 438 - DNA, 3123 bp, Artificial Sequence
  CasX variant 119
atggctccgaagaagaagcgaaaggtcagccaggaaattaaacgcatcaacaagatccgccgtcgtctggtaaaagacagcaatacgaaaaaagccggaaaaaccggtccgatgaaaacgctgctggtgcgcgtgatgacgccggatctccgcgaacgtcttgagaatttgcgtaagaaacctgaaaatattccgcaaccgatttctaacacctcgcgcgccaatctgaataaactgctgaccgattacaccgaaatgaagaaagcgattctgcacgtttactgggaagagttccagaaagacccggtcggtctgatgagccgcgttgcgcaacctgcgccgaaaaatatcgatcagcgcaagttaatcccggttaaagatggtaatgaacgtttaacctccagcggctttgcctgcagtcagtgctgccagccactttatgtttataaacttgaacaggttaacgataaagggaaaccccataccaattatttcggccgctgcaatgtcagcgaacatgaacgcctgattttgttaagcccgcataaaccggaagcgaatgacgaactggtgacctattccctgggtaaatttggtcagcgggcgctggatttttacagcattcatgtgacgcgggaaagtaaccatccggtaaagccactggaacaaatcggcggtaacagctgcgcctctggcccggttggcaaagcgcttagcgatgcctgtatgggcgcggtggcgagctttctgacaaaataccaggatattatcctggagcatcagaaggtgatcaaaaagaacgagaaacgtctggcaaatttaaaggatattgcctccgctaacggcctggcgttcccgaagattaccttaccgccgcagccgcacaccaaagaaggtatcgaagcgtataacaacgttgttgcccagatcgtcatctgggtgaatctcaacctgtggcaaaaactgaaaattggtcgtgatgaagcaaaaccgttgcagcgactgaaaggattcccgtcgtttccgctggttgaacgacaggcgaacgaagtggattggtgggatatggtttgtaacgtcaaaaaattgatcaacgaaaaaaaggaagatggcaaagttttctggcaaaatctggcgggttacaaacgtcaggaggcgttgcgtccgtatctctcttcagaagaagatcgcaaaaaaggcaagaagtttgctcgctatcagtttggcgatttattactgcatctggaaaaaaaacacggcgaagactggggcaaagtgtacgatgaagcctgggagcgtatcgacaaaaaagtggaaggtttgtcgaaacatattaaactcgaagaagagcgccgcagtgaagatgcgcagtcaaaagcagcgctgacggactggttacgtgcgaaagccagttttgtgattgaaggattaaaagaagctgataaagatgaattttgccgttgcgaactgaaactgcaaaaatggtatggcgacctgcgcggcaaaccgttcgccattgaggcagaaaatagcatccttgatatctccggtttcagcaaacaatataactgcgcgtttatttggcagaaagacggcgtgaaaaagcttaacctgtatctgatcattaactattttaaaggcgggaaactgcgtttcaagaaaatcaagccggaagcatttgaagccaatcgtttttataccgttattaataaaaaaagcggtgaaatcgtgccgatggaagttaattttaactttgatgatccgaacttgattattctgccgctggcattcggtaaacggcagggccgtgagtttatctggaacgacctgttatcgctggaaacgggcagcctgaaattagccaacggtcgcgtcattgaaaaaacgctctacaaccgccgcacccgccaggatgagccggcactgtttgtcgcgctgacctttgaacggcgtgaagtcctcgatagcagcaacatcaaaccaatgaaccttatcggtattgatcgtggtgaaaacattcctgccgttatcgccctgactgatccagaaggctgcccgctttctcgcttcaaagattcactgggcaacccgacccatatcctccgtattggcgagagctacaaagagaaacagcgtaccattcaggcaaagaaagaagtggagcagcgtcgcgcgggcggctatagccgtaaatatgccagcaaagctaaaaacctggcggatgacatggtgcgtaacacggcgcgcgatttgctgtactacgccgtcacccaggacgcgatgctgatttttgagaacctctcccgcggttttgggcgtcagggtaaacgcacgtttatggcggaacgccagtatacgcgtatggaggactggctgaccgcgaagctggcctatgaaggcttgtctaaaacttacctgagcaagaccctggctcagtacaccagtaaaacctgtagtaattgcggctttaccatcaccagcgccgattatgaccgcgtgctggaaaagctgaagaaaaccgccaccggctggatgaccaccatcaatggtaaagagcttaaagtcgaagggcagattacttattacaaccgttataagcggcaaaacgtggtgaaagatctgtcggttgagctggaccgtttgtctgaagaaagcgtgaacaatgatatcagctcctggaccaaaggtcgttccggcgaagcgttaagtctgttgaaaaagcgctttagccatcgcccggtgcaggaaaaattcgtttgcctgaactgtggcttcgaaacccacgccgacgagcaagcggcgctcaatattgcgcgtagctggctgttcctgcgcagccaggaatataaaaaatatcaaaccaacaaaacaactggcaataccgacaagcgtgcctttgttgaaacctggcagagcttctatcgcaagaagctgaaagaggtctggaaaccggcggtaccacctgcgccaaagaaaaaacgcaaagtgagcgaaaatctttattttcaaggtagcgcatggagtcatcctcaattcgagaaaggtggaggttctggcggtggatcgggaggttcagcgtggagccacccgcagttcgaaaaaggaaggggatccggctgctaa

SEQ ID NO: 439 - protein, 976 aa, Artificial Sequence; identical to SEQ ID NO: 117
  CasX variant 119

SEQ ID NO: 440 - DNA, 2928 bp, Artificial Sequence
  CasX variant 457
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccagggagagcaatcaccctgtgaagcccctggaacagatcggcggcaatagctgtgcctctggacctgtgggaaaagccctgagcgacgcctgtatgggagccgtggcatccttcctgaccaagtaccaggacatcatcctggaacacaagaaagtgatcaagaagaacgagaaaagactggccaacctcaaggatatcgccagcgctaacggcctggcctttcctaagatcaccctgcctccacagcctcacaccaaagagggcatcgaggcctacaacaacgtggtggcccagatcgtgatttgggtcaacctgaatctgtggcagaagctgaagatcggcagggacgaagccaagccactgcagagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagccccgaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaacccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 441 - protein, 976 aa, Artificial Sequence
  CasX variant 457
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHKKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSPEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKPLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 442 - DNA, 2928 bp, Artificial Sequence
  CasX variant 438
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccagggagagcaatcaccctgtgaagcccctggaacagatcggcggcaatagctgtgcctctggacctgtgggaaaagccctgagcgacgcctgtatgggagccgtggcatccttcctgaccaagtaccaggacatcatcctggaacaccagaaagtgatcaagaagaacgagaaaagactggccaacctcaaggatatcgccagcgctaacggcctggcctttcctaagatcaccctgcctccacagcctcacaccaaagagggcatcgaggcctacaacaacgtggtggcccagatcgtgatttgggtcaacctgaatctgtggcagaagctgaagatcggcagggacgaagccaagccactgcagagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgaagcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 443 - protein, 976 aa, Artificial Sequence
  CasX variant 438
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 444 - DNA, 2931 bp, Artificial Sequence
  CasX variant 488
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 445 - protein, 977 aa, Artificial Sequence; identical to SEQ ID NO: 135
  CasX variant 488

SEQ ID NO: 446 - DNA, 2931 bp, Artificial Sequence
  CasX variant 491
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 447 - protein, 977 aa, Artificial Sequence; identical to SEQ ID NO: 138
  CasX variant 491

SEQ ID NO: 448 - protein, 987 aa, Artificial Sequence
  CasX variant 278
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 449 - protein, 986 aa, Artificial Sequence
  CasX variant 279
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 450 - protein, 996 aa, Artificial Sequence
  CasX variant 280
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPPKKKRKV

SEQ ID NO: 451 - protein, 1006 aa, Artificial Sequence
  CasX variant 285
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPHKKKHPDASVNFSEFSK

SEQ ID NO: 452 - protein, 1007 aa, Artificial Sequence
  CasX variant 286
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPQRPGPYDRPQRPGPYDRP

SEQ ID NO: 453 - protein, 1005 aa, Artificial Sequence
  CasX variant 287
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPLSPSLSPLLSPSLSPL

SEQ ID NO: 454 - protein, 1008 aa, Artificial Sequence
  CasX variant 288
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTMSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPRGKGGKGLGKGGAKRHRK

SEQ ID NO: 455 - protein, 1013 aa, Artificial Sequence
  CasX variant 290
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPSRRRKANPTKLSENAKKLAKEVEN

SEQ ID NO: 456 - protein, 998 aa, Artificial Sequence
  CasX variant 291
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPPAAKRVKLD

SEQ ID NO: 457 - protein, 997 aa, Artificial Sequence
  CasX variant 293
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPKRSFSKAF

SEQ ID NO: 458 - protein, 1008 aa, Artificial Sequence
  CasX variant 300
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPKRGINDRNFWRGENERKTR

SEQ ID NO: 459 - protein, 1007 aa, Artificial Sequence
  CasX variant 492
MAPKKKRKVSRMQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPPKKKRKV

SEQ ID NO: 460 - protein, 1009 aa, Artificial Sequence
  CasX variant 493
MAPKKKRKVSRMQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVPPPPAAKRVKLD

SEQ ID NO: 461 - DNA, 21 bp, Betapolyomavirus macaca mulatta polyomavirus 1
ccaaagaagaagcggaaggtc

SEQ ID NO: 462 - DNA, 51 bp, Unknown
  nuclear localization signal
cacaagaagaaacatccagacgcatcagtcaactttagcgagttcagtaaa

SEQ ID NO: 463 - DNA, 54 bp, Unknown
  nuclear localization signal
cagcgccctgggccttacgataggccgcaaagacccggaccgtatgatcgccct

SEQ ID NO: 464 - DNA, 48 bp, Unknown
  nuclear localization signal
ctcagcccgagtcttagtccactgctttccccgtccctgtctccactg

SEQ ID NO: 465 - DNA, 54 bp, Unknown
  nuclear localization signal
cggggcaagggtggcaaggggcttggcaaggggggggcaaagaggcacaggaag

SEQ ID NO: 466 - DNA, 72 bp, Unknown
  nuclear localization signal
agccgccgcagaaaagccaatcctacaaaactgtcagaaaatgcgaaaaaacttgctaaggaggtggaaaac

SEQ ID NO: 467 - DNA, 27 bp, Homo sapiens
cctgccgcaaagcgagtgaaattggac

SEQ ID NO: 468 - DNA, 24 bp, Unknown
  nuclear localization signal
aagcggtccttcagtaaggccttt

SEQ ID NO: 469 - DNA, 57 bp, Alphainfluenzavirus influenza A virus
aaacggggaataaacgaccggaacttctggcgcggggaaaacgagcgcaaaacccga

SEQ ID NO: 470 - protein, 24 aa, Unknown
  nuclear localization signal
SRRRKANPTKLSENAKKLAKEVEN

SEQ ID NO: 471 - DNA, 2991 bp, Artificial Sequence
  CasX variant 387
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccagggagagcaatcaccctgtgaagcccctggaacagatcggcggcaatagctgtgcctctggacctgtgggaaaagccctgagcgacgcctgtatgggagccgtggcatccttcctgaccaagtaccaggacatcatcctggaacaccagaaagtgatcaagaagaacgagaaaagactggccaacctcaaggatatcgccagcgctaacggcctggcctttcctaagatcaccctgcctccacagcctcacaccaaagagggcatcgaggcctacaacaacgtggtggcccagatcgtgatttgggtcaacctgaatctgtggcagaagctgaagatcggcagggacgaagccaagccactgcagagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 472 - protein, 997 aa, Artificial Sequence
  CasX variant 387
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 473 - DNA, 2988 bp, Artificial Sequence
  CasX variant 395
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 474 - protein, 1005 aa, Artificial Sequence
  CasX variant 395
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVTSPKKKRKV

SEQ ID NO: 475 - DNA, 2988 bp, Artificial Sequence
  CasX variant 485
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 476 - protein, 996 aa, Artificial Sequence
  CasX variant 485
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 477 - DNA, 2988 bp, Artificial Sequence
  CasX variant 486
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgaagcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 478 - protein, 996 aa, Artificial Sequence
  CasX variant 486
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 479 - DNA, 2988 bp, Artificial Sequence
  CasX variant 487
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcccgctcctaagaacatcgaccagagaaagctgatccccgtgaaggacggcaacgagagactgacctctagcggctttgcctgcagccagtgttgccagcctctgtacgtgtacaagctggaacaagtgaacgacaagggcaagccccacaccaactacttcggcagatgcaacgtgtccgagcacgagaggctgatcctgctgtctcctcacaagcccgaggccaacgatgagctggtcacatacagcctgggcaagttcggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 480 - protein, 996 aa, Artificial Sequence
  CasX variant 487
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 481 - DNA, 2991 bp, Artificial Sequence
  CasX variant 488
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagttcggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcatcgaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 482 - protein, 997 aa, Artificial Sequence
  CasX variant 488
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 483 - DNA, 2991 bp, Artificial Sequence
  CasX variant 489
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 484 - protein, 997 aa, Artificial Sequence
  CasX variant 489
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 485 - DNA, 2991 bp, Artificial Sequence
  CasX variant 490
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgaagcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggaggaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 486 - protein, 997 aa, Artificial Sequence
  CasX variant 490
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLKHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRRKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 487 - DNA, 2991 bp, Artificial Sequence
  CasX variant 491
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 488 - protein, 997 aa, Artificial Sequence
  CasX variant 491
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 489 - DNA, 2991 bp, Artificial Sequence
  CasX variant 494
atggccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccagggagagcaatcaccctgtgaagcccctggaacagatcggcggcaatagctgtgcctctggacctgtgggaaaagccctgagcgacgcctgtatgggagccgtggcatccttcctgaccaagtaccaggacatcatcctggaacaccagaaagtgatcaagaagaacgagaaaagactggccaacctcaaggatatcgccagcgctaacggcctggcctttcctaagatcaccctgcctccacagcctcacaccaaagagggcatcgaggcctacaacaacgtggtggcccagatcgtgatttgggtcaacctgaatctgtggcagaagctgaagatcggcagggacgaagccaagccactgcagagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggta

SEQ ID NO: 490 - protein, 997 aa, Artificial Sequence
  CasX variant 494
MAPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKV

SEQ ID NO: 491 - DNA, 22 bp, Artificial Sequence
  T7 promoter primer
gaaattaatacgactcactata

SEQ ID NO: 492 - DNA, 87 bp, Artificial Sequence
  sg2 backbone fwd primer
gaaattaatacgactcactataggtactggcgcttttatctcattactttgagagccatcaccagcgactatgtcgtatgggtaaag

SEQ ID NO: 493 - DNA, 78 bp, Artificial Sequence
  sg2 backbone rev primer
ctttgatgcttcttatttatcggatttctctccgataaataagcgctttacccatacgacatagtcgctggtgatggc

SEQ ID NO: 494 - DNA, 54 bp, Artificial Sequence
  sg2.7.37 spacer primer
cggagcgagacatctcggccctttgatgcttcttatttatcggatttctctccg

SEQ ID NO: 495 - DNA, 90 bp, Artificial Sequence
  sg32 backbone fwd primer
gaaattaatacgactcactataggtactggcgcttttatctcattactttgagagccatcaccagcgactatgtcgtatgggtaaagcgc

SEQ ID NO: 496 - DNA, 46 bp, Artificial Sequence
  sg32 backbone rev primer
ctttgatgcttccctccgaagagggcgctttacccatacgacatag

SEQ ID NO: 497 - DNA, 43 bp, Artificial Sequence
  sg32.7.37 spacer primer
cggagcgagacatctcggccctttgatgcttccctccgaagag

SEQ ID NO: 498 - DNA, 90 bp, Artificial Sequence
  sg64 backbone fwd primer
gaaattaatacgactcactataggtactggcgcctttatctcattactttgagagccatcaccagcgactatgtcgtatgggtaaagcgc

SEQ ID NO: 499 - DNA, 54 bp, Artificial Sequence
  sg64 backbone rev primer
ctttgatgcttcttacggaccgaagtccgtaagcgctttacccatacgacatag

SEQ ID NO: 500 - DNA, 45 bp, Artificial Sequence
  sg64.7.37 spacer primer
cggagcgagacatctcggccctttgatgcttcttacggaccgaag

SEQ ID NO: 501 - DNA, 87 bp, Artificial Sequence
  sg174 backbone fwd primer
gaaattaatacgactcactataactggcgcttttatctgattactttgagagccatcaccagcgactatgtcgtagtgggtaaagct

SEQ ID NO: 502 - DNA, 50 bp, Artificial Sequence
  sg174 backbone rev primer
ctttgatgctccctccgaagagggagctttacccactacgacatagtcgc

SEQ ID NO: 503 - DNA, 36 bp, Artificial Sequence
  sg174.7.37 spacer primer
cggagcgagacatctcggccctttgatgctccctcc

SEQ ID NO: 504 - RNA, 130 nt, Artificial Sequence
  guide RNA
gguacuggcgcuuuuaucucauuacuuugagagccaucaccagcgacuaugucguauggguaaagcgcuuauuuaucggagagaaauccgauaaauaagaagcaucaaagggccgagaugucucgcuccg

SEQ ID NO: 505 - RNA, 107 nt, Artificial Sequence
  guide RNA
gguacuggcgcuuuuaucucauuacuuugagagccaucaccagcgacuaugucguauggguaaagcgcccucuucggagggaagcaucaaagggccgagaugucucg

SEQ ID NO: 506 - RNA, 120 nt, Artificial Sequence
  guide RNA
gguacuggcgccuuuaucucauuacuuugagagccaucaccagcgacuaugucguauggguaaagcgcuuacggacuucgguccguaagaagcaucaaagggccgagaugucucgcuccg

SEQ ID NO: 507 - RNA, 109 nt, Artificial Sequence
  guide RNA
acuggcgcuuuuaucugauuacuuugagagccaucaccagcgacuaugucguaguggguaaagcucccucuucggagggagcaucaaagggccgagaugucucgcuccg

SEQ ID NO: 508 - DNA, 20 bp, Artificial Sequence
  spacer sequence
gaggaggacggcctggccga

SEQ ID NO: 509 - DNA, 20 bp, Artificial Sequence
  spacer sequence
accgctgcgccaaggtgcgg

SEQ ID NO: 510 - DNA, 20 bp, Artificial Sequence
  spacer sequence
gccaggccgtcctcctcgga

SEQ ID NO: 511 - DNA, 20 bp, Artificial Sequence
  spacer sequence
gtgctcgggtgcttcggcca

SEQ ID NO: 512 - DNA, 20 bp, Artificial Sequence
  spacer sequence
atggccttcttcctggcttc

SEQ ID NO: 513 - DNA, 20 bp, Artificial Sequence
  spacer sequence
gcaccaccacgtaggtgcca

SEQ ID NO: 514 - DNA, 20 bp, Artificial Sequence
  spacer sequence
tcctggcttcctggtgaaga

SEQ ID NO: 515 - DNA, 20 bp, Artificial Sequence
  spacer sequence
tggcttcctggtgaagatga

SEQ ID NO: 516 - DNA, 20 bp, Artificial Sequence
  spacer sequence
ccaggaagccaggaagaagg

SEQ ID NO: 517 - DNA, 20 bp, Artificial Sequence
  spacer sequence
tccttgcatggggccaggat

SEQ ID NO: 518 - DNA, 20 bp, Artificial Sequence
  spacer sequence
ggcggcaagttctgctcagc

SEQ ID NO: 519 - DNA, 20 bp, Artificial Sequence
  spacer sequence
tctccacgatcgtcagcgtg

SEQ ID NO: 520 - DNA, 20 bp, Artificial Sequence
  spacer sequence
acgatcgtcagcgtgagtgc

SEQ ID NO: 521 - DNA, 20 bp, Artificial Sequence
  spacer sequence
ctctagcaatggatcgtggg

SEQ ID NO: 522 - DNA, 20 bp, Artificial Sequence
  spacer sequence
caaacaaatgtgtcacaaag

SEQ ID NO: 523 - DNA, 20 bp, Artificial Sequence
  spacer sequence
gatgtgtatatcacagacaa

SEQ ID NO: 524 - DNA, 20 bp, Artificial Sequence
  spacer sequence
ggaataatgctgttgttgaa

SEQ ID NO: 525 - DNA, 20 bp, Artificial Sequence
  spacer sequence
aaatccagtgacaagtctgt

SEQ ID NO: 526 - DNA, 20 bp, Artificial Sequence
  spacer sequence
aggccacagcactgttgctc

SEQ ID NO: 527 - DNA, 20 bp, Artificial Sequence
  spacer sequence
agaagacaccttcttcccca

SEQ ID NO: 528 - DNA, 20 bp, Artificial Sequence
  spacer sequence
tccccagcccaggtaagggc

SEQ ID NO: 529 - DNA, 20 bp, Artificial Sequence
  spacer sequence
ccagcccaggtaagggcagc

SEQ ID NO: 530 - DNA, 20 bp, Artificial Sequence
  spacer sequence
agtccctcaagtccttccag

SEQ ID NO: 531 - DNA, 20 bp, Artificial Sequence
  spacer sequence
agcagcagcagcagcagcag

SEQ ID NO: 532 - DNA, 20 bp, Artificial Sequence
  spacer sequence
tcagccgccgccgcaggcac

SEQ ID NO: 533 - DNA, 20 bp, Artificial Sequence
  spacer sequence
agggtcgccatggcggtctc

SEQ ID NO: 534 - DNA, 20 bp, Artificial Sequence
  spacer sequence
tcagcttttccagggtcgcc

SEQ ID NO: 535 - DNA, 20 bp, Artificial Sequence
  spacer sequence
gccgcagccgcccccgccgc

SEQ ID NO: 536 - DNA, 20 bp, Artificial Sequence
  spacer sequence
gccacagccgggccgggtgg

SEQ ID NO: 537 - DNA, 20 bp, Artificial Sequence
  spacer sequence
tcagccacagccgggccggg

SEQ ID NO: 538 - DNA, 20 bp, Artificial Sequence
  spacer sequence
cggtcggtgcagcggctcct

SEQ ID NO: 539 - DNA, 20 bp, Artificial Sequence
  spacer sequence
ccacaccttcactggtccat

SEQ ID NO: 540 - DNA, 20 bp, Artificial Sequence
  spacer sequence
taaaggaaagtaatggacca

SEQ ID NO: 541 - DNA, 20 bp, Artificial Sequence
  spacer sequence
ctggtccattactttccttt

SEQ ID NO: 542 - DNA, 20 bp, Artificial Sequence
  spacer sequence
atgttcatgagtttggagat

SEQ ID NO: 543 - DNA, 20 bp, Artificial Sequence
  spacer sequence
tgagtttggagataatacag

SEQ ID NO: 544 - DNA, 20 bp, Artificial Sequence
  spacer sequence
atagacacatcggccacacc

SEQ ID NO: 545 - DNA, 20 bp, Artificial Sequence
  spacer sequence
ttattaggcatgttggagac

SEQ ID NO: 546 - DNA, 20 bp, Artificial Sequence
  spacer sequence
caggagaccattgcatcatt

SEQ ID NO: 547 - DNA, 20 bp, Artificial Sequence
  spacer sequence
ggcctggaggctatccagcg

SEQ ID NO: 548 - DNA, 20 bp, Artificial Sequence
  spacer sequence
ggccgagatgtctcgctccg

SEQ ID NO: 549 - DNA, 20 bp, Artificial Sequence
  spacer sequence
aggccagaaagagagagtag

SEQ ID NO: 550 - DNA, 20 bp, Artificial Sequence
  spacer sequence
cgctggatagcctccaggcc

SEQ ID NO: 551 - DNA, 20 bp, Artificial Sequence
  spacer sequence
tgaagctgacagcattcggg

SEQ ID NO: 552 - RNA, 20 nt, Artificial Sequence
  spacer sequence
gaggaggacggccuggccga

SEQ ID NO: 553 - RNA, 20 nt, Artificial Sequence
  spacer sequence
accgcugcgccaaggugcgg

SEQ ID NO: 554 - RNA, 20 nt, Artificial Sequence
  spacer sequence
gccaggccguccuccucgga

SEQ ID NO: 555 - RNA, 20 nt, Artificial Sequence
  spacer sequence
gugcucgggugcuucggcca

SEQ ID NO: 556 - RNA, 20 nt, Artificial Sequence
  spacer sequence
auggccuucuuccuggcuuc

SEQ ID NO: 557 - RNA, 20 nt, Artificial Sequence
  spacer sequence
gcaccaccacguaggugcca

SEQ ID NO: 558 - RNA, 20 nt, Artificial Sequence
  spacer sequence
uccuggcuuccuggugaaga

SEQ ID NO: 559 - RNA, 20 nt, Artificial Sequence
  spacer sequence
uggcuuccuggugaagauga

SEQ ID NO: 560 - RNA, 20 nt, Artificial Sequence
  spacer sequence
ccaggaagccaggaagaagg

SEQ ID NO: 561 - RNA, 20 nt, Artificial Sequence
  spacer sequence
uccuugcauggggccaggau

SEQ ID NO: 562 - RNA, 20 nt, Artificial Sequence
  spacer sequence
ggcggcaaguucugcucagc

SEQ ID NO: 563 - RNA, 20 nt, Artificial Sequence
  spacer sequence
ucuccacgaucgucagcgug

SEQ ID NO: 564 - RNA, 20 nt, Artificial Sequence
  spacer sequence
acgaucgucagcgugagugc

SEQ ID NO: 565 - RNA, 20 nt, Artificial Sequence
  spacer sequence
cucuagcaauggaucguggg

SEQ ID NO: 566 - RNA, 20 nt, Artificial Sequence
  spacer sequence
caaacaaaugugucacaaag

SEQ ID NO: 567 - RNA, 20 nt, Artificial Sequence
  spacer sequence
gauguguauaucacagacaa

SEQ ID NO: 568 - RNA, 20 nt, Artificial Sequence
  spacer sequence
ggaauaaugcuguuguugaa

SEQ ID NO: 569 - RNA, 20 nt, Artificial Sequence
  spacer sequence
aaauccagugacaagucugu

SEQ ID NO: 570 - RNA, 20 nt, Artificial Sequence
  spacer sequence
aggccacagcacuguugcuc

SEQ ID NO: 571 - RNA, 20 nt, Artificial Sequence
  spacer sequence
agaagacaccuucuucccca

SEQ ID NO: 572 - RNA, 20 nt, Artificial Sequence
  spacer sequence
uccccagcccagguaagggc

SEQ ID NO: 573 - RNA, 20 nt, Artificial Sequence
  spacer sequence
ccagcccagguaagggcagc

SEQ ID NO: 574 - RNA, 20 nt, Artificial Sequence
  spacer sequence
agucccucaaguccuuccag

SEQ ID NO: 575 - RNA, 20 nt, Artificial Sequence
  spacer sequence
agcagcagcagcagcagcag

SEQ ID NO: 576 - RNA, 20 nt, Artificial Sequence
  spacer sequence
ucagccgccgccgcaggcac

SEQ ID NO: 577 - RNA, 20 nt, Artificial Sequence
  spacer sequence
agggucgccauggcggucuc

SEQ ID NO: 578 - RNA, 20 nt, Artificial Sequence
  spacer sequence
ucagcuuuuccagggucgcc

SEQ ID NO: 579 - RNA, 20 nt, Artificial Sequence
  spacer sequence
gccgcagccgcccccgccgc

SEQ ID NO: 580 - RNA, 20 nt, Artificial Sequence
  spacer sequence
gccacagccgggccgggugg

SEQ ID NO: 581 - RNA, 20 nt, Artificial Sequence
  spacer sequence
ucagccacagccgggccggg

SEQ ID NO: 582 - RNA, 20 nt, Artificial Sequence
  spacer sequence
cggucggugcagcggcuccu

SEQ ID NO: 583 - RNA, 20 nt, Artificial Sequence
  spacer sequence
ccacaccuucacugguccau

SEQ ID NO: 584 - RNA, 20 nt, Artificial Sequence
  spacer sequence
uaaaggaaaguaauggacca

SEQ ID NO: 585 - RNA, 20 nt, Artificial Sequence
  spacer sequence
cugguccauuacuuuccuuu

SEQ ID NO: 586 - RNA, 20 nt, Artificial Sequence
  spacer sequence
auguucaugaguuuggagau

SEQ ID NO: 587 - RNA, 20 nt, Artificial Sequence
  spacer sequence
ugaguuuggagauaauacag

SEQ ID NO: 588 - RNA, 20 nt, Artificial Sequence
  spacer sequence
auagacacaucggccacacc

SEQ ID NO: 589 - RNA, 20 nt, Artificial Sequence
  spacer sequence
uuauuaggcauguuggagac

SEQ ID NO: 590 - RNA, 20 nt, Artificial Sequence
  spacer sequence
caggagaccauugcaucauu

SEQ ID NO: 591 - RNA, 20 nt, Artificial Sequence
  spacer sequence
ggccuggaggcuauccagcg

SEQ ID NO: 592 - RNA, 20 nt, Artificial Sequence
  spacer sequence
ggccgagaugucucgcuccg

SEQ ID NO: 593 - RNA, 20 nt, Artificial Sequence
  spacer sequence
aggccagaaagagagaguag

SEQ ID NO: 594 - RNA, 20 nt, Artificial Sequence
  spacer sequence
cgcuggauagccuccaggcc

SEQ ID NO: 595 - RNA, 20 nt, Artificial Sequence
  spacer sequence
ugaagcugacagcauucggg

SEQ ID NO: 596 - DNA, 60 bp, Artificial Sequence
  beta-2 microglobulin (B2M) 7.37 oligonucleotide
tgaagctgacagcattcgggccgagatgtctcgctccgtggccttagctgtgctcgcgct

SEQ ID NO: 597 - DNA, 60 bp, Artificial Sequence; identical to SEQ ID NO: 596
  beta-2 microglobulin (B2M) 7.37 oligonucleotide

SEQ ID NO: 598 - DNA, 89 bp, Artificial Sequence
  gNA extension
gggtcggcatggcatctccacctcctcgcggtccgacctgggcatccgaaggaggacgcacgtccactcggatggctaagggagagcca

SEQ ID NO: 599 - DNA, 86 bp, Artificial Sequence
  gNA extension
ggccggcatggtcccagcctcctcgctggcgccggctgggcaacattccgaggggaccgtcccctcggtaatggcgaatgggaccc

SEQ ID NO: 600 - DNA, 69 bp, Artificial Sequence
  gNA extension
gatggccggcatggtcccagcctcctcgctggcgccggctgggcaacaccttcgggtggcgaatgggac

SEQ ID NO: 601 - DNA, 78 bp, Artificial Sequence
  gNA extension
ttttggccggcatggtcccagcctcctcgctggcgccggctgggcaacatgcttcggcatggcgaatgggaccccggg

SEQ ID NO: 602 - DNA, 78 bp, Artificial Sequence
  gNA extension
cattcctcagaaaatgacaaacctgtggggcgtaagtagatcttcggatctatgatcgtgcagacgttaaaatcaggt

SEQ ID NO: 603 - DNA, 64 bp, Artificial Sequence
  gNA extension
cgtggttagggccacgttaaatagttgcttaagccctaagcgttgatcttcggatcaggtgcaa

SEQ ID NO: 604 - DNA, 60 bp, Artificial Sequence
  gNA extension
gggagccccgctgatgaggtcggggagaccgaaagggacttcggtccctacggggctccc

SEQ ID NO: 605 - DNA, 52 bp, Artificial Sequence
  gNA extension
cctgtcaccggatgtgctttccggtctgatgagtccgtgaggacgaaacagg

SEQ ID NO: 606 - DNA, 63 bp, Artificial Sequence
  gNA extension
cgactactgatgagtccgtgaggacgaaacgagtaagctcgtctagtcgcgtgtagcgaagca

SEQ ID NO: 607 - DNA, 49 bp, Artificial Sequence
  gNA extension
cgactactgatgagtccgtgaggacgaaacgagtaagctcgtctagtcg

SEQ ID NO: 608 - DNA, 63 bp, Artificial Sequence
  gNA extension
ccagtactgatgagtccgtgaggacgaaacgagtaagctcgtctactggcgcttttatctcat

SEQ ID NO: 609 - DNA, 77 bp, Artificial Sequence
  gNA extension
acccgcaaggccgacggcatccgccgccgctggtgcaagtccagccgccccttcgggggcgggcgctcatgggtaac

SEQ ID NO: 610 - DNA, 76 bp, Artificial Sequence
  gNA extension
ggcaataaagcggttacaagcccgcaaaaatagcagagtaatgtcgcgatagcgcggcattaatgcagctttattg

SEQ ID NO: 611 - DNA, 36 bp, Artificial Sequence
  gNA extension
ccacccccaccaccacccccacccccaccaccaccc

SEQ ID NO: 612 - protein, 977 aa, Artificial Sequence
  Stx CasX Construct 2.2
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 613 - protein, 976 aa, Artificial Sequence; identical to SEQ ID NO: 117
  Stx CasX Construct 119.64

SEQ ID NO: 614 - RNA, 20 nt, Artificial Sequence
  Targeting sequence
uccauccgacauugaaguug

SEQ ID NO: 615 - RNA, 20 nt, Artificial Sequence
  Targeting sequence
aucucuuguacuacacugaa

SEQ ID NO: 616 - RNA, 20 nt, Artificial Sequence
  Targeting sequence
guguaguacaagagauagaa

SEQ ID NO: 617 - RNA, 20 nt, Artificial Sequence
  Targeting sequence
cacggcaggcauacucaucu

SEQ ID NO: 618 - RNA, 20 nt, Artificial Sequence
  Targeting sequence
uagaucgagacauguaagca

SEQ ID NO: 619 - RNA, 20 nt, Artificial Sequence
  Targeting sequence
aauuuacauacucugcuuag

SEQ ID NO: 620 - RNA, 20 nt, Artificial Sequence
  Targeting sequence
aagcagaguauguaaauugg

SEQ ID NO: 621 - RNA, 20 nt, Artificial Sequence
  Targeting sequence
ugaagcugacagcauucggg

SEQ ID NO: 622 - RNA, 20 nt, Artificial Sequence
  Targeting sequence
gguuuacucacgucauccag

SEQ ID NO: 623 - RNA, 20 nt, Artificial Sequence
  Targeting sequence
cucuccauucuucaguaagu

SEQ ID NO: 624 - RNA, 20 nt, Artificial Sequence
  Targeting sequence
gacuugucuuucagcaagga

SEQ ID NO: 625 - RNA, 20 nt, Artificial Sequence
  Targeting sequence
cccccacugaaaaagaugag

SEQ ID NO: 626 - RNA, 20 nt, Artificial Sequence
  Targeting sequence
uagaucgagacauguaagca

SEQ ID NO: 627 - RNA, 20 nt, Artificial Sequence
  Targeting sequence
ccacugucuuuuucauagau

SEQ ID NO: 628 - RNA, 20 nt, Artificial Sequence
  Targeting sequence
uugcuaaccuuuuucuuuuc

SEQ ID NO: 629 - RNA, 20 nt, Artificial Sequence
  Targeting sequence
uuucuuuucagguuugaaga

SEQ ID NO: 630 - RNA, 20 nt, Artificial Sequence
  Targeting sequence
uuucagguuugaagaugccg

SEQ ID NO: 631 - RNA, 20 nt, Artificial Sequence
  Targeting sequence
gguuugaagaugccgcauuu

SEQ ID NO: 632 - RNA, 20 nt, Artificial Sequence
  Targeting sequence
aaccugaaaagaaaagaaaa

SEQ ID NO: 633 - RNA, 20 nt, Artificial Sequence
  Targeting sequence
uccaauccaaaugcggcauc

SEQ ID NO: 634 - RNA, 20 nt, Artificial Sequence
  Targeting sequence
uggucaaauaaacaaagcug

SEQ ID NO: 635 - RNA, 20 nt, Artificial Sequence
  Targeting sequence
cauuuuccagauuaggaauc

SEQ ID NO: 636 - RNA, 20 nt, Artificial Sequence
  Targeting sequence
ggaaugcccgccagcgcgac

SEQ ID NO: 637 - RNA, 20 nt, Artificial Sequence
  Targeting sequence
ugaagcugacagcauucggg

SEQ ID NO: 638 - RNA, 20 nt, Artificial Sequence
  Targeting sequence
caaggucaaaaacuuaccuc

SEQ ID NO: 639 - RNA, 20 nt, Artificial Sequence
  Targeting sequence
uuucuuuucagguuugaaga

SEQ ID NO: 640 - RNA, 20 nt, Artificial Sequence
  Targeting sequence
aggcauaguuuuauaccuga

SEQ ID NO: 641 - RNA, 20 nt, Artificial Sequence
  Targeting sequence
ggccgagaugucucgcuccg

SEQ ID NO: 642 - RNA, 20 nt, Artificial Sequence
  Targeting sequence
auguuugauguaucugagca

SEQ ID NO: 643 - RNA, 20 nt, Artificial Sequence
  Targeting sequence
gauacaucaaacauggagac

SEQ ID NO: 644 - RNA, 20 nt, Artificial Sequence
  Targeting sequence
augaugcugcuuacaugucu

SEQ ID NO: 645 - RNA, 20 nt, Artificial Sequence
  Targeting sequence
cgucauccagcagagaaugg

SEQ ID NO: 646 - RNA, 20 nt, Artificial Sequence
  Targeting sequence
gcuggaugacgugaguaaac

SEQ ID NO: 647 - RNA, 20 nt, Artificial Sequence
  Targeting sequence
aggccagaaagagagaguag

SEQ ID NO: 648 - RNA, 20 nt, Artificial Sequence
  Targeting sequence
acugucuuuuucauagaucg

SEQ ID NO: 649 - RNA, 20 nt, Artificial Sequence
  Targeting sequence
aggucaaaaacuuaccucca

SEQ ID NO: 650 - RNA, 20 nt, Artificial Sequence
  Targeting sequence
augaugcugcuuacaugucu

SEQ ID NO: 651 - RNA, 20 nt, Artificial Sequence
  Targeting sequence
acuuauauuaaacgcgugcc

SEQ ID NO: 652 - RNA, 20 nt, Artificial Sequence
  Targeting sequence
cggcccgaaugcugucagcu

SEQ ID NO: 653 - RNA, 20 nt, Artificial Sequence
  Targeting sequence
agcgugagucucuccuaccc

SEQ ID NO: 654 - RNA, 20 nt, Artificial Sequence
  Targeting sequence
uuggaguaccugaggaauau

SEQ ID NO: 655 - RNA, 20 nt, Artificial Sequence
  Targeting sequence
auccgacauugaaguugacu

SEQ ID NO: 656 - RNA, 20 nt, Artificial Sequence
  Targeting sequence
gacauugaaguugacuuacu

SEQ ID NO: 657 - RNA, 20 nt, Artificial Sequence
  Targeting sequence
cuuguacuacacugaauuca

SEQ ID NO: 658 - RNA, 20 nt, Artificial Sequence
  Targeting sequence
uuuucagugggggugaauuc

SEQ ID NO: 659 - RNA, 20 nt, Artificial Sequence
  Targeting sequence
ugggcugugacaaagucaca

SEQ ID NO: 660 - RNA, 20 nt, Artificial Sequence
  Targeting sequence
agacauguaagcagcaucau

SEQ ID NO: 661 - RNA, 20 nt, Artificial Sequence
  Targeting sequence
ucaaaccugaaaagaaaaga

SEQ ID NO: 662 - RNA, 20 nt, Artificial Sequence
  Targeting sequence
aaaugcggcaucuucaaacc

SEQ ID NO: 663 - RNA, 20 nt, Artificial Sequence
  Targeting sequence
aauccaaaugcggcaucuuc

SEQ ID NO: 664 - RNA, 20 nt, Artificial Sequence
  Targeting sequence
gagcagguugcuccacaggu

SEQ ID NO: 665 - RNA, 20 nt, Artificial Sequence
  Targeting sequence
uaaaacuugauguguuaucu

SEQ ID NO: 666 - RNA, 20 nt, Artificial Sequence
  Targeting sequence
aacaucaacaucuuggucag

SEQ ID NO: 667 - RNA, 20 nt, Artificial Sequence
  Targeting sequence
cggcccgaaugcugucagcu

SEQ ID NO: 668 - RNA, 20 nt, Artificial Sequence
  Targeting sequence
ugauuggcugggcacgcguu

SEQ ID NO: 669 - RNA, 20 nt, Artificial Sequence
  Targeting sequence
cgcuccguggccuuagcugu

SEQ ID NO: 670 - RNA, 20 nt, Artificial Sequence
  Targeting sequence
aauaaacaaagcuggccauc

SEQ ID NO: 671 - RNA, 20 nt, Artificial Sequence
  Targeting sequence
uauaagauucauauuuacuu

SEQ ID NO: 672 - RNA, 20 nt, Artificial Sequence
  Targeting sequence
gggccgagaugucucgcucc

SEQ ID NO: 673 - RNA, 20 nt, Artificial Sequence
  Targeting sequence
aaugucggauggaugaaacc

SEQ ID NO: 674 - RNA, 20 nt, Artificial Sequence
  Targeting sequence
gcugugcucgcgcuacucuc

SEQ ID NO: 675 - RNA, 20 nt, Artificial Sequence
  Targeting sequence
cuggccuggaggcuauccag

SEQ ID NO: 676 - RNA, 20 nt, Artificial Sequence
  Targeting sequence
ccauucucugcuggaugacg

SEQ ID NO: 677 - RNA, 20 nt, Artificial Sequence
  Targeting sequence
cugaagaauggagagagaau

SEQ ID NO: 678 - RNA, 20 nt, Artificial Sequence
  Targeting sequence
ccuccaugaugcugcuuaca

SEQ ID NO: 679 - RNA, 20 nt, Artificial Sequence
  Targeting sequence
caauuuacauacucugcuua

SEQ ID NO: 680 - RNA, 20 nt, Artificial Sequence
  Targeting sequence
cacucaaagcuuguuaagau

SEQ ID NO: 681 - RNA, 20 nt, Artificial Sequence
  Targeting sequence
acaagcuuugagugcaagag

SEQ ID NO: 682 - RNA, 23 nt, Artificial Sequence
  Targeting sequence
ucggcccgaaugcugucagcuuc

SEQ ID NO: 683 - RNA, 23 nt, Artificial Sequence
  Targeting sequence
gccacggagcgagacaucucggc

SEQ ID NO: 684 - RNA, 23 nt, Artificial Sequence
  Targeting sequence
ggauagccuccaggccagaaaga

SEQ ID NO: 685 - RNA, 23 nt, Artificial Sequence
  Targeting sequence
uucuggccuggaggcuauccagc

SEQ ID NO: 686 - RNA, 23 nt, Artificial Sequence
  Targeting sequence
cgggaggguaggagagacucacg

SEQ ID NO: 687 - RNA, 23 nt, Artificial Sequence
  Targeting sequence
aaccugaaucuuuggaguaccug

SEQ ID NO: 688 - RNA, 23 nt, Artificial Sequence
  Targeting sequence
ugacgugaguaaaccugaaucuu

SEQ ID NO: 689 - RNA, 23 nt, Artificial Sequence
  Targeting sequence
ucugcuggaugacgugaguaaac

SEQ ID NO: 690 - RNA, 23 nt, Artificial Sequence
  Targeting sequence
agguuuacucacgucauccagca

SEQ ID NO: 691 - RNA, 23 nt, Artificial Sequence
  Targeting sequence
cuuuccauucucugcuggaugac

SEQ ID NO: 692 - RNA, 23 nt, Artificial Sequence
  Targeting sequence
cagagaauggaaagucaaauuuc

SEQ ID NO: 693 - RNA, 23 nt, Artificial Sequence
  Targeting sequence
aaauuuccugaauugcuaugugu

SEQ ID NO: 694 - RNA, 23 nt, Artificial Sequence
  Targeting sequence
caguaagucaacuucaaugucgg

SEQ ID NO: 695 - RNA, 23 nt, Artificial Sequence
  Targeting sequence
ccgacauugaaguugacuuacug

SEQ ID NO: 696 - RNA, 23 nt, Artificial Sequence
  Targeting sequence
guugacuuacugaagaauggaga

SEQ ID NO: 697 - RNA, 23 nt, Artificial Sequence
  Targeting sequence
ccaguccuugcugaaagacaagu

SEQ ID NO: 698 - RNA, 23 nt, Artificial Sequence
  Targeting sequence
gucuuucuaucucuuguacuaca

SEQ ID NO: 699 - RNA, 23 nt, Artificial Sequence
  Targeting sequence
ugaauucacccccacugaaaaag

SEQ ID NO: 700 - RNA, 23 nt, Artificial Sequence
  Targeting sequence
cauacucaucuuuuucagugggg

SEQ ID NO: 701 - RNA, 23 nt, Artificial Sequence
  Targeting sequence
caggcauacucaucuuuuucagu

SEQ ID NO: 702 - RNA, 23 nt, Artificial Sequence
  Targeting sequence
ugucacagcccaagauaguuaag

SEQ ID NO: 703 - RNA, 23 nt, Artificial Sequence
  Targeting sequence
uuucagguuugaagaugccgcau

SEQ ID NO: 704 - RNA, 23 nt, Artificial Sequence
  Targeting sequence
uucagguuugaagaugccgcauu

SEQ ID NO: 705 - RNA, 23 nt, Artificial Sequence
  Targeting sequence
gguuugaagaugccgcauuugga

SEQ ID NO: 706 - RNA, 23 nt, Artificial Sequence
  Targeting sequence
ugaagaugccgcauuuggauugg

SEQ ID NO: 707 - RNA, 23 nt, Artificial Sequence
  Targeting sequence
uaaauuuucccccaaauucuaag

SEQ ID NO: 708 - RNA, 23 nt, Artificial Sequence
  Targeting sequence
ucggcccgaaugcugucagcuuc

SEQ ID NO: 709 - RNA, 23 nt, Artificial Sequence
  Targeting sequence
gccacggagcgagacaucucggc

SEQ ID NO: 710 - RNA, 23 nt, Artificial Sequence
  Targeting sequence
ggauagccuccaggccagaaaga

SEQ ID NO: 711 - DNA, 38 bp, Artificial Sequence
  15.3 left homology arm FWD primer
agagagctgcagtggccaagattgatagcttgtgcctg

SEQ ID NO: 712 - DNA, 60 bp, Artificial Sequence
  15.3 left homology arm REV primer
agagatcccctgccctctccggatccggacgacacatttgtttgagaatcaaaatcggtg

SEQ ID NO: 713 - DNA, 60 bp, Artificial Sequence
  15.3 right homology arm FWD primer
gccggcgacgtggaggagaaccccggccccagtaaggattctgatgtgtatatcacagac

SEQ ID NO: 714 - DNA, 36 bp, Artificial Sequence
  15.3 right homology arm REV primer
gagagaaagcttgggttttggtggcaatggataagg

SEQ ID NO: 715 - DNA, 33 bp, Artificial Sequence
  15.5 left homology arm FWD primer
agagagctgcaggcatctggactccagcctggg

SEQ ID NO: 716 - DNA, 60 bp, Artificial Sequence
  15.5 left homology arm REV primer
gtaaggagagatcccctgccctctccggatccggaatttgcacatgcaaagtcagatttg

SEQ ID NO: 717 - DNA, 60 bp, Artificial Sequence
  15.5 right homology arm FWD primer
caggccggcgacgtggaggagaaccccggccccagtaacagcattattccagaagacacc

SEQ ID NO: 718 - DNA, 34 bp, Artificial Sequence
  15.5 right homology arm REV primer
gagagaaagcttaactcagttggagagactgagg

SEQ ID NO: 719 - DNA, 78 bp, Artificial Sequence
  eGFP FWD primer
ggagagggcaggggatctctccttacttgtggcgacgtggaggagaaccccggccccatggtgagcaagggcgaggag

SEQ ID NO: 720 - DNA, 85 bp, Artificial Sequence
  eGFP REV primer
ggggttctcctccacgtcgccggcctgcttcagcaggctgaagttggtggctccggatccggacttgtacagctcgtccatgccg

SEQ ID NO: 721 - DNA, 20 bp, Artificial Sequence
  15.3 amplification FWD primer
tggccaagattgatagcttg

SEQ ID NO: 722 - DNA, 18 bp, Artificial Sequence
  15.3 amplification REV primer
gggttttggtggcaatgg

SEQ ID NO: 723 - DNA, 21 bp, Artificial Sequence
  15.5 amplification FWD primer
gcatctggactccagcctggg

SEQ ID NO: 724 - DNA, 22 bp, Artificial Sequence
  15.5 amplification REV primer
aactcagttggagagactgagg

SEQ ID NO: 725 - RNA, 20 nt, Artificial Sequence
  B2M targeting sequence
uuauuagguaaaaaaaagac

SEQ ID NO: 726 - RNA, 20 nt, Artificial Sequence
  B2M targeting sequence
uuuuuuuaccuaauaaggac

SEQ ID NO: 727 - RNA, 20 nt, Artificial Sequence
  B2M targeting sequence
gacuguucauauugauaaau

SEQ ID NO: 728 - RNA, 20 nt, Artificial Sequence
  B2M targeting sequence
gaaaaaugucuuuuuuuuac

SEQ ID NO: 729 - RNA, 20 nt, Artificial Sequence
  B2M targeting sequence
uauugauaaauguagaaaau

SEQ ID NO: 730 - RNA, 20 nt, Artificial Sequence
  B2M targeting sequence
auaugaacagucagaaaaau

SEQ ID NO: 731 - RNA, 20 nt, Artificial Sequence
  B2M targeting sequence
acauuuaucaauaugaacag

SEQ ID NO: 732 - RNA, 20 nt, Artificial Sequence
  B2M targeting sequence
aauauacaaaagguuaaacu

SEQ ID NO: 733 - RNA, 20 nt, Artificial Sequence
  B2M targeting sequence
uaguuuaaccuuuuguauau

SEQ ID NO: 734 - RNA, 20 nt, Artificial Sequence
  B2M targeting sequence
accuuuuaaguauaucuuag

SEQ ID NO: 735 - RNA, 20 nt, Artificial Sequence
  B2M targeting sequence
uuagcauagggacaauauug

SEQ ID NO: 736 - RNA, 20 nt, Artificial Sequence
  B2M targeting sequence
cuaugcuaaugauguacucu

SEQ ID NO: 737 - RNA, 20 nt, Artificial Sequence
  B2M targeting sequence
auguggcaauauugucccua

SEQ ID NO: 738 - RNA, 20 nt, Artificial Sequence
  B2M targeting sequence
uuccauguggcaauauuguc

SEQ ID NO: 739 - RNA, 20 nt, Artificial Sequence
  B2M targeting sequence
ugucuuuccauguggcaaua

SEQ ID NO: 740 - RNA, 20 nt, Artificial Sequence
  B2M targeting sequence
augcaauaaacaagauauau

SEQ ID NO: 741 - RNA, 20 nt, Artificial Sequence
  B2M targeting sequence
uguuuauugcauugaaaauu

SEQ ID NO: 742 - RNA, 20 nt, Artificial Sequence
  B2M targeting sequence
uauaucuuguuuauugcauu

SEQ ID NO: 743 - RNA, 20 nt, Artificial Sequence
  B2M targeting sequence
acaauauuaaaaagaccuau

SEQ ID NO: 744 - RNA, 20 nt, Artificial Sequence
  B2M targeting sequence
uuuuaauauuguugaaauua

SEQ ID NO: 745 - RNA, 20 nt, Artificial Sequence
  B2M targeting sequence
aaguacauaggucuuuuuaa

SEQ ID NO: 746 - RNA, 20 nt, Artificial Sequence
  B2M targeting sequence
uacuuuuucaaaguacauag

SEQ ID NO: 747 - RNA, 20 nt, Artificial Sequence
  B2M targeting sequence
aaauacuauaaacaugcccu

SEQ ID NO: 748 - RNA, 20 nt, Artificial Sequence
  B2M targeting sequence
uagguuaaaaauaagggcau

SEQ ID NO: 749 - RNA, 20 nt, Artificial Sequence
  B2M targeting sequence
guuaaaauacuucauagguu

SEQ ID NO: 750 - RNA, 20 nt, Artificial Sequence
  B2M targeting sequence
auucaacuaaaaaaguuaaa

SEQ ID NO: 751 - RNA, 20 nt, Artificial Sequence
  B2M targeting sequence
acuaaaaaaguuaaaaaguc

SEQ ID NO: 752 - RNA, 20 nt, Artificial Sequence
  B2M targeting sequence
uuucuugguccuccuccccu

SEQ ID NO: 753 - RNA, 20 nt, Artificial Sequence
  B2M targeting sequence
ugguccuccuccccucuaau

SEQ ID NO: 754 - RNA, 20 nt, Artificial Sequence
  B2M targeting sequence
uccuccccucuaauuucaug

SEQ ID NO: 755 - RNA, 20 nt, Artificial Sequence
  B2M targeting sequence
cugcuggguucucaaacacc

SEQ ID NO: 756 - RNA, 20 nt, Artificial Sequence
  B2M targeting sequence
caaacaccuaaagauuucgg

SEQ ID NO: 757 - RNA, 20 nt, Artificial Sequence
  B2M targeting sequence
aacaccuaaagauuucggcu

SEQ ID NO: 758 - RNA, 20 nt, Artificial Sequence
  B2M targeting sequence
uuagguguuugagaacccag

SEQ ID NO: 759 - RNA, 20 nt, Artificial Sequence
  B2M targeting sequence
gcuuuucuuugccccauucc

SEQ ID NO: 760 - RNA, 20 nt, Artificial Sequence
  B2M targeting sequence
uugccccauuccucucuuua

SEQ ID NO: 761 - RNA, 20 nt, Artificial Sequence
  B2M targeting sequence
ucucuuuacagagccacauu

SEQ ID NO: 762 - RNA, 20 nt, Artificial Sequence
  B2M targeting sequence
cuuuacagagccacauucau

SEQ ID NO: 763 - RNA, 20 nt, Artificial Sequence
  B2M targeting sequence
uuacagagccacauucauag

SEQ ID NO: 764 - RNA, 20 nt, Artificial Sequence
  B2M targeting sequence
guaaagagaggaauggggca

SEQ ID NO: 765 - RNA, 20 nt, Artificial Sequence
  B2M targeting sequence
uagguacuugauacugcuaa

SEQ ID NO: 766 - RNA, 20 nt, Artificial Sequence
  B2M targeting sequence
aguaccuaugaauguggcuc

SEQ ID NO: 767 - RNA, 20 nt, Artificial Sequence
  B2M targeting sequence
ccuaaacuaguuuauaaaua

SEQ ID NO: 768 - RNA, 20 nt, Artificial Sequence
  B2M targeting sequence
gcguuuaguuuauaaacuua

SEQ ID NO: 769 - RNA, 20 nt, Artificial Sequence
  B2M targeting sequence
cugcguuuaguuuauaaacu

SEQ ID NO: 770 - RNA, 20 nt, Artificial Sequence
  B2M targeting sequence
ucuuucgagcaacuagacau

SEQ ID NO: 771 - RNA, 20 nt, Artificial Sequence
  B2M targeting sequence
uucgagcaacuagacaucaa

SEQ ID NO: 772 - RNA, 20 nt, Artificial Sequence
  B2M targeting sequence
agcaacuagacaucaagggu

SEQ ID NO: 773 - RNA, 20 nt, Artificial Sequence
  B2M targeting sequence
aaagaggaaucucugcguuu

SEQ ID NO: 774 - RNA, 20 nt, Artificial Sequence
  B2M targeting sequence
aguugcucgaaagaggaauc

SEQ ID NO: 775 - RNA, 20 nt, Artificial Sequence
  B2M targeting sequence
aggguagagaagacaaaccc

SEQ ID NO: 776 - RNA, 20 nt, Artificial Sequence
  B2M targeting sequence
acccuugaugucuaguugcu

SEQ ID NO: 777 - RNA, 20 nt, Artificial Sequence
  B2M targeting sequence
cuacccuugaugucuaguug

SEQ ID NO: 778 - RNA, 20 nt, Artificial Sequence
  B2M targeting sequence
ucucuacccuugaugucuag

SEQ ID NO: 779 - RNA, 20 nt, Artificial Sequence
  B2M targeting sequence
ggguuugucuucucuacccu

SEQ ID NO: 780 - RNA, 20 nt, Artificial Sequence
  B2M targeting sequence
ucuggguuugucuucucuac

SEQ ID NO: 781 - RNA, 20 nt, Artificial Sequence
  B2M targeting sequence
cugauguaucaaaugaaucu

SEQ ID NO: 782 - RNA, 20 nt, Artificial Sequence
  B2M targeting sequence
gugaaugcuuaacucuucug

SEQ ID NO: 783 - RNA, 20 nt, Artificial Sequence
  B2M targeting sequence
aaugaaucucuaaaugucag

SEQ ID NO: 784 - RNA, 20 nt, Artificial Sequence
  B2M targeting sequence
uuugauacaucagugaaugc

SEQ ID NO: 785 - RNA, 20 nt, Artificial Sequence
  B2M targeting sequence
cuaaaugucaggagcuguua

SEQ ID NO: 786 - RNA, 20 nt, Artificial Sequence
  B2M targeting sequence
aaaugucaggagcuguuaga

SEQ ID NO: 787 - RNA, 20 nt, Artificial Sequence
  B2M targeting sequence
ggagcuguuagaggagcugg

SEQ ID NO: 788 - RNA, 20 nt, Artificial Sequence
  B2M targeting sequence
ugacauuuagagauucauuu

SEQ ID NO: 789 - RNA, 20 nt, Artificial Sequence
  B2M targeting sequence
aacagcuccugacauuuaga

SEQ ID NO: 790 - RNA, 20 nt, Artificial Sequence
  B2M targeting sequence
ucuaacagcuccugacauuu

SEQ ID NO: 791 - RNA, 20 nt, Artificial Sequence
  B2M targeting sequence
agcuccucuaacagcuccug

SEQ ID NO: 792 - RNA, 20 nt, Artificial Sequence
  B2M targeting sequence
ccagcuccucuaacagcucc

SEQ ID NO: 793 - RNA, 20 nt, Artificial Sequence
  B2M targeting sequence
aagauuaauaagacaccuuu

SEQ ID NO: 794 - RNA, 20 nt, Artificial Sequence
  B2M targeting sequence
uggaaucuccagcuccucua

SEQ ID NO: 795 - RNA, 20 nt, Artificial Sequence
  B2M targeting sequence
uauuaaucuuggaaucucca

SEQ ID NO: 796 - RNA, 20 nt, Artificial Sequence
  B2M targeting sequence
ucuuaaagaaagaguuguga

SEQ ID NO: 797 - RNA, 20 nt, Artificial Sequence
  B2M targeting sequence
uaaagaaagaguugugaaaa

SEQ ID NO: 798 - RNA, 20 nt, Artificial Sequence
  B2M targeting sequence
uuaagaugaguagccaaaag

SEQ ID NO: 799 - RNA, 20 nt, Artificial Sequence
  B2M targeting sequence
uucuuuaagaugaguagcca

SEQ ID NO: 800 - RNA, 20 nt, Artificial Sequence
  B2M targeting sequence
caacucuuucuuuaagauga

SEQ ID NO: 801 - RNA, 20 nt, Artificial Sequence
  B2M targeting sequence
uuuaauaauuauuaauagua

SEQ ID NO: 802 - RNA, 20 nt, Artificial Sequence
  B2M targeting sequence
ggcucaguggcucacaccug

SEQ ID NO: 803 - RNA, 20 nt, Artificial Sequence
  B2M targeting sequence
guggcucacaccuguaaucc

SEQ ID NO: 804 - RNA, 20 nt, Artificial Sequence
  B2M targeting sequence
caccuguaaucccaacacuu

SEQ ID NO: 805 - RNA, 20 nt, Artificial Sequence
  B2M targeting sequence
caacacuuuggcagggagag

SEQ ID NO: 806 - RNA, 20 nt, Artificial Sequence
  B2M targeting sequence
cugccaaaguguugggauua

SEQ ID NO: 807 - RNA, 20 nt, Artificial Sequence
  B2M targeting sequence
cccugccaaaguguugggau

SEQ ID NO: 808 - RNA, 20 nt, Artificial Sequence
  B2M targeting sequence
cgccucucccugccaaagug

SEQ ID NO: 809 - RNA, 20 nt, Artificial Sequence
  B2M targeting sequence
cuugagcccaggagcuugag

SEQ ID NO: 810 - RNA, 20 nt, Artificial Sequence
  B2M targeting sequence
agugaucccgccucucccug

SEQ ID NO: 811 - RNA, 20 nt, Artificial Sequence
  B2M targeting sequence
ugggcucaagugaucccgcc

SEQ ID NO: 812 - RNA, 20 nt, Artificial Sequence
  B2M targeting sequence
agcuccugggcucaagugau

SEQ ID NO: 813 - RNA, 20 nt, Artificial Sequence
  B2M targeting sequence
caagcuccugggcucaagug

SEQ ID NO: 814 - RNA, 20 nt, Artificial Sequence
  B2M targeting sequence
cuguguugccuaggcuaguc

SEQ ID NO: 815 - RNA, 20 nt, Artificial Sequence
  B2M targeting sequence
cacuguguugccuaggcuag

SEQ ID NO: 816 - RNA, 20 nt, Artificial Sequence
  B2M targeting sequence
ucucuacaaaaacuagaaaa

SEQ ID NO: 817 - RNA, 20 nt, Artificial Sequence
  B2M targeting sequence
cuacaaaaacuagaaaaauu

SEQ ID NO: 818 - RNA, 20 nt, Artificial Sequence
  B2M targeting sequence
acaaaaacuagaaaaauuag

SEQ ID NO: 819 - RNA, 20 nt, Artificial Sequence
  B2M targeting sequence
aguuuuuguagagaugaggu

SEQ ID NO: 820 - RNA, 20 nt, Artificial Sequence
  B2M targeting sequence
uagcugcuggggaggcugag

SEQ ID NO: 821 - RNA, 20 nt, Artificial Sequence
  B2M targeting sequence
ccagcagcuacgacuacagg

SEQ ID NO: 822 - RNA, 20 nt, Artificial Sequence
  B2M targeting sequence
gccuccccagcagcuacgac

SEQ ID NO: 823 - RNA, 20 nt, Artificial Sequence
  B2M targeting sequence
cgggcucagccuccccagca

SEQ ID NO: 824 - RNA, 20 nt, Artificial Sequence
  B2M targeting sequence
aggcuggcugccgugaaccg

SEQ ID NO: 825 - RNA, 20 nt, Artificial Sequence
  B2M targeting sequence
cggcagccagccuugaccuc

SEQ ID NO: 826 - RNA, 20 nt, Artificial Sequence
  B2M targeting sequence
cgguucacggcagccagccu

SEQ ID NO: 827 - RNA, 20 nt, Artificial Sequence
  B2M targeting sequence
gucacgguucacggcagcca

SEQ ID NO: 828 - RNA, 20 nt, Artificial Sequence
  B2M targeting sequence
agccugggcgacagcgaccu

SEQ ID NO: 829 - RNA, 20 nt, Artificial Sequence
  B2M targeting sequence
cccaggcuggaguguagugg

SEQ ID NO: 830 - RNA, 20 nt, Artificial Sequence
  B2M targeting sequence
cugucgcccaggcuggagug

SEQ ID NO: 831 - RNA, 20 nt, Artificial Sequence
  B2M targeting sequence
uuaaaaaaaaaaaaaaaaaa

SEQ ID NO: 832 - RNA, 20 nt, Artificial Sequence
  B2M targeting sequence
aaacacuaagagggcguucc

SEQ ID NO: 833 - RNA, 20 nt, Artificial Sequence
  B2M targeting sequence
uaguguuuugagugggcugc

SEQ ID NO: 834 - RNA, 20 nt, Artificial Sequence
  B2M targeting sequence
caaacuuuaugauguaaacu

SEQ ID NO: 835 - RNA, 20 nt, Artificial Sequence
  B2M targeting sequence
uaaaguuugggaacgcccuc

SEQ ID NO: 836 - RNA, 20 nt, Artificial Sequence
  B2M targeting sequence
uaaguacugaaccaagaguu

SEQ ID NO: 837 - RNA, 20 nt, Artificial Sequence
  B2M targeting sequence
guacuuaagaguuuacauca

SEQ ID NO: 838 - RNA, 20 nt, Artificial Sequence
  B2M targeting sequence
ugguucaguacuuaagaguu

SEQ ID NO: 839 - RNA, 20 nt, Artificial Sequence
  B2M targeting sequence
guaacucuugguucaguacu

SEQ ID NO: 840 - RNA, 20 nt, Artificial Sequence
  B2M targeting sequence
uguuugucuuccccaaacau

SEQ ID NO: 841 - RNA, 20 nt, Artificial Sequence
  B2M targeting sequence
uccccaaacaugcgcgccuc

SEQ ID NO: 842 - RNA, 20 nt, Artificial Sequence
  B2M targeting sequence
ccaaacaugcgcgccucgca

SEQ ID NO: 843 - RNA, 20 nt, Artificial Sequence
  B2M targeting sequence
caagaaagaagugucuuacu

SEQ ID NO: 844 - RNA, 20 nt, Artificial Sequence
  B2M targeting sequence
ugcgaggcgcgcauguuugg

SEQ ID NO: 845 - RNA, 20 nt, Artificial Sequence
  B2M targeting sequence
uucuugcgaggcgcgcaugu

SEQ ID NO: 846 - RNA, 20 nt, Artificial Sequence
  B2M targeting sequence
uacucaacuuuuuaggcacu

SEQ ID NO: 847 - RNA, 20 nt, Artificial Sequence
  B2M targeting sequence
acuuuuuaggcacugcuccu

SEQ ID NO: 848 - RNA, 20 nt, Artificial Sequence
  B2M targeting sequence
uauguaacagcaagcacaca

SEQ ID NO: 849 - RNA, 20 nt, Artificial Sequence
  B2M targeting sequence
gcaaauauugugugcuugcu

SEQ ID NO: 850 - RNA, 20 nt, Artificial Sequence
  B2M targeting sequence
uuuauucagcaaauauugug

SEQ ID NO: 851 - RNA, 20 nt, Artificial Sequence
  B2M targeting sequence
cuucauuuauucagcaaaua

SEQ ID NO: 852 - RNA, 20 nt, Artificial Sequence
  B2M targeting sequence
aguuugucccuucauuuauu

SEQ ID NO: 853 - RNA, 20 nt, Artificial Sequence
  B2M targeting sequence
guccuugaagaagaggacua

SEQ ID NO: 854 - RNA, 20 nt, Artificial Sequence
  B2M targeting sequence
uugaagaagaggacuacaug

SEQ ID NO: 855 - RNA, 20 nt, Artificial Sequence
  B2M targeting sequence
aggacagaguccaguuuguc

SEQ ID NO: 856 - RNA, 20 nt, Artificial Sequence
  B2M targeting sequence
ucaaggacagaguccaguuu

SEQ ID NO: 857 - RNA, 20 nt, Artificial Sequence
  B2M targeting sequence
ucuucaaggacagaguccag

SEQ ID NO: 858 - RNA, 20 nt, Artificial Sequence
  B2M targeting sequence
ucuucuucaaggacagaguc

SEQ ID NO: 859 - RNA, 20 nt, Artificial Sequence
  B2M targeting sequence
cauguaguccucuucuucaa

SEQ ID NO: 860 - RNA, 20 nt, Artificial Sequence
  B2M targeting sequence
uucacauguaguccucuucu

SEQ ID NO: 861 - RNA, 20 nt, Artificial Sequence
  B2M targeting sequence
cuucaaggacaugaaaaaag

SEQ ID NO: 862 - RNA, 20 nt, Artificial Sequence
  B2M targeting sequence
aggacaugaaaaaaguauca

SEQ ID NO: 863 - RNA, 20 nt, Artificial Sequence
  B2M targeting sequence
uugaagugaauagcguuuuc

SEQ ID NO: 864 - RNA, 20 nt, Artificial Sequence
  B2M targeting sequence
uguccuugaagugaauagcg

SEQ ID NO: 865 - RNA, 20 nt, Artificial Sequence
  B2M targeting sequence
ggaugauucaaauuagagau

SEQ ID NO: 866 - RNA, 20 nt, Artificial Sequence
  B2M targeting sequence
ugauacuuuuuucauguccu

SEQ ID NO: 867 - RNA, 20 nt, Artificial Sequence
  B2M targeting sequence
uccugauacuuuuuucaugu

SEQ ID NO: 868 - RNA, 20 nt, Artificial Sequence
  B2M targeting sequence
aauuagagaugauccucagc

SEQ ID NO: 869 - RNA, 20 nt, Artificial Sequence
  B2M targeting sequence
aauuugaaucauccugauac

SEQ ID NO: 870 - RNA, 20 nt, Artificial Sequence
  B2M targeting sequence
cuaauuugaaucauccugau

SEQ ID NO: 871 - RNA, 20 nt, Artificial Sequence
  B2M targeting sequence
ucucuaauuugaaucauccu

SEQ ID NO: 872 - RNA, 20 nt, Artificial Sequence
  B2M targeting sequence
ucagcuggcaucuuuaacug

SEQ ID NO: 873 - RNA, 20 nt, Artificial Sequence
  B2M targeting sequence
gcuggcaucuuuaacugaaa

SEQ ID NO: 874 - RNA, 20 nt, Artificial Sequence
  B2M targeting sequence
uuaacugaaagaaaugggca

SEQ ID NO: 875 - RNA, 20 nt, Artificial Sequence
  B2M targeting sequence
guuaaagaugccagcugagg

SEQ ID NO: 876 - RNA, 20 nt, Artificial Sequence
  B2M targeting sequence
uucaguuaaagaugccagcu

SEQ ID NO: 877 - RNA, 20 nt, Artificial Sequence
  B2M targeting sequence
caugcccauuucuuucaguu

SEQ ID NO: 878 - RNA, 20 nt, Artificial Sequence
  B2M targeting sequence
acccugugacaguuaaucaa

SEQ ID NO: 879 - RNA, 20 nt, Artificial Sequence
  B2M targeting sequence
agucccaugcccauuucuuu

SEQ ID NO: 880 - RNA, 20 nt, Artificial Sequence
  B2M targeting sequence
cagggucgagucccaugccc

SEQ ID NO: 881 - RNA, 20 nt, Artificial Sequence
  B2M targeting sequence
accuguguugaauaaugaaa

SEQ ID NO: 882 - RNA, 20 nt, Artificial Sequence
  B2M targeting sequence
acacagguugauuaacuguc

SEQ ID NO: 883 - RNA, 20 nt, Artificial Sequence
  B2M targeting sequence
uuauucaacacagguugauu

SEQ ID NO: 884 - RNA, 20 nt, Artificial Sequence
  B2M targeting sequence
uucauuauucaacacagguu

SEQ ID NO: 885 - RNA, 20 nt, Artificial Sequence
  B2M targeting sequence
gcgccucagcugagacccgu

SEQ ID NO: 886 - RNA, 20 nt, Artificial Sequence
  B2M targeting sequence
gcugagacccguuccggguu

SEQ ID NO: 887 - RNA, 20 nt, Artificial Sequence
  B2M targeting sequence
gcugaggcgcugauucuuuc

SEQ ID NO: 888 - RNA, 20 nt, Artificial Sequence
  B2M targeting sequence
cagcugaggcgcugauucuu

SEQ ID NO: 889 - RNA, 20 nt, Artificial Sequence
  B2M targeting sequence
ggguucgccgcagguggcaa

SEQ ID NO: 890 - RNA, 20 nt, Artificial Sequence
  B2M targeting sequence
ccgcagguggcaauggagcu

SEQ ID NO: 891 - RNA, 20 nt, Artificial Sequence
  B2M targeting sequence
auugccaccugcggcgaacc

SEQ ID NO: 892 - RNA, 20 nt, Artificial Sequence
  B2M targeting sequence
ccgcccacccggaacaggag

SEQ ID NO: 893 - RNA, 20 nt, Artificial Sequence
  B2M targeting sequence
gcccacccggaacaggagag

SEQ ID NO: 894 - RNA, 20 nt, Artificial Sequence
  B2M targeting sequence
gggugggcggagacggcacc

SEQ ID NO: 895 - RNA, 20 nt, Artificial Sequence
  B2M targeting sequence
uguuccgggugggcggagac

SEQ ID NO: 896 - RNA, 20 nt, Artificial Sequence
  B2M targeting sequence
ccuguuccgggugggcggag

SEQ ID NO: 897 - RNA, 20 nt, Artificial Sequence
  B2M targeting sequence
ggcagcccagcucuccuguu

SEQ ID NO: 898 - RNA, 20 nt, Artificial Sequence
  B2M targeting sequence
uugcauucuggcagcccagc

SEQ ID NO: 899 - RNA, 20 nt, Artificial Sequence
  B2M targeting sequence
ccucguugcauucuggcagc

SEQ ID NO: 900 - RNA, 20 nt, Artificial Sequence
  B2M targeting sequence
ggucgggggaaagguucugu

SEQ ID NO: 901 - RNA, 20 nt, Artificial Sequence
  B2M targeting sequence
ggggaaagguucugugagga

SEQ ID NO: 902 - RNA, 20 nt, Artificial Sequence
  B2M targeting sequence
cccgaccugaaacgcucgcc

SEQ ID NO: 903 - RNA, 20 nt, Artificial Sequence
  B2M targeting sequence
gugaggaaaccacgcucgcc

SEQ ID NO: 904 - RNA, 20 nt, Artificial Sequence
  B2M targeting sequence
cagaaccuuucccccgaccu

SEQ ID NO: 905 - RNA, 20 nt, Artificial Sequence
  B2M targeting sequence
ucacagaaccuuucccccga

SEQ ID NO: 906 - RNA, 20 nt, Artificial Sequence
  B2M targeting sequence
ccucuggggcguuuccugca

SEQ ID NO: 907 - RNA, 20 nt, Artificial Sequence
  B2M targeting sequence
ggggcguuuccugcagcugg

SEQ ID NO: 908 - RNA, 20 nt, Artificial Sequence
  B2M targeting sequence
ugcagcuggcacccuucucc

SEQ ID NO: 909 - RNA, 20 nt, Artificial Sequence
  B2M targeting sequence
cccgccaccucuauggcugc

SEQ ID NO: 910 - RNA, 20 nt, Artificial Sequence
  B2M targeting sequence
cgccaccucuauggcugcag

SEQ ID NO: 911 - RNA, 20 nt, Artificial Sequence
  B2M targeting sequence
auggcugcagggaggccucg

SEQ ID NO: 912 - RNA, 20 nt, Artificial Sequence
  B2M targeting sequence
cugcagccauagagguggcg

SEQ ID NO: 913 - RNA, 20 nt, Artificial Sequence
  B2M targeting sequence
gcgugagcccuuggggcuca

SEQ ID NO: 914 - RNA, 20 nt, Artificial Sequence
  B2M targeting sequence
cgccgaggccucccugcagc

SEQ ID NO: 915 - RNA, 20 nt, Artificial Sequence
  B2M targeting sequence
gucagccgagccuaggcucu

SEQ ID NO: 916 - RNA, 20 nt, Artificial Sequence
  B2M targeting sequence
gccgagccuaggcucuggac

SEQ ID NO: 917 - RNA, 20 nt, Artificial Sequence
  B2M targeting sequence
gcugacugagccccaagggc

SEQ ID NO: 918 - RNA, 20 nt, Artificial Sequence
  B2M targeting sequence
ggacucccccaacggcccaa

SEQ ID NO: 919 - RNA, 20 nt, Artificial Sequence
  B2M targeting sequence
agagccuaggcucggcugac

SEQ ID NO: 920 - RNA, 20 nt, Artificial Sequence
  B2M targeting sequence
cccaacggcccaacucuccc

SEQ ID NO: 921 - RNA, 20 nt, Artificial Sequence
  B2M targeting sequence
cccucagcacuuacugccag

SEQ ID NO: 922 - RNA, 20 nt, Artificial Sequence
  B2M targeting sequence
cucagcacuuacugccagaa

SEQ ID NO: 923 - RNA, 20 nt, Artificial Sequence
  B2M targeting sequence
gcacuuacugccagaagggg

SEQ ID NO: 924 - RNA, 20 nt, Artificial Sequence
  B2M targeting sequence
ggcaguaagugcugagggag

SEQ ID NO: 925 - RNA, 20 nt, Artificial Sequence
  B2M targeting sequence
aggcagcagcgacccccgcc

SEQ ID NO: 926 - RNA, 20 nt, Artificial Sequence
  B2M targeting sequence
cugcugccuggagggccccu

SEQ ID NO: 927 - RNA, 20 nt, Artificial Sequence
  B2M targeting sequence
aagaaagcacuuggaggcug

SEQ ID NO: 928 - RNA, 20 nt, Artificial Sequence
  B2M targeting sequence
uugacgccuggcagccgggg

SEQ ID NO: 929 - RNA, 20 nt, Artificial Sequence
  B2M targeting sequence
aagugcuuucuuugacgccu

SEQ ID NO: 930 - RNA, 20 nt, Artificial Sequence
  B2M targeting sequence
ggcuccccagagccuccggc

SEQ ID NO: 931 - RNA, 20 nt, Artificial Sequence
  B2M targeting sequence
ccagagccuccggcugugug

SEQ ID NO: 932 - RNA, 20 nt, Artificial Sequence
  B2M targeting sequence
ggggagccugacggcugcgg

SEQ ID NO: 933 - RNA, 20 nt, Artificial Sequence
  B2M targeting sequence
ggcugugugcgcagcugcgc

SEQ ID NO: 934 - RNA, 20 nt, Artificial Sequence
  B2M targeting sequence
cgggcgcagcugcgcacaca

SEQ ID NO: 935 - RNA, 20 nt, Artificial Sequence
  B2M targeting sequence
gcucccgggcgcagcugcgc

SEQ ID NO: 936 - RNA, 20 nt, Artificial Sequence
  B2M targeting sequence
ccucggcggggacuggcacc

SEQ ID NO: 937 - RNA, 20 nt, Artificial Sequence
  B2M targeting sequence
gcggggacuggcaccaacag

SEQ ID NO: 938 - RNA, 20 nt, Artificial Sequence
  B2M targeting sequence
ccgccgaggcgauggggcag

SEQ ID NO: 939 - RNA, 20 nt, Artificial Sequence
  B2M targeting sequence
guagaacccgccccauggcc

SEQ ID NO: 940 - RNA, 20 nt, Artificial Sequence
  B2M targeting sequence
accgaugcuguuggugccag

SEQ ID NO: 941 - RNA, 20 nt, Artificial Sequence
  B2M targeting sequence
gccggcgguagcuggggcac

SEQ ID NO: 942 - RNA, 20 nt, Artificial Sequence
  B2M targeting sequence
cgaccccuuccucugcagcc

SEQ ID NO: 943 - RNA, 20 nt, Artificial Sequence
  B2M targeting sequence
cgagugcugcuuccgccggc

SEQ ID NO: 944 - RNA, 20 nt, Artificial Sequence
  B2M targeting sequence
ucugcagccaucuuggcccg

SEQ ID NO: 945 - RNA, 20 nt, Artificial Sequence
  B2M targeting sequence
gcagccaucuuggcccggcg

SEQ ID NO: 946 - RNA, 20 nt, Artificial Sequence
  B2M targeting sequence
uggcccggcgguuacuuccg

SEQ ID NO: 947 - RNA, 20 nt, Artificial Sequence
  B2M targeting sequence
ggucacuuucgccggaaccu

SEQ ID NO: 948 - RNA, 20 nt, Artificial Sequence
  B2M targeting sequence
cuuucgccggaaccugacug

SEQ ID NO: 949 - RNA, 20 nt, Artificial Sequence
  B2M targeting sequence
ccggaaccugacugcgucgu

SEQ ID NO: 950 - RNA, 20 nt, Artificial Sequence
  B2M targeting sequence
ggcgaaagugaccggaagua

SEQ ID NO: 951 - RNA, 20 nt, Artificial Sequence
  B2M targeting sequence
gguuccggcgaaagugaccg

SEQ ID NO: 952 - RNA, 20 nt, Artificial Sequence
  B2M targeting sequence
ugggcaugcgcgguguacgu

SEQ ID NO: 953 - RNA, 20 nt, Artificial Sequence
  B2M targeting sequence
cgcucggccucgugacuccc

SEQ ID NO: 954 - RNA, 20 nt, Artificial Sequence
  B2M targeting sequence
gccucgugacucccgcggag

SEQ ID NO: 955 - RNA, 20 nt, Artificial Sequence
  B2M targeting sequence
ugacucccgcggagaccucu

SEQ ID NO: 956 - RNA, 20 nt, Artificial Sequence
  B2M targeting sequence
cgaggccgagcgggagccgc

SEQ ID NO: 957 - RNA, 20 nt, Artificial Sequence
  B2M targeting sequence
cgcggagaccucucggcugu

SEQ ID NO: 958 - RNA, 20 nt, Artificial Sequence
  B2M targeting sequence
gcgggagucacgaggccgag

SEQ ID NO: 959 - RNA, 20 nt, Artificial Sequence
  B2M targeting sequence
ccgcgggagucacgaggccg

SEQ ID NO: 960 - RNA, 20 nt, Artificial Sequence
  B2M targeting sequence
cggcugucuccggucgauuc

SEQ ID NO: 961 - RNA, 20 nt, Artificial Sequence
  B2M targeting sequence
gcugucuccggucgauucca

SEQ ID NO: 962 - RNA, 20 nt, Artificial Sequence
  B2M targeting sequence
ccggucgauuccauucguuu

SEQ ID NO: 963 - RNA, 20 nt, Artificial Sequence
  B2M targeting sequence
ggucgauuccauucguuucc

SEQ ID NO: 964 - RNA, 20 nt, Artificial Sequence
  B2M targeting sequence
auuccauucguuuccugugg

SEQ ID NO: 965 - RNA, 20 nt, Artificial Sequence
  B2M targeting sequence
accggagacagccgagaggu

SEQ ID NO: 966 - RNA, 20 nt, Artificial Sequence
  B2M targeting sequence
auucguuuccuguggggggc

SEQ ID NO: 967 - RNA, 20 nt, Artificial Sequence
  B2M targeting sequence
uuuccuguggggggcaguac

SEQ ID NO: 968 - RNA, 20 nt, Artificial Sequence
  B2M targeting sequence
uguggggggcaguaccagcc

SEQ ID NO: 969 - RNA, 20 nt, Artificial Sequence
  B2M targeting sequence
cuagcaaagccacaucugcc

SEQ ID NO: 970 - RNA, 20 nt, Artificial Sequence
  B2M targeting sequence
agcaaagccacaucugcccu

SEQ ID NO: 971 - RNA, 20 nt, Artificial Sequence
  B2M targeting sequence
gcccugacgccagucccacu

SEQ ID NO: 972 - RNA, 20 nt, Artificial Sequence
  B2M targeting sequence
gggcagauguggcuuugcua

SEQ ID NO: 973 - RNA, 20 nt, Artificial Sequence
  B2M targeting sequence
cacucugcuuaacugcucug

SEQ ID NO: 974 - RNA, 20 nt, Artificial Sequence
  B2M targeting sequence
gcuuaacugcucuggcaugc

SEQ ID NO: 975 - RNA, 20 nt, Artificial Sequence
  B2M targeting sequence
ggcaugcuugaaggccuagc

SEQ ID NO: 976 - RNA, 20 nt, Artificial Sequence
  B2M targeting sequence
agcaugccagagcaguuaag

SEQ ID NO: 977 - RNA, 20 nt, Artificial Sequence
  B2M targeting sequence
cgcucuguggcauugcucuu

SEQ ID NO: 978 - RNA, 20 nt, Artificial Sequence
  B2M targeting sequence
cucuguggcauugcucuuug

SEQ ID NO: 979 - RNA, 20 nt, Artificial Sequence
  B2M targeting sequence
guggcauugcucuuugccuu

SEQ ID NO: 980 - RNA, 20 nt, Artificial Sequence
  B2M targeting sequence
uugccuucuugguccagcug

SEQ ID NO: 981 - RNA, 20 nt, Artificial Sequence
  B2M targeting sequence
ugguccagcugccuccagcu

SEQ ID NO: 982 - RNA, 20 nt, Artificial Sequence
  B2M targeting sequence
agcugccuccagcucccuug

SEQ ID NO: 983 - RNA, 20 nt, Artificial Sequence
  B2M targeting sequence
agcucccuuggaacccaguu

SEQ ID NO: 984 - RNA, 20 nt, Artificial Sequence
  B2M targeting sequence
cuuggaacccaguuccugcc

SEQ ID NO: 985 - RNA, 20 nt, Artificial Sequence
  B2M targeting sequence
aagggagcuggaggcagcug

SEQ ID NO: 986 - RNA, 20 nt, Artificial Sequence
  B2M targeting sequence
ugccucuuuucuucgcuuuu

SEQ ID NO: 987 - RNA, 20 nt, Artificial Sequence
  B2M targeting sequence
uuucuucgcuuuucuuauug

SEQ ID NO: 988 - RNA, 20 nt, Artificial Sequence
  B2M targeting sequence
ucgcuuuucuuauugugcug

SEQ ID NO: 989 - RNA, 20 nt, Artificial Sequence
  B2M targeting sequence
cuuuucuuauugugcuguuc

SEQ ID NO: 990 - RNA, 20 nt, Artificial Sequence
  B2M targeting sequence
uauugugcuguucgcuuaca

SEQ ID NO: 991 - RNA, 20 nt, Artificial Sequence
  B2M targeting sequence
cuuacaggcucugggguggu

SEQ ID NO: 992 - RNA, 20 nt, Artificial Sequence
  B2M targeting sequence
gggguggugccauuuccuug

SEQ ID NO: 993 - RNA, 20 nt, Artificial Sequence
  B2M targeting sequence
uugguagcauggaccgucuu

SEQ ID NO: 994 - RNA, 20 nt, Artificial Sequence
  B2M targeting sequence
augcuaccaaggaaauggca

SEQ ID NO: 995 - RNA, 20 nt, Artificial Sequence
  B2M targeting sequence
uacaguguggauccauagua

SEQ ID NO: 996 - RNA, 20 nt, Artificial Sequence
  B2M targeting sequence
acacuguaagacgguccaug

SEQ ID NO: 997 - RNA, 20 nt, Artificial Sequence
  B2M targeting sequence
auaguaaggguguugacccg

SEQ ID NO: 998 - RNA, 20 nt, Artificial Sequence
  B2M targeting sequence
acacccuuacuauggaucca

SEQ ID NO: 999 - RNA, 20 nt, Artificial Sequence
  B2M targeting sequence
ggucaacacccuuacuaugg

SEQ ID NO: 1000 - RNA, 20 nt, Artificial Sequence
  B2M targeting sequence
aauuucgggucaacacccuu

SEQ ID NO: 1001 - RNA, 20 nt, Artificial Sequence
  B2M targeting sequence
aauaauauccauuguaacag

SEQ ID NO: 1002 - RNA, 20 nt, Artificial Sequence
  B2M targeting sequence
auuguaacagucagagagac

SEQ ID NO: 1003 - RNA, 20 nt, Artificial Sequence
  B2M targeting sequence
gagagacgggguaaguaagg

SEQ ID NO: 1004 - RNA, 20 nt, Artificial Sequence
  B2M targeting sequence
gacuguuacaauggauauua

SEQ ID NO: 1005 - RNA, 20 nt, Artificial Sequence
  B2M targeting sequence
cugacuguuacaauggauau

SEQ ID NO: 1006 - RNA, 20 nt, Artificial Sequence
  B2M targeting sequence
cucugacuguuacaauggau

SEQ ID NO: 1007 - RNA, 20 nt, Artificial Sequence
  B2M targeting sequence
accccuuacuuaccccgucu

SEQ ID NO: 1008 - RNA, 20 nt, Artificial Sequence
  B2M targeting sequence
ccaccccuuacuuaccccgu

SEQ ID NO: 1009 - RNA, 20 nt, Artificial Sequence
  B2M targeting sequence
accaucuccaccccuuacuu

SEQ ID NO: 1010 - RNA, 20 nt, Artificial Sequence
  B2M targeting sequence
cuaccaucuccaccccuuac

SEQ ID NO: 1011 - RNA, 20 nt, Artificial Sequence
  B2M targeting sequence
ugucuguuuucucagggaag

SEQ ID NO: 1012 - RNA, 20 nt, Artificial Sequence
  B2M targeting sequence
guuuucucagggaaguauga

SEQ ID NO: 1013 - RNA, 20 nt, Artificial Sequence
  B2M targeting sequence
cagggaaguaugauccaaga

SEQ ID NO: 1014 - RNA, 20 nt, Artificial Sequence
  B2M targeting sequence
gggaaguaugauccaagauc

SEQ ID NO: 1015 - RNA, 20 nt, Artificial Sequence
  B2M targeting sequence
cugagaaaacagacaggagc

SEQ ID NO: 1016 - RNA, 20 nt, Artificial Sequence
  B2M targeting sequence
uacuucccugagaaaacaga

SEQ ID NO: 1017 - RNA, 20 nt, Artificial Sequence
  B2M targeting sequence
aagaucaagagaaggagagg

SEQ ID NO: 1018 - RNA, 20 nt, Artificial Sequence
  B2M targeting sequence
uggaucauacuucccugaga

SEQ ID NO: 1019 - RNA, 20 nt, Artificial Sequence
  B2M targeting sequence
agagaaggagaggagcaaag

SEQ ID NO: 1020 - RNA, 20 nt, Artificial Sequence
  B2M targeting sequence
ugaucuuggaucauacuucc

SEQ ID NO: 1021 - RNA, 20 nt, Artificial Sequence
  B2M targeting sequence
cuugaucuuggaucauacuu

SEQ ID NO: 1022 - RNA, 20 nt, Artificial Sequence
  B2M targeting sequence
uucucuugaucuuggaucau

SEQ ID NO: 1023 - RNA, 20 nt, Artificial Sequence
  B2M targeting sequence
ccuucucuugaucuuggauc

SEQ ID NO: 1024 - RNA, 20 nt, Artificial Sequence
  B2M targeting sequence
ucuccuucucuugaucuugg

SEQ ID NO: 1025 - RNA, 20 nt, Artificial Sequence
  B2M targeting sequence
uugcuccucuccuucucuug

SEQ ID NO: 1026 - RNA, 20 nt, Artificial Sequence
  B2M targeting sequence
aacucuuugcuccucuccuu

SEQ ID NO: 1027 - RNA, 20 nt, Artificial Sequence
  B2M targeting sequence
ccucaaacucuuugcuccuc

SEQ ID NO: 1028 - RNA, 20 nt, Artificial Sequence
  B2M targeting sequence
caccucaaacucuuugcucc

SEQ ID NO: 1029 - RNA, 20 nt, Artificial Sequence
  B2M targeting sequence
ucucaccucaaacucuuugc

SEQ ID NO: 1030 - RNA, 20 nt, Artificial Sequence
  B2M targeting sequence
accccucuucucaccucaaa

SEQ ID NO: 1031 - RNA, 20 nt, Artificial Sequence
  B2M targeting sequence
ccuaaaagacaacuguaccu

SEQ ID NO: 1032 - RNA, 20 nt, Artificial Sequence
  B2M targeting sequence
uaaaagacaacuguaccuuc

SEQ ID NO: 1033 - RNA, 20 nt, Artificial Sequence
  B2M targeting sequence
uuuaggagacuuuaccaaaa

SEQ ID NO: 1034 - RNA, 20 nt, Artificial Sequence
  B2M targeting sequence
uaacacaucuuccacauuca

SEQ ID NO: 1035 - RNA, 20 nt, Artificial Sequence
  B2M targeting sequence
uccacauucagaacauuuca

SEQ ID NO: 1036 - RNA, 20 nt, Artificial Sequence
  B2M targeting sequence
acauucagaacauuucagca

SEQ ID NO: 1037 - RNA, 20 nt, Artificial Sequence
  B2M targeting sequence
gaacauuucagcauaaaugu

SEQ ID NO: 1038 - RNA, 20 nt, Artificial Sequence
  B2M targeting sequence
gaauguggaagauguguuaa

SEQ ID NO: 1039 - RNA, 20 nt, Artificial Sequence
  B2M targeting sequence
gcauaaauguaaccucuauu

SEQ ID NO: 1040 - RNA, 20 nt, Artificial Sequence
  B2M targeting sequence
auugacaggccuccccaagc

SEQ ID NO: 1041 - RNA, 20 nt, Artificial Sequence
  B2M targeting sequence
auagagguuacauuuaugcu

SEQ ID NO: 1042 - RNA, 20 nt, Artificial Sequence
  B2M targeting sequence
ccaagccauucaaccuaagg

SEQ ID NO: 1043 - RNA, 20 nt, Artificial Sequence
  B2M targeting sequence
accuaaggucccuucuacug

SEQ ID NO: 1044 - RNA, 20 nt, Artificial Sequence
  B2M targeting sequence
cuucuacugcagucucucac

SEQ ID NO: 1045 - RNA, 20 nt, Artificial Sequence
  B2M targeting sequence
acugcagucucucaccuagu

SEQ ID NO: 1046 - RNA, 20 nt, Artificial Sequence
  B2M targeting sequence
cucaccuaguuuuguuuuua

SEQ ID NO: 1047 - RNA, 20 nt, Artificial Sequence
  B2M targeting sequence
caccuaguuuuguuuuuaau

SEQ ID NO: 1048 - RNA, 20 nt, Artificial Sequence
  B2M targeting sequence
ccuaguuuuguuuuuaauca

SEQ ID NO: 1049 - RNA, 20 nt, Artificial Sequence
  B2M targeting sequence
uaguauuuaucacuacuuga

SEQ ID NO: 1050 - RNA, 20 nt, Artificial Sequence
  B2M targeting sequence
cuacuugauauuuucugcca

SEQ ID NO: 1051 - RNA, 20 nt, Artificial Sequence
  B2M targeting sequence
aguagugauaaauacuauga

SEQ ID NO: 1052 - RNA, 20 nt, Artificial Sequence
  B2M targeting sequence
gccaguuccuguccaauaag

SEQ ID NO: 1053 - RNA, 20 nt, Artificial Sequence
  B2M targeting sequence
uguccaauaagaauguaaac

SEQ ID NO: 1054 - RNA, 20 nt, Artificial Sequence
  B2M targeting sequence
aauaagaauguaaacuucaa

SEQ ID NO: 1055 - RNA, 20 nt, Artificial Sequence
  B2M targeting sequence
uauuggacaggaacuggcag

SEQ ID NO: 1056 - RNA, 20 nt, Artificial Sequence
  B2M targeting sequence
aaagagcaaggacuuuguug

SEQ ID NO: 1057 - RNA, 20 nt, Artificial Sequence
  B2M targeting sequence
uuugaaguuuacauucuuau

SEQ ID NO: 1058 - RNA, 20 nt, Artificial Sequence
  B2M targeting sequence
uugcucuuuugaaguuuaca

SEQ ID NO: 1059 - RNA, 20 nt, Artificial Sequence
  B2M targeting sequence
ccacuguccuggcuaguacc

SEQ ID NO: 1060 - RNA, 20 nt, Artificial Sequence
  B2M targeting sequence
uggcuaguaccuaaaacagu

SEQ ID NO: 1061 - RNA, 20 nt, Artificial Sequence
  B2M targeting sequence
ugaaagguacucccgcauuu

SEQ ID NO: 1062 - RNA, 20 nt, Artificial Sequence
  B2M targeting sequence
ugaaacaugcacuguuuuag

SEQ ID NO: 1063 - RNA, 20 nt, Artificial Sequence
  B2M targeting sequence
cgcauuuguugaucaaugca

SEQ ID NO: 1064 - RNA, 20 nt, Artificial Sequence
  B2M targeting sequence
acaaaugcgggaguaccuuu

SEQ ID NO: 1065 - RNA, 20 nt, Artificial Sequence
  B2M targeting sequence
augcaugaccuuauuuguca

SEQ ID NO: 1066 - RNA, 20 nt, Artificial Sequence
  B2M targeting sequence
ugcauugaucaacaaaugcg

SEQ ID NO: 1067 - RNA, 20 nt, Artificial Sequence
  B2M targeting sequence
aaauaaaagcaaacuuuuuu

SEQ ID NO: 1068 - RNA, 20 nt, Artificial Sequence
  B2M targeting sequence
uuugagauggagucucgcuu

SEQ ID NO: 1069 - RNA, 20 nt, Artificial Sequence
  B2M targeting sequence
aaagaaaaaaaaaguuugcu

SEQ ID NO: 1070 - RNA, 20 nt, Artificial Sequence
  B2M targeting sequence
caaaagaaaaaaaaaguuug

SEQ ID NO: 1071 - RNA, 20 nt, Artificial Sequence
  B2M targeting sequence
aucucaaaagaaaaaaaaag

SEQ ID NO: 1072 - RNA, 20 nt, Artificial Sequence
  B2M targeting sequence
cgcuuugucacucaggcugg

SEQ ID NO: 1073 - RNA, 20 nt, Artificial Sequence
  B2M targeting sequence
cuuugucacucaggcuggag

SEQ ID NO: 1074 - RNA, 20 nt, Artificial Sequence
  B2M targeting sequence
cucaggcuggagugcagugg

SEQ ID NO: 1075 - RNA, 20 nt, Artificial Sequence
  B2M targeting sequence
ggcuggagugcaguggcggg

SEQ ID NO: 1076 - RNA, 20 nt, Artificial Sequence
  B2M targeting sequence
agccugagugacaaagcgag

SEQ ID NO: 1077 - RNA, 20 nt, Artificial Sequence
  B2M targeting sequence
cgccacugcacuccagccug

SEQ ID NO: 1078 - RNA, 20 nt, Artificial Sequence
  B2M targeting sequence
cggcucacugcaaccuccgc

SEQ ID NO: 1079 - RNA, 20 nt, Artificial Sequence
  B2M targeting sequence
gcucacugcaaccuccgccu

SEQ ID NO: 1080 - RNA, 20 nt, Artificial Sequence
  B2M targeting sequence
cugcaaccuccgccuccugg

SEQ ID NO: 1081 - RNA, 20 nt, Artificial Sequence
  B2M targeting sequence
gccuccugggcucaagcaau

SEQ ID NO: 1082 - RNA, 20 nt, Artificial Sequence
  B2M targeting sequence
ugggcucaagcaauucugcc

SEQ ID NO: 1083 - RNA, 20 nt, Artificial Sequence
  B2M targeting sequence
agcaauucugccucagccuu

SEQ ID NO: 1084 - RNA, 20 nt, Artificial Sequence
  B2M targeting sequence
gccucagccuucccaguagc

SEQ ID NO: 1085 - RNA, 20 nt, Artificial Sequence
  B2M targeting sequence
gccuucccaguagcugggau

SEQ ID NO: 1086 - RNA, 20 nt, Artificial Sequence
  B2M targeting sequence
caguagcugggauuacaggc

SEQ ID NO: 1087 - RNA, 20 nt, Artificial Sequence
  B2M targeting sequence
cagcuacugggaaggcugag

SEQ ID NO: 1088 - RNA, 20 nt, Artificial Sequence
  B2M targeting sequence
acuaaaauacaaaaauuuag

SEQ ID NO: 1089 - RNA, 20 nt, Artificial Sequence
  B2M targeting sequence
cuacuaaaauacaaaaauuu

SEQ ID NO: 1090 - RNA, 20 nt, Artificial Sequence
  B2M targeting sequence
ccauguuggccaggcugguu

SEQ ID NO: 1091 - RNA, 20 nt, Artificial Sequence
  B2M targeting sequence
aauuccugaccuccggugau

SEQ ID NO: 1092 - RNA, 20 nt, Artificial Sequence
  B2M targeting sequence
aaaccagccuggccaacaug

SEQ ID NO: 1093 - RNA, 20 nt, Artificial Sequence
  B2M targeting sequence
ugaccuccggugauuuaccu

SEQ ID NO: 1094 - RNA, 20 nt, Artificial Sequence
  B2M targeting sequence
ggaauucgaaaccagccugg

SEQ ID NO: 1095 - RNA, 20 nt, Artificial Sequence
  B2M targeting sequence
ggugauuuaccugucccagc

SEQ ID NO: 1096 - RNA, 20 nt, Artificial Sequence
  B2M targeting sequence
ccggaggucaggaauucgaa

SEQ ID NO: 1097 - RNA, 20 nt, Artificial Sequence
  B2M targeting sequence
cagccuggaagugcuaagau

SEQ ID NO: 1098 - RNA, 20 nt, Artificial Sequence
  B2M targeting sequence
aggcugggacagguaaauca

SEQ ID NO: 1099 - RNA, 20 nt, Artificial Sequence
  B2M targeting sequence
uagcacuuccaggcugggac

SEQ ID NO: 1100 - RNA, 20 nt, Artificial Sequence
  B2M targeting sequence
guaaucuuagcacuuccagg

SEQ ID NO: 1101 - RNA, 20 nt, Artificial Sequence
  B2M targeting sequence
cgucuguaaucuuagcacuu

SEQ ID NO: 1102 - RNA, 20 nt, Artificial Sequence
  B2M targeting sequence
gcugggcacgguggcucacg

SEQ ID NO: 1103 - RNA, 20 nt, Artificial Sequence
  B2M targeting sequence
aucacaagggagauauauuc

SEQ ID NO: 1104 - RNA, 20 nt, Artificial Sequence
  B2M targeting sequence
caagggagauauauucaacc

SEQ ID NO: 1105 - RNA, 20 nt, Artificial Sequence
  B2M targeting sequence
cuugugauagaaaacguuug

SEQ ID NO: 1106 - RNA, 20 nt, Artificial Sequence
  B2M targeting sequence
cccuugugauagaaaacguu

SEQ ID NO: 1107 - RNA, 20 nt, Artificial Sequence
  B2M targeting sequence
accuucuaagcuuagcuggg

SEQ ID NO: 1108 - RNA, 20 nt, Artificial Sequence
  B2M targeting sequence
aagcuuagcuggggcugugu

SEQ ID NO: 1109 - RNA, 20 nt, Artificial Sequence
  B2M targeting sequence
uucuguaaaaaauggcaacg

SEQ ID NO: 1110 - RNA, 20 nt, Artificial Sequence
  B2M targeting sequence
guaaaaaauggcaacguuaa

SEQ ID NO: 1111 - RNA, 20 nt, Artificial Sequence
  B2M targeting sequence
aagguuacacuuguguuagc

SEQ ID NO: 1112 - RNA, 20 nt, Artificial Sequence
  B2M targeting sequence
cuuauaaucaggacagucuu

SEQ ID NO: 1113 - RNA, 20 nt, Artificial Sequence
  B2M targeting sequence
ggacagucuucucaugccug

SEQ ID NO: 1114 - RNA, 20 nt, Artificial Sequence
  B2M targeting sequence
ugauuauaagggacaaggcu

SEQ ID NO: 1115 - RNA, 20 nt, Artificial Sequence
  B2M targeting sequence
ucucaugccuguaaauccca

SEQ ID NO: 1116 - RNA, 20 nt, Artificial Sequence
  B2M targeting sequence
caugccuguaaaucccagca

SEQ ID NO: 1117 - RNA, 20 nt, Artificial Sequence
  B2M targeting sequence
ugccuguaaaucccagcacu

SEQ ID NO: 1118 - RNA, 20 nt, Artificial Sequence
  B2M targeting sequence
cagcacuuugggaggccaag

SEQ ID NO: 1119 - RNA, 20 nt, Artificial Sequence
  B2M targeting sequence
caaagugcugggauuuacag

SEQ ID NO: 1120 - RNA, 20 nt, Artificial Sequence
  B2M targeting sequence
caacuuggccucccaaagug

SEQ ID NO: 1121 - RNA, 20 nt, Artificial Sequence
  B2M targeting sequence
ucccaacuuggccucccaaa

SEQ ID NO: 1122 - RNA, 20 nt, Artificial Sequence
  B2M targeting sequence
cuggagcccacccuugccaa

SEQ ID NO: 1123 - RNA, 20 nt, Artificial Sequence
  B2M targeting sequence
agugauccucccaacuuggc

SEQ ID NO: 1124 - RNA, 20 nt, Artificial Sequence
  B2M targeting sequence
cuauguuggcaagggugggc

SEQ ID NO: 1125 - RNA, 20 nt, Artificial Sequence
  B2M targeting sequence
cccuauguuggcaagggugg

SEQ ID NO: 1126 - RNA, 20 nt, Artificial Sequence
  B2M targeting sequence
cuacaaaaaaaaucaaaaaa

SEQ ID NO: 1127 - RNA, 20 nt, Artificial Sequence
  B2M targeting sequence
acaaaaaaaaucaaaaaaaa

SEQ ID NO: 1128 - RNA, 20 nt, Artificial Sequence
  B2M targeting sequence
aaaaaaauuuuuuuugagag

SEQ ID NO: 1129 - RNA, 20 nt, Artificial Sequence
  B2M targeting sequence
aaaaaaauuuuuuuugauuu

SEQ ID NO: 1130 - RNA, 20 nt, Artificial Sequence
  B2M targeting sequence
caaaaaaaauuuuuuuugau

SEQ ID NO: 1131 - RNA, 20 nt, Artificial Sequence
  B2M targeting sequence
uguuguccaggcuggagugc

SEQ ID NO: 1132 - RNA, 20 nt, Artificial Sequence
  B2M targeting sequence
aggcuggagugcaauggcac

SEQ ID NO: 1133 - RNA, 20 nt, Artificial Sequence
  B2M targeting sequence
agccuggacaacaagagcaa

SEQ ID NO: 1134 - RNA, 20 nt, Artificial Sequence
  B2M targeting sequence
uggcucacugcaaccucuaa

SEQ ID NO: 1135 - RNA, 20 nt, Artificial Sequence
  B2M targeting sequence
cugcaaccucuaaccucugc

SEQ ID NO: 1136 - RNA, 20 nt, Artificial Sequence
  B2M targeting sequence
aaccucugccuccuggguuc

SEQ ID NO: 1137 - RNA, 20 nt, Artificial Sequence
  B2M targeting sequence
gccuccuggguucaagcgau

SEQ ID NO: 1138 - RNA, 20 nt, Artificial Sequence
  B2M targeting sequence
uggguucaagcgauuccccu

SEQ ID NO: 1139 - RNA, 20 nt, Artificial Sequence
  B2M targeting sequence
agcgauuccccugccucagc

SEQ ID NO: 1140 - RNA, 20 nt, Artificial Sequence
  B2M targeting sequence
cuugaacccaggaggcagag

SEQ ID NO: 1141 - RNA, 20 nt, Artificial Sequence
  B2M targeting sequence
ccugccucagccuccgagua

SEQ ID NO: 1142 - RNA, 20 nt, Artificial Sequence
  B2M targeting sequence
gccuccgaguagcugggauu

SEQ ID NO: 1143 - RNA, 20 nt, Artificial Sequence
  B2M targeting sequence
gaguagcugggauuacaggc

SEQ ID NO: 1144 - RNA, 20 nt, Artificial Sequence
  B2M targeting sequence
gaggcugaggcaggggaauc

SEQ ID NO: 1145 - RNA, 20 nt, Artificial Sequence
  B2M targeting sequence
cagcuacucggaggcugagg

SEQ ID NO: 1146 - RNA, 20 nt, Artificial Sequence
  B2M targeting sequence
gccaggcaugguggcacacg

SEQ ID NO: 1147 - RNA, 20 nt, Artificial Sequence
  B2M targeting sequence
acuaaaaauacaaaaucagc

SEQ ID NO: 1148 - RNA, 20 nt, Artificial Sequence
  B2M targeting sequence
cuacuaaaaauacaaaauca

SEQ ID NO: 1149 - RNA, 20 nt, Artificial Sequence
  B2M targeting sequence
ucacguuggucaggcuguuc

SEQ ID NO: 1150 - RNA, 20 nt, Artificial Sequence
  B2M targeting sequence
cguuggucaggcuguucuca

SEQ ID NO: 1151 - RNA, 20 nt, Artificial Sequence
  B2M targeting sequence
ggcuguucucaaacucccga

SEQ ID NO: 1152 - RNA, 20 nt, Artificial Sequence
  B2M targeting sequence
caaacucccgacccucaggu

SEQ ID NO: 1153 - RNA, 20 nt, Artificial Sequence
  B2M targeting sequence
aacucccgacccucagguga

SEQ ID NO: 1154 - RNA, 20 nt, Artificial Sequence
  B2M targeting sequence
cgacccucaggugaucugcc

SEQ ID NO: 1155 - RNA, 20 nt, Artificial Sequence
  B2M targeting sequence
ggaguuugagaacagccuga

SEQ ID NO: 1156 - RNA, 20 nt, Artificial Sequence
  B2M targeting sequence
ggugaucugcccaccucggc

SEQ ID NO: 1157 - RNA, 20 nt, Artificial Sequence
  B2M targeting sequence
ccugagggucgggaguuuga

SEQ ID NO: 1158 - RNA, 20 nt, Artificial Sequence
  B2M targeting sequence
gcccaccucggccucccaga

SEQ ID NO: 1159 - RNA, 20 nt, Artificial Sequence
  B2M targeting sequence
gccucccagagugcugggau

SEQ ID NO: 1160 - RNA, 20 nt, Artificial Sequence
  B2M targeting sequence
cagagugcugggauuacagg

SEQ ID NO: 1161 - RNA, 20 nt, Artificial Sequence
  B2M targeting sequence
gggaggccgaggugggcaga

SEQ ID NO: 1162 - RNA, 20 nt, Artificial Sequence
  B2M targeting sequence
cagcacucugggaggccgag

SEQ ID NO: 1163 - RNA, 20 nt, Artificial Sequence
  B2M targeting sequence
ugccuguaaucccagcacuc

SEQ ID NO: 1164 - RNA, 20 nt, Artificial Sequence
  B2M targeting sequence
caugccuauaauccaagcua

SEQ ID NO: 1165 - RNA, 20 nt, Artificial Sequence
  B2M targeting sequence
aagcuacucagaagacugag

SEQ ID NO: 1166 - RNA, 20 nt, Artificial Sequence
  B2M targeting sequence
gaagacugaggugggaggau

SEQ ID NO: 1167 - RNA, 20 nt, Artificial Sequence
  B2M targeting sequence
gaguagcuuggauuauaggc

SEQ ID NO: 1168 - RNA, 20 nt, Artificial Sequence
  B2M targeting sequence
ucugaguagcuuggauuaua

SEQ ID NO: 1169 - RNA, 20 nt, Artificial Sequence
  B2M targeting sequence
gucuucugaguagcuuggau

SEQ ID NO: 1170 - RNA, 20 nt, Artificial Sequence
  B2M targeting sequence
caccucagucuucugaguag

SEQ ID NO: 1171 - RNA, 20 nt, Artificial Sequence
  B2M targeting sequence
ucccaccucagucuucugag

SEQ ID NO: 1172 - RNA, 20 nt, Artificial Sequence
  B2M targeting sequence
cuugagccuggaggucaaug

SEQ ID NO: 1173 - RNA, 20 nt, Artificial Sequence
  B2M targeting sequence
agugauccucccaccucagu

SEQ ID NO: 1174 - RNA, 20 nt, Artificial Sequence
  B2M targeting sequence
aggcucaagugauccuccca

SEQ ID NO: 1175 - RNA, 20 nt, Artificial Sequence
  B2M targeting sequence
augcugcaguaagccaugau

SEQ ID NO: 1176 - RNA, 20 nt, Artificial Sequence
  B2M targeting sequence
uggcuuacugcagcauugac

SEQ ID NO: 1177 - RNA, 20 nt, Artificial Sequence
  B2M targeting sequence
cacaugggugacagaguaag

SEQ ID NO: 1178 - RNA, 20 nt, Artificial Sequence
  B2M targeting sequence
cccaugugggagugcagugc

SEQ ID NO: 1179 - RNA, 20 nt, Artificial Sequence
  B2M targeting sequence
gucacccaugugggagugca

SEQ ID NO: 1180 - RNA, 20 nt, Artificial Sequence
  B2M targeting sequence
uacucugucacccauguggg

SEQ ID NO: 1181 - RNA, 20 nt, Artificial Sequence
  B2M targeting sequence
caaaaaaaaaaaaaaaaaaa

SEQ ID NO: 1182 - RNA, 20 nt, Artificial Sequence
  B2M targeting sequence
aaaaaaaaaaaaaaaaaaaa

SEQ ID NO: 1183 - RNA, 20 nt, Artificial Sequence
  B2M targeting sequence
uuuuuuuuuuuuuuuuuuuu

SEQ ID NO: 1184 - RNA, 20 nt, Artificial Sequence
  B2M targeting sequence
uuuuucuuuuuuuuuuuuuu

SEQ ID NO: 1185 - RNA, 20 nt, Artificial Sequence
  B2M targeting sequence
uggagcacucacacauagga

SEQ ID NO: 1186 - RNA, 20 nt, Artificial Sequence
  B2M targeting sequence
aggaauguccuuuuucuuuu

SEQ ID NO: 1187 - RNA, 20 nt, Artificial Sequence
  B2M targeting sequence
cacauaggauagccuucauu

SEQ ID NO: 1188 - RNA, 20 nt, Artificial Sequence
  B2M targeting sequence
uaugugugagugcuccagga

SEQ ID NO: 1189 - RNA, 20 nt, Artificial Sequence
  B2M targeting sequence
uuacagguuuuaacuuacaa

SEQ ID NO: 1190 - RNA, 20 nt, Artificial Sequence
  B2M targeting sequence
aacacaucauucuauuaucu

SEQ ID NO: 1191 - RNA, 20 nt, Artificial Sequence
  B2M targeting sequence
uucuauuaucucuuuaauua

SEQ ID NO: 1192 - RNA, 20 nt, Artificial Sequence
  B2M targeting sequence
auuaucucuuuaauuauacc

SEQ ID NO: 1193 - RNA, 20 nt, Artificial Sequence
  B2M targeting sequence
cuuuaauuauaccuuauuau

SEQ ID NO: 1194 - RNA, 20 nt, Artificial Sequence
  B2M targeting sequence
uuaauuauaccuuauuaugc

SEQ ID NO: 1195 - RNA, 20 nt, Artificial Sequence
  B2M targeting sequence
uauuuuuaggcacaucauuu

SEQ ID NO: 1196 - RNA, 20 nt, Artificial Sequence
  B2M targeting sequence
uuuagauuuuugaagaaagg

SEQ ID NO: 1197 - RNA, 20 nt, Artificial Sequence
  B2M targeting sequence
aaaugaugugccuaaaaaua

SEQ ID NO: 1198 - RNA, 20 nt, Artificial Sequence
  B2M targeting sequence
aaaaucuaaaugaugugccu

SEQ ID NO: 1199 - RNA, 20 nt, Artificial Sequence
  B2M targeting sequence
ucaaaaaucuaaaugaugug

SEQ ID NO: 1200 - RNA, 20 nt, Artificial Sequence
  B2M targeting sequence
uuucuucaaaaaucuaaaug

SEQ ID NO: 1201 - RNA, 20 nt, Artificial Sequence
  B2M targeting sequence
uauccuuucuucaaaaaucu

SEQ ID NO: 1202 - RNA, 20 nt, Artificial Sequence
  B2M targeting sequence
ccauuuucauauccuuucuu

SEQ ID NO: 1203 - RNA, 20 nt, Artificial Sequence
  B2M targeting sequence
ccaauauauaaaggcauaag

SEQ ID NO: 1204 - RNA, 20 nt, Artificial Sequence
  B2M targeting sequence
aauauauaaaggcauaagaa

SEQ ID NO: 1205 - RNA, 20 nt, Artificial Sequence
  B2M targeting sequence
uaugccuuuauauauuggag

SEQ ID NO: 1206 - RNA, 20 nt, Artificial Sequence
  B2M targeting sequence
ucagacucucuggaucccug

SEQ ID NO: 1207 - RNA, 20 nt, Artificial Sequence
  B2M targeting sequence
gacucucuggaucccuguaa

SEQ ID NO: 1208 - RNA, 20 nt, Artificial Sequence
  B2M targeting sequence
gaagacauuucuuaugccuu

SEQ ID NO: 1209 - RNA, 20 nt, Artificial Sequence
  B2M targeting sequence
cuggaucccuguaaacauag

SEQ ID NO: 1210 - RNA, 20 nt, Artificial Sequence
  B2M targeting sequence
ggaucccuguaaacauaguc

SEQ ID NO: 1211 - RNA, 20 nt, Artificial Sequence
  B2M targeting sequence
agagagucugaagacauuuc

SEQ ID NO: 1212 - RNA, 20 nt, Artificial Sequence
  B2M targeting sequence
cuguaaacauagucuaugua

SEQ ID NO: 1213 - RNA, 20 nt, Artificial Sequence
  B2M targeting sequence
auguagcuagugucugauga

SEQ ID NO: 1214 - RNA, 20 nt, Artificial Sequence
  B2M targeting sequence
gaugauucaacuucccacau

SEQ ID NO: 1215 - RNA, 20 nt, Artificial Sequence
  B2M targeting sequence
gacacuagcuacauagacua

SEQ ID NO: 1216 - RNA, 20 nt, Artificial Sequence
  B2M targeting sequence
ucagacacuagcuacauaga

SEQ ID NO: 1217 - RNA, 20 nt, Artificial Sequence
  B2M targeting sequence
acuucccacauacacguauu

SEQ ID NO: 1218 - RNA, 20 nt, Artificial Sequence
  B2M targeting sequence
cacauacacguauuccagaa

SEQ ID NO: 1219 - RNA, 20 nt, Artificial Sequence
  B2M targeting sequence
agaacaaacagaucaguaaa

SEQ ID NO: 1220 - RNA, 20 nt, Artificial Sequence
  B2M targeting sequence
ggaauacguguaugugggaa

SEQ ID NO: 1221 - RNA, 20 nt, Artificial Sequence
  B2M targeting sequence
guuuguucuggaauacgugu

SEQ ID NO: 1222 - RNA, 20 nt, Artificial Sequence
  B2M targeting sequence
guaaauccaggcaaaccuau

SEQ ID NO: 1223 - RNA, 20 nt, Artificial Sequence
  B2M targeting sequence
aggcaaaccuauaaagagaa

SEQ ID NO: 1224 - RNA, 20 nt, Artificial Sequence
  B2M targeting sequence
uuauagguuugccuggauuu

SEQ ID NO: 1225 - RNA, 20 nt, Artificial Sequence
  B2M targeting sequence
cuuuauagguuugccuggau

SEQ ID NO: 1226 - RNA, 20 nt, Artificial Sequence
  B2M targeting sequence
guucucuuuauagguuugcc

SEQ ID NO: 1227 - RNA, 20 nt, Artificial Sequence
  B2M targeting sequence
acuuugcaaguauuuauaug

SEQ ID NO: 1228 - RNA, 20 nt, Artificial Sequence
  B2M targeting sequence
uauaaauacuugcaaaguag

SEQ ID NO: 1229 - RNA, 20 nt, Artificial Sequence
  B2M targeting sequence
gacucuuucuagcaguaauu

SEQ ID NO: 1230 - RNA, 20 nt, Artificial Sequence
  B2M targeting sequence
gauacuaauuaaaucauaua

SEQ ID NO: 1231 - RNA, 20 nt, Artificial Sequence
  B2M targeting sequence
uucuagcaguaauucugagg

SEQ ID NO: 1232 - RNA, 20 nt, Artificial Sequence
  B2M targeting sequence
agcaguaauucugaggacag

SEQ ID NO: 1233 - RNA, 20 nt, Artificial Sequence
  B2M targeting sequence
gaggacagagaugaccaugu

SEQ ID NO: 1234 - RNA, 20 nt, Artificial Sequence
  B2M targeting sequence
gaauuacugcuagaaagagu

SEQ ID NO: 1235 - RNA, 20 nt, Artificial Sequence
  B2M targeting sequence
ucagaauuacugcuagaaag

SEQ ID NO: 1236 - RNA, 20 nt, Artificial Sequence
  B2M targeting sequence
guccucagaauuacugcuag

SEQ ID NO: 1237 - RNA, 20 nt, Artificial Sequence
  B2M targeting sequence
cuguccucagaauuacugcu

SEQ ID NO: 1238 - RNA, 20 nt, Artificial Sequence
  B2M targeting sequence
ucucuguccucagaauuacu

SEQ ID NO: 1239 - RNA, 20 nt, Artificial Sequence
  B2M targeting sequence
ugcuuauauccuagaauagu

SEQ ID NO: 1240 - RNA, 20 nt, Artificial Sequence
  B2M targeting sequence
uagaauaguugucccucaag

SEQ ID NO: 1241 - RNA, 20 nt, Artificial Sequence
  B2M targeting sequence
aggauauaagcaugaauaac

SEQ ID NO: 1242 - RNA, 20 nt, Artificial Sequence
  B2M targeting sequence
cucaaguauuucuugaauga

SEQ ID NO: 1243 - RNA, 20 nt, Artificial Sequence
  B2M targeting sequence
aguauuucuugaaugaauaa

SEQ ID NO: 1244 - RNA, 20 nt, Artificial Sequence
  B2M targeting sequence
ugaaugaauaauucagguuc

SEQ ID NO: 1245 - RNA, 20 nt, Artificial Sequence
  B2M targeting sequence
agaaauacuugagggacaac

SEQ ID NO: 1246 - RNA, 20 nt, Artificial Sequence
  B2M targeting sequence
uucaagaaauacuugaggga

SEQ ID NO: 1247 - RNA, 20 nt, Artificial Sequence
  B2M targeting sequence
gguucuuaaauuaauucuug

SEQ ID NO: 1248 - RNA, 20 nt, Artificial Sequence
  B2M targeting sequence
uaaauuaauucuugcccuca

SEQ ID NO: 1249 - RNA, 20 nt, Artificial Sequence
  B2M targeting sequence
ugcccucaaauagguuagca

SEQ ID NO: 1250 - RNA, 20 nt, Artificial Sequence
  B2M targeting sequence
aauagguuagcacuauaaau

SEQ ID NO: 1251 - RNA, 20 nt, Artificial Sequence
  B2M targeting sequence
uuuauagugcuaaccuauuu

SEQ ID NO: 1252 - RNA, 20 nt, Artificial Sequence
  B2M targeting sequence
aggugcuuuggucauuuaua

SEQ ID NO: 1253 - RNA, 20 nt, Artificial Sequence
  B2M targeting sequence
gccaaccuuuuauuccaggu

SEQ ID NO: 1254 - RNA, 20 nt, Artificial Sequence
  B2M targeting sequence
ucagccaaccuuuuauucca

SEQ ID NO: 1255 - RNA, 20 nt, Artificial Sequence
  B2M targeting sequence
agaaugguuacucaguaaau

SEQ ID NO: 1256 - RNA, 20 nt, Artificial Sequence
  B2M targeting sequence
ugacuaagucuucagccaac

SEQ ID NO: 1257 - RNA, 20 nt, Artificial Sequence
  B2M targeting sequence
guaaaugucaguguguagaa

SEQ ID NO: 1258 - RNA, 20 nt, Artificial Sequence
  B2M targeting sequence
guguguagaaccacuucuaa

SEQ ID NO: 1259 - RNA, 20 nt, Artificial Sequence
  B2M targeting sequence
acacacugacauuuacugag

SEQ ID NO: 1260 - RNA, 20 nt, Artificial Sequence
  B2M targeting sequence
aaaaacacaugauccuucau

SEQ ID NO: 1261 - RNA, 20 nt, Artificial Sequence
  B2M targeting sequence
uguguuuuuagaagugguuc

SEQ ID NO: 1262 - RNA, 20 nt, Artificial Sequence
  B2M targeting sequence
uucaugcucauaauuuagaa

SEQ ID NO: 1263 - RNA, 20 nt, Artificial Sequence
  B2M targeting sequence
ugcucauaauuuagaagaag

SEQ ID NO: 1264 - RNA, 20 nt, Artificial Sequence
  B2M targeting sequence
uaauuuagaagaaggaagua

SEQ ID NO: 1265 - RNA, 20 nt, Artificial Sequence
  B2M targeting sequence
aaauuaugagcaugaaggau

SEQ ID NO: 1266 - RNA, 20 nt, Artificial Sequence
  B2M targeting sequence
ucuaaauuaugagcaugaag

SEQ ID NO: 1267 - RNA, 20 nt, Artificial Sequence
  B2M targeting sequence
uucuucuaaauuaugagcau

SEQ ID NO: 1268 - RNA, 20 nt, Artificial Sequence
  B2M targeting sequence
cuacuuccuucuucuaaauu

SEQ ID NO: 1269 - RNA, 20 nt, Artificial Sequence
  B2M targeting sequence
guuacuugcuucacuacuuc

SEQ ID NO: 1270 - RNA, 20 nt, Artificial Sequence
  B2M targeting sequence
auguucuguuacuugcuuca

SEQ ID NO: 1271 - RNA, 20 nt, Artificial Sequence
  B2M targeting sequence
agcccaaucuauguucuguu

SEQ ID NO: 1272 - RNA, 20 nt, Artificial Sequence
  B2M targeting sequence
aagccccuuguucaagccca

SEQ ID NO: 1273 - RNA, 20 nt, Artificial Sequence
  B2M targeting sequence
gccauuacuuacuccauccu

SEQ ID NO: 1274 - RNA, 20 nt, Artificial Sequence
  B2M targeting sequence
auccuggccuccagcugcug

SEQ ID NO: 1275 - RNA, 20 nt, Artificial Sequence
  B2M targeting sequence
uggccuccagcugcugaacc

SEQ ID NO: 1276 - RNA, 20 nt, Artificial Sequence
  B2M targeting sequence
agcugcugaaccaauuguuu

SEQ ID NO: 1277 - RNA, 20 nt, Artificial Sequence
  B2M targeting sequence
gcagcuggaggccaggaugg

SEQ ID NO: 1278 - RNA, 20 nt, Artificial Sequence
  B2M targeting sequence
acguggugacagaacagggg

SEQ ID NO: 1279 - RNA, 20 nt, Artificial Sequence
  B2M targeting sequence
ccacguggacaaacaauugg

SEQ ID NO: 1280 - RNA, 20 nt, Artificial Sequence
  B2M targeting sequence
gucaccacguggacaaacaa

SEQ ID NO: 1281 - RNA, 20 nt, Artificial Sequence
  B2M targeting sequence
ccuguucugucaccacgugg

SEQ ID NO: 1282 - RNA, 20 nt, Artificial Sequence
  B2M targeting sequence
ccagcaaccuacuuccccug

SEQ ID NO: 1283 - RNA, 20 nt, Artificial Sequence
  B2M targeting sequence
gccagagaggcuguaggcau

SEQ ID NO: 1284 - RNA, 20 nt, Artificial Sequence
  B2M targeting sequence
ggcagaaccccuagcuuucc

SEQ ID NO: 1285 - RNA, 20 nt, Artificial Sequence
  B2M targeting sequence
cuggcagaaccccuagcuuu

SEQ ID NO: 1286 - RNA, 20 nt, Artificial Sequence
  B2M targeting sequence
cccaggcaaucagaaccacc

SEQ ID NO: 1287 - RNA, 20 nt, Artificial Sequence
  B2M targeting sequence
caggcaaucagaaccaccau

SEQ ID NO: 1288 - RNA, 20 nt, Artificial Sequence
  B2M targeting sequence
gaaccaccaugucuguccua

SEQ ID NO: 1289 - RNA, 20 nt, Artificial Sequence
  B2M targeting sequence
gauugccugggagauagccc

SEQ ID NO: 1290 - RNA, 20 nt, Artificial Sequence
  B2M targeting sequence
guccuagagagcauaaauau

SEQ ID NO: 1291 - RNA, 20 nt, Artificial Sequence
  B2M targeting sequence
uagagagcauaaauauaaau

SEQ ID NO: 1292 - RNA, 20 nt, Artificial Sequence
  B2M targeting sequence
aggacagacauggugguucu

SEQ ID NO: 1293 - RNA, 20 nt, Artificial Sequence
  B2M targeting sequence
cuaggacagacauggugguu

SEQ ID NO: 1294 - RNA, 20 nt, Artificial Sequence
  B2M targeting sequence
auuugcuuauauuuauauuu

SEQ ID NO: 1295 - RNA, 20 nt, Artificial Sequence
  B2M targeting sequence
uaagcaaaucuauuugcuua

SEQ ID NO: 1296 - RNA, 20 nt, Artificial Sequence
  B2M targeting sequence
guuucuuaagcaaaucuauu

SEQ ID NO: 1297 - RNA, 20 nt, Artificial Sequence
  B2M targeting sequence
gggccaagguuucuuauuau

SEQ ID NO: 1298 - RNA, 20 nt, Artificial Sequence
  B2M targeting sequence
uauuaucuuuccguuacuac

SEQ ID NO: 1299 - RNA, 20 nt, Artificial Sequence
  B2M targeting sequence
uuccguuacuacuaccauug

SEQ ID NO: 1300 - RNA, 20 nt, Artificial Sequence
  B2M targeting sequence
guuacuacuaccauuguccc

SEQ ID NO: 1301 - RNA, 20 nt, Artificial Sequence
  B2M targeting sequence
cccacccccagguagcaauu

SEQ ID NO: 1302 - RNA, 20 nt, Artificial Sequence
  B2M targeting sequence
gagguaacauuugcauguuu

SEQ ID NO: 1303 - RNA, 20 nt, Artificial Sequence
  B2M targeting sequence
gaauugcuaccugggggugg

SEQ ID NO: 1304 - RNA, 20 nt, Artificial Sequence
  B2M targeting sequence
cuuccuauuuaaucuuaaga

SEQ ID NO: 1305 - RNA, 20 nt, Artificial Sequence
  B2M targeting sequence
uauuuaaucuuaagaacuau

SEQ ID NO: 1306 - RNA, 20 nt, Artificial Sequence
  B2M targeting sequence
uaagaacuaugagggguuaa

SEQ ID NO: 1307 - RNA, 20 nt, Artificial Sequence
  B2M targeting sequence
uaagauuaaauaggaaggga

SEQ ID NO: 1308 - RNA, 20 nt, Artificial Sequence
  B2M targeting sequence
uaguucuuaagauuaaauag

SEQ ID NO: 1309 - RNA, 20 nt, Artificial Sequence
  B2M targeting sequence
ucccuaguuuguagauaaag

SEQ ID NO: 1310 - RNA, 20 nt, Artificial Sequence
  B2M targeting sequence
cuaguuuguagauaaagaaa

SEQ ID NO: 1311 - RNA, 20 nt, Artificial Sequence
  B2M targeting sequence
acaaacuagggaugauggua

SEQ ID NO: 1312 - RNA, 20 nt, Artificial Sequence
  B2M targeting sequence
uuaucuacaaacuagggaug

SEQ ID NO: 1313 - RNA, 20 nt, Artificial Sequence
  B2M targeting sequence
uaguuuguuucuuuaucuac

SEQ ID NO: 1314 - RNA, 20 nt, Artificial Sequence
  B2M targeting sequence
cuuaguuuguuucuuuaucu

SEQ ID NO: 1315 - RNA, 20 nt, Artificial Sequence
  B2M targeting sequence
cuucucuuaguuuguuucuu

SEQ ID NO: 1316 - RNA, 20 nt, Artificial Sequence
  B2M targeting sequence
cacuucucuuaguuuguuuc

SEQ ID NO: 1317 - RNA, 20 nt, Artificial Sequence
  B2M targeting sequence
cuucucacuucucuuaguuu

SEQ ID NO: 1318 - RNA, 20 nt, Artificial Sequence
  B2M targeting sequence
uucacuucucacuucucuua

SEQ ID NO: 1319 - RNA, 20 nt, Artificial Sequence
  B2M targeting sequence
cuuacuagcaauauaacuuu

SEQ ID NO: 1320 - RNA, 20 nt, Artificial Sequence
  B2M targeting sequence
ggcuguaucacuuacuagca

SEQ ID NO: 1321 - RNA, 20 nt, Artificial Sequence
  B2M targeting sequence
aacguaggucuuuuuaaaau

SEQ ID NO: 1322 - RNA, 20 nt, Artificial Sequence
  B2M targeting sequence
uuuuaaaaucuaaagcuugu

SEQ ID NO: 1323 - RNA, 20 nt, Artificial Sequence
  B2M targeting sequence
aaagcuuguccccuuaggua

SEQ ID NO: 1324 - RNA, 20 nt, Artificial Sequence
  B2M targeting sequence
ccuuagguacuauguuauac

SEQ ID NO: 1325 - RNA, 20 nt, Artificial Sequence
  B2M targeting sequence
uagaagaaaccgaaacucua

SEQ ID NO: 1326 - RNA, 20 nt, Artificial Sequence
  B2M targeting sequence
aggaggcaguauaacauagu

SEQ ID NO: 1327 - RNA, 20 nt, Artificial Sequence
  B2M targeting sequence
ucuaggaggcaguauaacau

SEQ ID NO: 1328 - RNA, 20 nt, Artificial Sequence
  B2M targeting sequence
guuucuucuaggaggcagua

SEQ ID NO: 1329 - RNA, 20 nt, Artificial Sequence
  B2M targeting sequence
agggcacuauagaaaaaaag

SEQ ID NO: 1330 - RNA, 20 nt, Artificial Sequence
  B2M targeting sequence
auagugcccuagaguuucgg

SEQ ID NO: 1331 - RNA, 20 nt, Artificial Sequence
  B2M targeting sequence
gcuuuuuuucuauagugccc

SEQ ID NO: 1332 - RNA, 20 nt, Artificial Sequence
  B2M targeting sequence
cuauccaaccucuuccucag

SEQ ID NO: 1333 - RNA, 20 nt, Artificial Sequence
  B2M targeting sequence
auccaaccucuuccucagua

SEQ ID NO: 1334 - RNA, 20 nt, Artificial Sequence
  B2M targeting sequence
aaccucuuccucaguacuug

SEQ ID NO: 1335 - RNA, 20 nt, Artificial Sequence
  B2M targeting sequence
uccucaguacuugaaaaugc

SEQ ID NO: 1336 - RNA, 20 nt, Artificial Sequence
  B2M targeting sequence
ucaguacuugaaaaugccuc

SEQ ID NO: 1337 - RNA, 20 nt, Artificial Sequence
  B2M targeting sequence
guacuugaaaaugccucagg

SEQ ID NO: 1338 - RNA, 20 nt, Artificial Sequence
  B2M targeting sequence
aguacugaggaagagguugg

SEQ ID NO: 1339 - RNA, 20 nt, Artificial Sequence
  B2M targeting sequence
ggaaauacuucaccuggcuc

SEQ ID NO: 1340 - RNA, 20 nt, Artificial Sequence
  B2M targeting sequence
ugaggcauuuucaaguacug

SEQ ID NO: 1341 - RNA, 20 nt, Artificial Sequence
  B2M targeting sequence
ccuggcucagucugcacauc

SEQ ID NO: 1342 - RNA, 20 nt, Artificial Sequence
  B2M targeting sequence
gucugcacaucccgagggua

SEQ ID NO: 1343 - RNA, 20 nt, Artificial Sequence
  B2M targeting sequence
gcacaucccgaggguacuag

SEQ ID NO: 1344 - RNA, 20 nt, Artificial Sequence
  B2M targeting sequence
cgaggguacuagauaguauu

SEQ ID NO: 1345 - RNA, 20 nt, Artificial Sequence
  B2M targeting sequence
ggaugugcagacugagccag

SEQ ID NO: 1346 - RNA, 20 nt, Artificial Sequence
  B2M targeting sequence
aguacccucgggaugugcag

SEQ ID NO: 1347 - RNA, 20 nt, Artificial Sequence
  B2M targeting sequence
uaaaggccuuguaaauacua

SEQ ID NO: 1348 - RNA, 20 nt, Artificial Sequence
  B2M targeting sequence
uaccaagcuguauggucacu

SEQ ID NO: 1349 - RNA, 20 nt, Artificial Sequence
  B2M targeting sequence
cuguuggguuccucuaggga

SEQ ID NO: 1350 - RNA, 20 nt, Artificial Sequence
  B2M targeting sequence
ucuagggaagaaugcagcga

SEQ ID NO: 1351 - RNA, 20 nt, Artificial Sequence
  B2M targeting sequence
agggaagaaugcagcgauac

SEQ ID NO: 1352 - RNA, 20 nt, Artificial Sequence
  B2M targeting sequence
cuagaggaacccaacaguga

SEQ ID NO: 1353 - RNA, 20 nt, Artificial Sequence
  B2M targeting sequence
ucccuagaggaacccaacag

SEQ ID NO: 1354 - RNA, 20 nt, Artificial Sequence
  B2M targeting sequence
cugcauucuucccuagagga

SEQ ID NO: 1355 - RNA, 20 nt, Artificial Sequence
  B2M targeting sequence
ccauggcucagcagggcaua

SEQ ID NO: 1356 - RNA, 20 nt, Artificial Sequence
  B2M targeting sequence
gcagggcauagagcaaagau

SEQ ID NO: 1357 - RNA, 20 nt, Artificial Sequence
  B2M targeting sequence
augcccugcugagccauggg

SEQ ID NO: 1358 - RNA, 20 nt, Artificial Sequence
  B2M targeting sequence
uugcucuaugcccugcugag

SEQ ID NO: 1359 - RNA, 20 nt, Artificial Sequence
  B2M targeting sequence
aaacugcaagggacauauau

SEQ ID NO: 1360 - RNA, 20 nt, Artificial Sequence
  B2M targeting sequence
cuugcaguuuggaauaucuu

SEQ ID NO: 1361 - RNA, 20 nt, Artificial Sequence
  B2M targeting sequence
agagcaaaaugaguucacac

SEQ ID NO: 1362 - RNA, 20 nt, Artificial Sequence
  B2M targeting sequence
ggaauauauauaugucccuu

SEQ ID NO: 1363 - RNA, 20 nt, Artificial Sequence
  B2M targeting sequence
uuuugcucuggaauauauau

SEQ ID NO: 1364 - RNA, 20 nt, Artificial Sequence
  B2M targeting sequence
cacucggcauuuggugcuuu

SEQ ID NO: 1365 - RNA, 20 nt, Artificial Sequence
  B2M targeting sequence
gcauuuggugcuuuccugac

SEQ ID NO: 1366 - RNA, 20 nt, Artificial Sequence
  B2M targeting sequence
ugacucuuaucuucccaacu

SEQ ID NO: 1367 - RNA, 20 nt, Artificial Sequence
  B2M targeting sequence
ggaaagcaccaaaugccgag

SEQ ID NO: 1368 - RNA, 20 nt, Artificial Sequence
  B2M targeting sequence
uaucuucccaacuaaaggac

SEQ ID NO: 1369 - RNA, 20 nt, Artificial Sequence
  B2M targeting sequence
ucccaacuaaaggacagguu

SEQ ID NO: 1370 - RNA, 20 nt, Artificial Sequence
  B2M targeting sequence
caacuaaaggacagguucac

SEQ ID NO: 1371 - RNA, 20 nt, Artificial Sequence
  B2M targeting sequence
uuuaguugggaagauaagag

SEQ ID NO: 1372 - RNA, 20 nt, Artificial Sequence
  B2M targeting sequence
cauuuagagauagagcucaa

SEQ ID NO: 1373 - RNA, 20 nt, Artificial Sequence
  B2M targeting sequence
aaaugugaaccuguccuuua

SEQ ID NO: 1374 - RNA, 20 nt, Artificial Sequence
  B2M targeting sequence
cuaaaugugaaccuguccuu

SEQ ID NO: 1375 - RNA, 20 nt, Artificial Sequence
  B2M targeting sequence
aucucuaaaugugaaccugu

SEQ ID NO: 1376 - RNA, 20 nt, Artificial Sequence
  B2M targeting sequence
aaauauccacaagugcuguc

SEQ ID NO: 1377 - RNA, 20 nt, Artificial Sequence
  B2M targeting sequence
acaagugcugucagguuuua

SEQ ID NO: 1378 - RNA, 20 nt, Artificial Sequence
  B2M targeting sequence
gguuuuacacuggugagcca

SEQ ID NO: 1379 - RNA, 20 nt, Artificial Sequence
  B2M targeting sequence
ccaguguaaaaccugacagc

SEQ ID NO: 1380 - RNA, 20 nt, Artificial Sequence
  B2M targeting sequence
uuggcucaccaguguaaaac

SEQ ID NO: 1381 - RNA, 20 nt, Artificial Sequence
  B2M targeting sequence
cuaacccuuuccauaggaau

SEQ ID NO: 1382 - RNA, 20 nt, Artificial Sequence
  B2M targeting sequence
aacccuuuccauaggaauca

SEQ ID NO: 1383 - RNA, 20 nt, Artificial Sequence
  B2M targeting sequence
auaggaaucacugcucugaa

SEQ ID NO: 1384 - RNA, 20 nt, Artificial Sequence
  B2M targeting sequence
uauggaaaggguuagagagu

SEQ ID NO: 1385 - RNA, 20 nt, Artificial Sequence
  B2M targeting sequence
cugcucugaacuuuuccaaa

SEQ ID NO: 1386 - RNA, 20 nt, Artificial Sequence
  B2M targeting sequence
gaacuuuuccaaaagacacu

SEQ ID NO: 1387 - RNA, 20 nt, Artificial Sequence
  B2M targeting sequence
gagcagugauuccuauggaa

SEQ ID NO: 1388 - RNA, 20 nt, Artificial Sequence
  B2M targeting sequence
aaaagacacucuuggagagc

SEQ ID NO: 1389 - RNA, 20 nt, Artificial Sequence
  B2M targeting sequence
uuuggaaaaguucagagcag

SEQ ID NO: 1390 - RNA, 20 nt, Artificial Sequence
  B2M targeting sequence
uggagagcugauuaaaugca

SEQ ID NO: 1391 - RNA, 20 nt, Artificial Sequence
  B2M targeting sequence
aagagugucuuuuggaaaag

SEQ ID NO: 1392 - RNA, 20 nt, Artificial Sequence
  B2M targeting sequence
ccaagagugucuuuuggaaa

SEQ ID NO: 1393 - RNA, 20 nt, Artificial Sequence
  B2M targeting sequence
gcucuccaagagugucuuuu

SEQ ID NO: 1394 - RNA, 20 nt, Artificial Sequence
  B2M targeting sequence
aggcuuaacuccuaggagua

SEQ ID NO: 1395 - RNA, 20 nt, Artificial Sequence
  B2M targeting sequence
uaggaguaggagaucgggaa

SEQ ID NO: 1396 - RNA, 20 nt, Artificial Sequence
  B2M targeting sequence
uaggaguuaagccuagaagu

SEQ ID NO: 1397 - RNA, 20 nt, Artificial Sequence
  B2M targeting sequence
uacuccuaggaguuaagccu

SEQ ID NO: 1398 - RNA, 20 nt, Artificial Sequence
  B2M targeting sequence
ccuacuccuaggaguuaagc

SEQ ID NO: 1399 - RNA, 20 nt, Artificial Sequence
  B2M targeting sequence
ggaaugcauccaggaaucug

SEQ ID NO: 1400 - RNA, 20 nt, Artificial Sequence
  B2M targeting sequence
cgaucuccuacuccuaggag

SEQ ID NO: 1401 - RNA, 20 nt, Artificial Sequence
  B2M targeting sequence
aggaaucugaggcagguagu

SEQ ID NO: 1402 - RNA, 20 nt, Artificial Sequence
  B2M targeting sequence
uggaugcauucccgaucucc

SEQ ID NO: 1403 - RNA, 20 nt, Artificial Sequence
  B2M targeting sequence
gaggcagguagucuguggac

SEQ ID NO: 1404 - RNA, 20 nt, Artificial Sequence
  B2M targeting sequence
gauuccuggaugcauucccg

SEQ ID NO: 1405 - RNA, 20 nt, Artificial Sequence
  B2M targeting sequence
guggaccccacuuuaagagg

SEQ ID NO: 1406 - RNA, 20 nt, Artificial Sequence
  B2M targeting sequence
acagacuaccugccucagau

SEQ ID NO: 1407 - RNA, 20 nt, Artificial Sequence
  B2M targeting sequence
uaaagugggguccacagacu

SEQ ID NO: 1408 - RNA, 20 nt, Artificial Sequence
  B2M targeting sequence
uuaagcaaagaccuucagua

SEQ ID NO: 1409 - RNA, 20 nt, Artificial Sequence
  B2M targeting sequence
uugcuuaaagaagugccucu

SEQ ID NO: 1410 - RNA, 20 nt, Artificial Sequence
  B2M targeting sequence
guauggcauacaugagauaa

SEQ ID NO: 1411 - RNA, 20 nt, Artificial Sequence
  B2M targeting sequence
uguaugccauacugaagguc

SEQ ID NO: 1412 - RNA, 20 nt, Artificial Sequence
  B2M targeting sequence
cauguaugccauacugaagg

SEQ ID NO: 1413 - RNA, 20 nt, Artificial Sequence
  B2M targeting sequence
caguggguuaucucauguau

SEQ ID NO: 1414 - RNA, 20 nt, Artificial Sequence
  B2M targeting sequence
aauaucccaguggguuaucu

SEQ ID NO: 1415 - RNA, 20 nt, Artificial Sequence
  B2M targeting sequence
ucuaauaucccaguggguua

SEQ ID NO: 1416 - RNA, 20 nt, Artificial Sequence
  B2M targeting sequence
cuucuaauaucccagugggu

SEQ ID NO: 1417 - RNA, 20 nt, Artificial Sequence
  B2M targeting sequence
aaauuuucacaucuagaguc

SEQ ID NO: 1418 - RNA, 20 nt, Artificial Sequence
  B2M targeting sequence
caucuagagucucauucuuu

SEQ ID NO: 1419 - RNA, 20 nt, Artificial Sequence
  B2M targeting sequence
agagucucauucuuuaaaau

SEQ ID NO: 1420 - RNA, 20 nt, Artificial Sequence
  B2M targeting sequence
agaugugaaaauuuugaugc

SEQ ID NO: 1421 - RNA, 20 nt, Artificial Sequence
  B2M targeting sequence
cauucuuuaaaauuuucugu

SEQ ID NO: 1422 - RNA, 20 nt, Artificial Sequence
  B2M targeting sequence
uucuuuaaaauuuucugucu

SEQ ID NO: 1423 - RNA, 20 nt, Artificial Sequence
  B2M targeting sequence
uuaaaauuuucugucuuuua

SEQ ID NO: 1424 - RNA, 20 nt, Artificial Sequence
  B2M targeting sequence
gucuuuuauuauauaccuau

SEQ ID NO: 1425 - RNA, 20 nt, Artificial Sequence
  B2M targeting sequence
uuuauuauauaccuauuggc

SEQ ID NO: 1426 - RNA, 20 nt, Artificial Sequence
  B2M targeting sequence
guggcaggugagucugcugc

SEQ ID NO: 1427 - RNA, 20 nt, Artificial Sequence
  B2M targeting sequence
uugcauuuucuguggcaggu

SEQ ID NO: 1428 - RNA, 20 nt, Artificial Sequence
  B2M targeting sequence
cuugccuccuugcauuuucu

SEQ ID NO: 1429 - RNA, 20 nt, Artificial Sequence
  B2M targeting sequence
cagcauaccaggggccuuga

SEQ ID NO: 1430 - RNA, 20 nt, Artificial Sequence
  B2M targeting sequence
aggccccugguaugcuggga

SEQ ID NO: 1431 - RNA, 20 nt, Artificial Sequence
  B2M targeting sequence
aggggagcuaagcagagcuc

SEQ ID NO: 1432 - RNA, 20 nt, Artificial Sequence
  B2M targeting sequence
ccuggagucaaggccccugg

SEQ ID NO: 1433 - RNA, 20 nt, Artificial Sequence
  B2M targeting sequence
gcuuagcuccccuggaguca

SEQ ID NO: 1434 - RNA, 20 nt, Artificial Sequence
  B2M targeting sequence
cuggaacaggagggaggaaa

SEQ ID NO: 1435 - RNA, 20 nt, Artificial Sequence
  B2M targeting sequence
ggaacaggagggaggaaaaa

SEQ ID NO: 1436 - RNA, 20 nt, Artificial Sequence
  B2M targeting sequence
agagagcucugcuuagcucc

SEQ ID NO: 1437 - RNA, 20 nt, Artificial Sequence
  B2M targeting sequence
uguuccagagagcucugcuu

SEQ ID NO: 1438 - RNA, 20 nt, Artificial Sequence
  B2M targeting sequence
cuccuguuccagagagcucu

SEQ ID NO: 1439 - RNA, 20 nt, Artificial Sequence
  B2M targeting sequence
ucccuccuguuccagagagc

SEQ ID NO: 1440 - RNA, 20 nt, Artificial Sequence
  B2M targeting sequence
aaugggccccuguagugucu

SEQ ID NO: 1441 - RNA, 20 nt, Artificial Sequence
  B2M targeting sequence
ucugcauucaccuguguuuu

SEQ ID NO: 1442 - RNA, 20 nt, Artificial Sequence
  B2M targeting sequence
gcauucaccuguguuuuuga

SEQ ID NO: 1443 - RNA, 20 nt, Artificial Sequence
  B2M targeting sequence
ccuguguuuuugagguggug

SEQ ID NO: 1444 - RNA, 20 nt, Artificial Sequence
  B2M targeting sequence
aaaacacaggugaaugcaga

SEQ ID NO: 1445 - RNA, 20 nt, Artificial Sequence
  B2M targeting sequence
caccaccucaaaaacacagg

SEQ ID NO: 1446 - RNA, 20 nt, Artificial Sequence
  B2M targeting sequence
ucccaccaccucaaaaacac

SEQ ID NO: 1447 - RNA, 20 nt, Artificial Sequence
  B2M targeting sequence
ugcugcuuccucccaccacc

SEQ ID NO: 1448 - RNA, 20 nt, Artificial Sequence
  B2M targeting sequence
aacauccagggcaguggcag

SEQ ID NO: 1449 - RNA, 20 nt, Artificial Sequence
  B2M targeting sequence
agggcaguggcagcuuggcc

SEQ ID NO: 1450 - RNA, 20 nt, Artificial Sequence
  B2M targeting sequence
cucagauucaaagucagcug

SEQ ID NO: 1451 - RNA, 20 nt, Artificial Sequence
  B2M targeting sequence
gauucaaagucagcugggcc

SEQ ID NO: 1452 - RNA, 20 nt, Artificial Sequence
  B2M targeting sequence
gagggagggccaagcugcca

SEQ ID NO: 1453 - RNA, 20 nt, Artificial Sequence
  B2M targeting sequence
aagucagcugggccaggauc

SEQ ID NO: 1454 - RNA, 20 nt, Artificial Sequence
  B2M targeting sequence
gcugggccaggaucccucuc

SEQ ID NO: 1455 - RNA, 20 nt, Artificial Sequence
  B2M targeting sequence
uggcccagcugacuuugaau

SEQ ID NO: 1456 - RNA, 20 nt, Artificial Sequence
  B2M targeting sequence
cucucccucuccugggagga

SEQ ID NO: 1457 - RNA, 20 nt, Artificial Sequence
  B2M targeting sequence
cccucuccugggaggaauaa

SEQ ID NO: 1458 - RNA, 20 nt, Artificial Sequence
  B2M targeting sequence
cucuccugggaggaauaaga

SEQ ID NO: 1459 - RNA, 20 nt, Artificial Sequence
  B2M targeting sequence
ccugggaggaauaagacuag

SEQ ID NO: 1460 - RNA, 20 nt, Artificial Sequence
  B2M targeting sequence
ugggaggaauaagacuagug

SEQ ID NO: 1461 - RNA, 20 nt, Artificial Sequence
  B2M targeting sequence
caggagagggagagggaucc

SEQ ID NO: 1462 - RNA, 20 nt, Artificial Sequence
  B2M targeting sequence
ucccaggagagggagaggga

SEQ ID NO: 1463 - RNA, 20 nt, Artificial Sequence
  B2M targeting sequence
uauuccucccaggagaggga

SEQ ID NO: 1464 - RNA, 20 nt, Artificial Sequence
  B2M targeting sequence
ucccuuauucaugagacaua

SEQ ID NO: 1465 - RNA, 20 nt, Artificial Sequence
  B2M targeting sequence
cuuauucaugagacauauau

SEQ ID NO: 1466 - RNA, 20 nt, Artificial Sequence
  B2M targeting sequence
ugagacauauauguuccgag

SEQ ID NO: 1467 - RNA, 20 nt, Artificial Sequence
  B2M targeting sequence
ugaauaagggaggaccacug

SEQ ID NO: 1468 - RNA, 20 nt, Artificial Sequence
  B2M targeting sequence
caugaauaagggaggaccac

SEQ ID NO: 1469 - RNA, 20 nt, Artificial Sequence
  B2M targeting sequence
gagacccccaagggaugccu

SEQ ID NO: 1470 - RNA, 20 nt, Artificial Sequence
  B2M targeting sequence
gaacauauaugucucaugaa

SEQ ID NO: 1471 - RNA, 20 nt, Artificial Sequence
  B2M targeting sequence
cggaacauauaugucucaug

SEQ ID NO: 1472 - RNA, 20 nt, Artificial Sequence
  B2M targeting sequence
cuugggggucucggaacaua

SEQ ID NO: 1473 - RNA, 20 nt, Artificial Sequence
  B2M targeting sequence
aggcaucccuugggggucuc

SEQ ID NO: 1474 - RNA, 20 nt, Artificial Sequence
  B2M targeting sequence
aguucuaggcaucccuuggg

SEQ ID NO: 1475 - RNA, 20 nt, Artificial Sequence
  B2M targeting sequence
uauauauacaugccuaugau

SEQ ID NO: 1476 - RNA, 20 nt, Artificial Sequence
  B2M targeting sequence
uaggcauguauauauaagaa

SEQ ID NO: 1477 - RNA, 20 nt, Artificial Sequence
  B2M targeting sequence
aaaaaaaauuuuuuuuaaau

SEQ ID NO: 1478 - RNA, 20 nt, Artificial Sequence
  B2M targeting sequence
gggucuugcucugucaccca

SEQ ID NO: 1479 - RNA, 20 nt, Artificial Sequence
  B2M targeting sequence
ugcucugucacccaggcugg

SEQ ID NO: 1480 - RNA, 20 nt, Artificial Sequence
  B2M targeting sequence
gucacccaggcuggagugca

SEQ ID NO: 1481 - RNA, 20 nt, Artificial Sequence
  B2M targeting sequence
cccaggcuggagugcagugg

SEQ ID NO: 1482 - RNA, 20 nt, Artificial Sequence
  B2M targeting sequence
agccugggugacagagcaag

SEQ ID NO: 1483 - RNA, 20 nt, Artificial Sequence
  B2M targeting sequence
uagcucacugcaggcucaaa

SEQ ID NO: 1484 - RNA, 20 nt, Artificial Sequence
  B2M targeting sequence
cugcaggcucaaacuccuga

SEQ ID NO: 1485 - RNA, 20 nt, Artificial Sequence
  B2M targeting sequence
aacuccugagcucaagccau

SEQ ID NO: 1486 - RNA, 20 nt, Artificial Sequence
  B2M targeting sequence
ugagcucaagccauccuccu

SEQ ID NO: 1487 - RNA, 20 nt, Artificial Sequence
  B2M targeting sequence
ggaguuugagccugcaguga

SEQ ID NO: 1488 - RNA, 20 nt, Artificial Sequence
  B2M targeting sequence
agccauccuccugccucaga

SEQ ID NO: 1489 - RNA, 20 nt, Artificial Sequence
  B2M targeting sequence
uccugccucagacuucuaag

SEQ ID NO: 1490 - RNA, 20 nt, Artificial Sequence
  B2M targeting sequence
ugccucagacuucuaaguag

SEQ ID NO: 1491 - RNA, 20 nt, Artificial Sequence
  B2M targeting sequence
gacuucuaaguagcugagac

SEQ ID NO: 1492 - RNA, 20 nt, Artificial Sequence
  B2M targeting sequence
gaggcaggaggauggcuuga

SEQ ID NO: 1493 - RNA, 20 nt, Artificial Sequence
  B2M targeting sequence
aaguagcugagacuacaggc

SEQ ID NO: 1494 - RNA, 20 nt, Artificial Sequence
  B2M targeting sequence
gcuacuuagaagucugaggc

SEQ ID NO: 1495 - RNA, 20 nt, Artificial Sequence
  B2M targeting sequence
cagcuacuuagaagucugag

SEQ ID NO: 1496 - RNA, 20 nt, Artificial Sequence
  B2M targeting sequence
ggcuaauuuuugaaaauuuu

SEQ ID NO: 1497 - RNA, 20 nt, Artificial Sequence
  B2M targeting sequence
aaaauuagccagauauggua

SEQ ID NO: 1498 - RNA, 20 nt, Artificial Sequence
  B2M targeting sequence
uuuuuuuuguagcgacaggg

SEQ ID NO: 1499 - RNA, 20 nt, Artificial Sequence
  B2M targeting sequence
cuacaaaaaaaaagaaaaaa

SEQ ID NO: 1500 - RNA, 20 nt, Artificial Sequence
  B2M targeting sequence
ugcuuuguugcccaggcugg

SEQ ID NO: 1501 - RNA, 20 nt, Artificial Sequence
  B2M targeting sequence
acaccagccugggcaacaaa

SEQ ID NO: 1502 - RNA, 20 nt, Artificial Sequence
  B2M targeting sequence
uggccucuagcaacccuccc

SEQ ID NO: 1503 - RNA, 20 nt, Artificial Sequence
  B2M targeting sequence
agcaacccucccaaagugcu

SEQ ID NO: 1504 - RNA, 20 nt, Artificial Sequence
  B2M targeting sequence
caaagugcugggauuacaga

SEQ ID NO: 1505 - RNA, 20 nt, Artificial Sequence
  B2M targeting sequence
cagcacuuugggaggguugc

SEQ ID NO: 1506 - RNA, 20 nt, Artificial Sequence
  B2M targeting sequence
guaaucccagcacuuuggga

SEQ ID NO: 1507 - RNA, 20 nt, Artificial Sequence
  B2M targeting sequence
uaaauuaaacuggccagggg

SEQ ID NO: 1508 - RNA, 20 nt, Artificial Sequence
  B2M targeting sequence
aauucuuaaauuaaacuggc

SEQ ID NO: 1509 - RNA, 20 nt, Artificial Sequence
  B2M targeting sequence
uauugugucuaauucuuaaa

SEQ ID NO: 1510 - RNA, 20 nt, Artificial Sequence
  B2M targeting sequence
uuucuuauugugucuaauuc

SEQ ID NO: 1511 - RNA, 20 nt, Artificial Sequence
  B2M targeting sequence
auuuuuauuguucauuucuu

SEQ ID NO: 1512 - RNA, 20 nt, Artificial Sequence
  B2M targeting sequence
cauaacuuuuauuacaguau

SEQ ID NO: 1513 - RNA, 20 nt, Artificial Sequence
  B2M targeting sequence
cucuuaaaauaccuuauugu

SEQ ID NO: 1514 - RNA, 20 nt, Artificial Sequence
  B2M targeting sequence
cuuaaaauaccuuauuguac

SEQ ID NO: 1515 - RNA, 20 nt, Artificial Sequence
  B2M targeting sequence
uaaaauaccuuauuguacua

SEQ ID NO: 1516 - RNA, 20 nt, Artificial Sequence
  B2M targeting sequence
gacuauaguugaccaagggu

SEQ ID NO: 1517 - RNA, 20 nt, Artificial Sequence
  B2M targeting sequence
gaaaauaggcaaguauagua

SEQ ID NO: 1518 - RNA, 20 nt, Artificial Sequence
  B2M targeting sequence
acuauagucugaaaauaggc

SEQ ID NO: 1519 - RNA, 20 nt, Artificial Sequence
  B2M targeting sequence
guuacccuuggucaacuaua

SEQ ID NO: 1520 - RNA, 20 nt, Artificial Sequence
  B2M targeting sequence
gccauuucaguuacccuugg

SEQ ID NO: 1521 - RNA, 20 nt, Artificial Sequence
  B2M targeting sequence
cuuucugccauuucaguuac

SEQ ID NO: 1522 - RNA, 20 nt, Artificial Sequence
  B2M targeting sequence
augguuucacuuucugccau

SEQ ID NO: 1523 - RNA, 20 nt, Artificial Sequence
  B2M targeting sequence
accuacuacuaagguacagu

SEQ ID NO: 1524 - RNA, 20 nt, Artificial Sequence
  B2M targeting sequence
uucaaccuacuacuaaggua

SEQ ID NO: 1525 - RNA, 20 nt, Artificial Sequence
  B2M targeting sequence
gaaaucaccucauaucuaca

SEQ ID NO: 1526 - RNA, 20 nt, Artificial Sequence
  B2M targeting sequence
gaacuuccuucaaccuacua

SEQ ID NO: 1527 - RNA, 20 nt, Artificial Sequence
  B2M targeting sequence
ccucauaucuacauaggagu

SEQ ID NO: 1528 - RNA, 20 nt, Artificial Sequence
  B2M targeting sequence
uaucuacauaggaguccuug

SEQ ID NO: 1529 - RNA, 20 nt, Artificial Sequence
  B2M targeting sequence
acauaggaguccuuguccuu

SEQ ID NO: 1530 - RNA, 20 nt, Artificial Sequence
  B2M targeting sequence
uauguagauaugaggugauu

SEQ ID NO: 1531 - RNA, 20 nt, Artificial Sequence
  B2M targeting sequence
uuguccuucuccacuaguua

SEQ ID NO: 1532 - RNA, 20 nt, Artificial Sequence
  B2M targeting sequence
uucuccacuaguuaugggau

SEQ ID NO: 1533 - RNA, 20 nt, Artificial Sequence
  B2M targeting sequence
ccacuaguuaugggauccag

SEQ ID NO: 1534 - RNA, 20 nt, Artificial Sequence
  B2M targeting sequence
acuaguuaugggauccaggg

SEQ ID NO: 1535 - RNA, 20 nt, Artificial Sequence
  B2M targeting sequence
cauaacuaguggagaaggac

SEQ ID NO: 1536 - RNA, 20 nt, Artificial Sequence
  B2M targeting sequence
aggggaauaaauaccaggaa

SEQ ID NO: 1537 - RNA, 20 nt, Artificial Sequence
  B2M targeting sequence
ccuggaucccauaacuagug

SEQ ID NO: 1538 - RNA, 20 nt, Artificial Sequence
  B2M targeting sequence
ugguauuuauuccccuggau

SEQ ID NO: 1539 - RNA, 20 nt, Artificial Sequence
  B2M targeting sequence
auuccugguauuuauucccc

SEQ ID NO: 1540 - RNA, 20 nt, Artificial Sequence
  B2M targeting sequence
guaguccauuccugguauuu

SEQ ID NO: 1541 - RNA, 20 nt, Artificial Sequence
  B2M targeting sequence
caguaguccauuccugguau

SEQ ID NO: 1542 - RNA, 20 nt, Artificial Sequence
  B2M targeting sequence
gucucaguaguccauuccug

SEQ ID NO: 1543 - RNA, 20 nt, Artificial Sequence
  B2M targeting sequence
ugggccccucugucucagua

SEQ ID NO: 1544 - RNA, 20 nt, Artificial Sequence
  B2M targeting sequence
ggcaaacgugacucaccuuu

SEQ ID NO: 1545 - RNA, 20 nt, Artificial Sequence
  B2M targeting sequence
cguuugccugauccugggcc

SEQ ID NO: 1546 - RNA, 20 nt, Artificial Sequence
  B2M targeting sequence
ccuuuaacgcuaguagcagg

SEQ ID NO: 1547 - RNA, 20 nt, Artificial Sequence
  B2M targeting sequence
cccacaggcgguggcccugc

SEQ ID NO: 1548 - RNA, 20 nt, Artificial Sequence
  B2M targeting sequence
gcuaggaccugguuuuaagg

SEQ ID NO: 1549 - RNA, 20 nt, Artificial Sequence
  B2M targeting sequence
uagcagagcugugcaucgcc

SEQ ID NO: 1550 - RNA, 20 nt, Artificial Sequence
  B2M targeting sequence
ccuuaaaaccagguccuagc

SEQ ID NO: 1551 - RNA, 20 nt, Artificial Sequence
  B2M targeting sequence
cgccuuaaaaccagguccua

SEQ ID NO: 1552 - RNA, 20 nt, Artificial Sequence
  B2M targeting sequence
gaaaugaagugggagacagg

SEQ ID NO: 1553 - RNA, 20 nt, Artificial Sequence
  B2M targeting sequence
gaugcuguucucgccuuaaa

SEQ ID NO: 1554 - RNA, 20 nt, Artificial Sequence
  B2M targeting sequence
uuucugaugcuguucucgcc

SEQ ID NO: 1555 - RNA, 20 nt, Artificial Sequence
  B2M targeting sequence
cacuucauuucugaugcugu

SEQ ID NO: 1556 - RNA, 20 nt, Artificial Sequence
  B2M targeting sequence
cccacuucauuucugaugcu

SEQ ID NO: 1557 - RNA, 20 nt, Artificial Sequence
  B2M targeting sequence
ugucucccacuucauuucug

SEQ ID NO: 1558 - RNA, 20 nt, Artificial Sequence
  B2M targeting sequence
ccugucucccacuucauuuc

SEQ ID NO: 1559 - RNA, 20 nt, Artificial Sequence
  B2M targeting sequence
uucuccugucucccacuuca

SEQ ID NO: 1560 - RNA, 20 nt, Artificial Sequence
  B2M targeting sequence
cucuuucuccugucucccac

SEQ ID NO: 1561 - RNA, 20 nt, Artificial Sequence
  B2M targeting sequence
uucccucuuucuccugucuc

SEQ ID NO: 1562 - RNA, 20 nt, Artificial Sequence
  B2M targeting sequence
ccuucccucuuucuccuguc

SEQ ID NO: 1563 - RNA, 20 nt, Artificial Sequence
  B2M targeting sequence
cuccuucccucuuucuccug

SEQ ID NO: 1564 - RNA, 20 nt, Artificial Sequence
  B2M targeting sequence
cuaacucaaguucaaggcuu

SEQ ID NO: 1565 - RNA, 20 nt, Artificial Sequence
  B2M targeting sequence
aguucaaggcuuaaaaagaa

SEQ ID NO: 1566 - RNA, 20 nt, Artificial Sequence
  B2M targeting sequence
aggcuuaaaaagaaaguguu

SEQ ID NO: 1567 - RNA, 20 nt, Artificial Sequence
  B2M targeting sequence
uuuuaagccuugaacuugag

SEQ ID NO: 1568 - RNA, 20 nt, Artificial Sequence
  B2M targeting sequence
agaacuugucuuagaaaagg

SEQ ID NO: 1569 - RNA, 20 nt, Artificial Sequence
  B2M targeting sequence
ggauuaacacuuucuuuuua

SEQ ID NO: 1570 - RNA, 20 nt, Artificial Sequence
  B2M targeting sequence
uagaaaaggguagaaaagag

SEQ ID NO: 1571 - RNA, 20 nt, Artificial Sequence
  B2M targeting sequence
aagacaaguucuggauuaac

SEQ ID NO: 1572 - RNA, 20 nt, Artificial Sequence
  B2M targeting sequence
acccuuuucuaagacaaguu

SEQ ID NO: 1573 - RNA, 20 nt, Artificial Sequence
  B2M targeting sequence
uuucuacccuuuucuaagac

SEQ ID NO: 1574 - RNA, 20 nt, Artificial Sequence
  B2M targeting sequence
cuuuucuacccuuuucuaag

SEQ ID NO: 1575 - RNA, 20 nt, Artificial Sequence
  B2M targeting sequence
ucucuuuucuacccuuuucu

SEQ ID NO: 1576 - RNA, 20 nt, Artificial Sequence
  B2M targeting sequence
ucuucucuuuucuacccuuu

SEQ ID NO: 1577 - RNA, 20 nt, Artificial Sequence
  B2M targeting sequence
cuaaacauuccucuucucuu

SEQ ID NO: 1578 - RNA, 20 nt, Artificial Sequence
  B2M targeting sequence
caggcugucacuaaacauuc

SEQ ID NO: 1579 - RNA, 20 nt, Artificial Sequence
  B2M targeting sequence
guggcucacaggcugucacu

SEQ ID NO: 1580 - RNA, 20 nt, Artificial Sequence
  B2M targeting sequence
ggacaacccucucccauucc

SEQ ID NO: 1581 - RNA, 20 nt, Artificial Sequence
  B2M targeting sequence
ugaacugucuguggcucaca

SEQ ID NO: 1582 - RNA, 20 nt, Artificial Sequence
  B2M targeting sequence
cccauucccuucugccaugg

SEQ ID NO: 1583 - RNA, 20 nt, Artificial Sequence
  B2M targeting sequence
cauucccuucugccauggua

SEQ ID NO: 1584 - RNA, 20 nt, Artificial Sequence
  B2M targeting sequence
cuucugccaugguaccuggg

SEQ ID NO: 1585 - RNA, 20 nt, Artificial Sequence
  B2M targeting sequence
gccaugguaccuggguguug

SEQ ID NO: 1586 - RNA, 20 nt, Artificial Sequence
  B2M targeting sequence
acaacacccagguaccaugg

SEQ ID NO: 1587 - RNA, 20 nt, Artificial Sequence
  B2M targeting sequence
agcuguacuuggugcugucc

SEQ ID NO: 1588 - RNA, 20 nt, Artificial Sequence
  B2M targeting sequence
ccaagaucauucucuuccuc

SEQ ID NO: 1589 - RNA, 20 nt, Artificial Sequence
  B2M targeting sequence
uggggauccagcuguacuug

SEQ ID NO: 1590 - RNA, 20 nt, Artificial Sequence
  B2M targeting sequence
uucucuuccuccucuagguc

SEQ ID NO: 1591 - RNA, 20 nt, Artificial Sequence
  B2M targeting sequence
cuuccuccucuaggucuggg

SEQ ID NO: 1592 - RNA, 20 nt, Artificial Sequence
  B2M targeting sequence
uccuccucuaggucuggguc

SEQ ID NO: 1593 - RNA, 20 nt, Artificial Sequence
  B2M targeting sequence
uccucuaggucuggguccag

SEQ ID NO: 1594 - RNA, 20 nt, Artificial Sequence
  B2M targeting sequence
ucuaggucuggguccagauc

SEQ ID NO: 1595 - RNA, 20 nt, Artificial Sequence
  B2M targeting sequence
aggucuggguccagaucugg

SEQ ID NO: 1596 - RNA, 20 nt, Artificial Sequence
  B2M targeting sequence
ggguccagaucuggguccag

SEQ ID NO: 1597 - RNA, 20 nt, Artificial Sequence
  B2M targeting sequence
agaucuggguccagauccuc

SEQ ID NO: 1598 - RNA, 20 nt, Artificial Sequence
  B2M targeting sequence
ggacccagaccuagaggagg

SEQ ID NO: 1599 - RNA, 20 nt, Artificial Sequence
  B2M targeting sequence
ggguccagauccuccucguc

SEQ ID NO: 1600 - RNA, 20 nt, Artificial Sequence
  B2M targeting sequence
agauccuccucguccuccuc

SEQ ID NO: 1601 - RNA, 20 nt, Artificial Sequence
  B2M targeting sequence
ggacccagaucuggacccag

SEQ ID NO: 1602 - RNA, 20 nt, Artificial Sequence
  B2M targeting sequence
uccucguccuccuccucuuc

SEQ ID NO: 1603 - RNA, 20 nt, Artificial Sequence
  B2M targeting sequence
ucguccuccuccucuuccuc

SEQ ID NO: 1604 - RNA, 20 nt, Artificial Sequence
  B2M targeting sequence
uccuccuccucuuccuccuc

SEQ ID NO: 1605 - RNA, 20 nt, Artificial Sequence
  B2M targeting sequence
uccuccucuuccuccuccuc

SEQ ID NO: 1606 - RNA, 20 nt, Artificial Sequence
  B2M targeting sequence
uccucuuccuccuccucccc

SEQ ID NO: 1607 - RNA, 20 nt, Artificial Sequence
  B2M targeting sequence
ucuuccuccuccuccccuuc

SEQ ID NO: 1608 - RNA, 20 nt, Artificial Sequence
  B2M targeting sequence
uccuccuccuccccuucauu

SEQ ID NO: 1609 - RNA, 20 nt, Artificial Sequence
  B2M targeting sequence
uccuccuccccuucauucuc

SEQ ID NO: 1610 - RNA, 20 nt, Artificial Sequence
  B2M targeting sequence
uccuccccuucauucucuuc

SEQ ID NO: 1611 - RNA, 20 nt, Artificial Sequence
  B2M targeting sequence
uccccuucauucucuucuuc

SEQ ID NO: 1612 - RNA, 20 nt, Artificial Sequence
  B2M targeting sequence
ccuucauucucuucuucuuu

SEQ ID NO: 1613 - RNA, 20 nt, Artificial Sequence
  B2M targeting sequence
uucucuucuucuuuuuccaa

SEQ ID NO: 1614 - RNA, 20 nt, Artificial Sequence
  B2M targeting sequence
cuucuucuuuuuccaacugg

SEQ ID NO: 1615 - RNA, 20 nt, Artificial Sequence
  B2M targeting sequence
ucuucuuuuuccaacuggca

SEQ ID NO: 1616 - RNA, 20 nt, Artificial Sequence
  B2M targeting sequence
ucuuuuuccaacuggcaggc

SEQ ID NO: 1617 - RNA, 20 nt, Artificial Sequence
  B2M targeting sequence
uuuuccaacuggcaggcaga

SEQ ID NO: 1618 - RNA, 20 nt, Artificial Sequence
  B2M targeting sequence
aacuggcaggcagacaccag

SEQ ID NO: 1619 - RNA, 20 nt, Artificial Sequence
  B2M targeting sequence
gccugccaguuggaaaaaga

SEQ ID NO: 1620 - RNA, 20 nt, Artificial Sequence
  B2M targeting sequence
uccucagaagccaaggggcc

SEQ ID NO: 1621 - RNA, 20 nt, Artificial Sequence
  B2M targeting sequence
ucagaagccaaggggccaca

SEQ ID NO: 1622 - RNA, 20 nt, Artificial Sequence
  B2M targeting sequence
gaagccaaggggccacaggu

SEQ ID NO: 1623 - RNA, 20 nt, Artificial Sequence
  B2M targeting sequence
gaggaggagcuggugucugc

SEQ ID NO: 1624 - RNA, 20 nt, Artificial Sequence
  B2M targeting sequence
uaccuggcccuugguuuaag

SEQ ID NO: 1625 - RNA, 20 nt, Artificial Sequence
  B2M targeting sequence
ggcccacacuuaaaccaagg

SEQ ID NO: 1626 - RNA, 20 nt, Artificial Sequence
  B2M targeting sequence
ucuggcccacacuuaaacca

SEQ ID NO: 1627 - RNA, 20 nt, Artificial Sequence
  B2M targeting sequence
ccucuggcccacacuuaaac

SEQ ID NO: 1628 - RNA, 20 nt, Artificial Sequence
  B2M targeting sequence
uaccuucuccucuggcccac

SEQ ID NO: 1629 - RNA, 20 nt, Artificial Sequence
  B2M targeting sequence
gcugugagucuugucuagag

SEQ ID NO: 1630 - RNA, 20 nt, Artificial Sequence
  B2M targeting sequence
cagcugagccccaucuuacc

SEQ ID NO: 1631 - RNA, 20 nt, Artificial Sequence
  B2M targeting sequence
ugucuagagaggcugcuacu

SEQ ID NO: 1632 - RNA, 20 nt, Artificial Sequence
  B2M targeting sequence
agagaggcugcuacucaaua

SEQ ID NO: 1633 - RNA, 20 nt, Artificial Sequence
  B2M targeting sequence
agacaagacucacagcugag

SEQ ID NO: 1634 - RNA, 20 nt, Artificial Sequence
  B2M targeting sequence
cuagacaagacucacagcug

SEQ ID NO: 1635 - RNA, 20 nt, Artificial Sequence
  B2M targeting sequence
auagcacuucuguucauaag

SEQ ID NO: 1636 - RNA, 20 nt, Artificial Sequence
  B2M targeting sequence
guucauaagccaucuccagc

SEQ ID NO: 1637 - RNA, 20 nt, Artificial Sequence
  B2M targeting sequence
uaagccaucuccagcaccac

SEQ ID NO: 1638 - RNA, 20 nt, Artificial Sequence
  B2M targeting sequence
ccagcaccaccuuugaacau

SEQ ID NO: 1639 - RNA, 20 nt, Artificial Sequence
  B2M targeting sequence
agcaccaccuuugaacauaa

SEQ ID NO: 1640 - RNA, 20 nt, Artificial Sequence
  B2M targeting sequence
aagguggugcuggagauggc

SEQ ID NO: 1641 - RNA, 20 nt, Artificial Sequence
  B2M targeting sequence
uguucuguggguuuaacucg

SEQ ID NO: 1642 - RNA, 20 nt, Artificial Sequence
  B2M targeting sequence
guggguuuaacucggccucc

SEQ ID NO: 1643 - RNA, 20 nt, Artificial Sequence
  B2M targeting sequence
gccucccuucucccaaggug

SEQ ID NO: 1644 - RNA, 20 nt, Artificial Sequence
  B2M targeting sequence
cuucucccaaggugccccga

SEQ ID NO: 1645 - RNA, 20 nt, Artificial Sequence
  B2M targeting sequence
cccaaggugccccgaaccau

SEQ ID NO: 1646 - RNA, 20 nt, Artificial Sequence
  B2M targeting sequence
caaggugccccgaaccaucc

SEQ ID NO: 1647 - RNA, 20 nt, Artificial Sequence
  B2M targeting sequence
gggcaccuugggagaaggga

SEQ ID NO: 1648 - RNA, 20 nt, Artificial Sequence
  B2M targeting sequence
cccaguaagucaaauggaac

SEQ ID NO: 1649 - RNA, 20 nt, Artificial Sequence
  B2M targeting sequence
aauggaaccugagccaggug

SEQ ID NO: 1650 - RNA, 20 nt, Artificial Sequence
  B2M targeting sequence
auuugacuuacugggggaug

SEQ ID NO: 1651 - RNA, 20 nt, Artificial Sequence
  B2M targeting sequence
gguuccauuugacuuacugg

SEQ ID NO: 1652 - RNA, 20 nt, Artificial Sequence
  B2M targeting sequence
ugccuguagucccaguuacu

SEQ ID NO: 1653 - RNA, 20 nt, Artificial Sequence
  B2M targeting sequence
caguuacuugggaggccaag

SEQ ID NO: 1654 - RNA, 20 nt, Artificial Sequence
  B2M targeting sequence
caaguaacugggacuacagg

SEQ ID NO: 1655 - RNA, 20 nt, Artificial Sequence
  B2M targeting sequence
cgccuuggccucccaaguaa

SEQ ID NO: 1656 - RNA, 20 nt, Artificial Sequence
  B2M targeting sequence
ucccgccuuggccucccaag

SEQ ID NO: 1657 - RNA, 20 nt, Artificial Sequence
  B2M targeting sequence
uuugggcccaggaguuugag

SEQ ID NO: 1658 - RNA, 20 nt, Artificial Sequence
  B2M targeting sequence
ugggcccaaaugaucuuccc

SEQ ID NO: 1659 - RNA, 20 nt, Artificial Sequence
  B2M targeting sequence
aacuccugggcccaaaugau

SEQ ID NO: 1660 - RNA, 20 nt, Artificial Sequence
  B2M targeting sequence
caaacuccugggcccaaaug

SEQ ID NO: 1661 - RNA, 20 nt, Artificial Sequence
  B2M targeting sequence
gccugggcaacacagugaga

SEQ ID NO: 1662 - RNA, 20 nt, Artificial Sequence
  B2M targeting sequence
cuguguugcccaggcugauc

SEQ ID NO: 1663 - RNA, 20 nt, Artificial Sequence
  B2M targeting sequence
cacuguguugcccaggcuga

SEQ ID NO: 1664 - RNA, 20 nt, Artificial Sequence
  B2M targeting sequence
cuaaguaaaaaauuuaaaaa

SEQ ID NO: 1665 - RNA, 20 nt, Artificial Sequence
  B2M targeting sequence
aaguaaaaaauuuaaaaagc

SEQ ID NO: 1666 - RNA, 20 nt, Artificial Sequence
  B2M targeting sequence
uuuuguuugcuuuuuaaauu

SEQ ID NO: 1667 - RNA, 20 nt, Artificial Sequence
  B2M targeting sequence
gccggguuccuuuuguuugc

SEQ ID NO: 1668 - RNA, 20 nt, Artificial Sequence
  B2M targeting sequence
cuuucacauccccucuucaa

SEQ ID NO: 1669 - RNA, 20 nt, Artificial Sequence
  B2M targeting sequence
cauccccucuucaauuccuu

SEQ ID NO: 1670 - RNA, 20 nt, Artificial Sequence
  B2M targeting sequence
ccucuucaauuccuucauua

SEQ ID NO: 1671 - RNA, 20 nt, Artificial Sequence
  B2M targeting sequence
ucaauuccuucauuaaguuc

SEQ ID NO: 1672 - RNA, 20 nt, Artificial Sequence
  B2M targeting sequence
auuccuucauuaaguucuag

SEQ ID NO: 1673 - RNA, 20 nt, Artificial Sequence
  B2M targeting sequence
uucauuaaguucuagcacag

SEQ ID NO: 1674 - RNA, 20 nt, Artificial Sequence
  B2M targeting sequence
uuaaguucuagcacagccuu

SEQ ID NO: 1675 - RNA, 20 nt, Artificial Sequence
  B2M targeting sequence
agcacagccuuuuccaucug

SEQ ID NO: 1676 - RNA, 20 nt, Artificial Sequence
  B2M targeting sequence
aucugcucugccccacccaa

SEQ ID NO: 1677 - RNA, 20 nt, Artificial Sequence
  B2M targeting sequence
gcucugccccacccaacgcc

SEQ ID NO: 1678 - RNA, 20 nt, Artificial Sequence
  B2M targeting sequence
gccccacccaacgcccuuuc

SEQ ID NO: 1679 - RNA, 20 nt, Artificial Sequence
  B2M targeting sequence
auugccucuuugaacaaguu

SEQ ID NO: 1680 - RNA, 20 nt, Artificial Sequence
  B2M targeting sequence
uugaacaaguuccaccugcc

SEQ ID NO: 1681 - RNA, 20 nt, Artificial Sequence
  B2M targeting sequence
aagaggcaauagaaagggcg

SEQ ID NO: 1682 - RNA, 20 nt, Artificial Sequence
  B2M targeting sequence
accugcccugacucacugca

SEQ ID NO: 1683 - RNA, 20 nt, Artificial Sequence
  B2M targeting sequence
gggcagguggaacuuguuca

SEQ ID NO: 1684 - RNA, 20 nt, Artificial Sequence
  B2M targeting sequence
cugcaauuuaacccuacugu

SEQ ID NO: 1685 - RNA, 20 nt, Artificial Sequence
  B2M targeting sequence
uuuaacaguaauaugaggcu

SEQ ID NO: 1686 - RNA, 20 nt, Artificial Sequence
  B2M targeting sequence
uauuacuguuaaaugaacau

SEQ ID NO: 1687 - RNA, 20 nt, Artificial Sequence
  B2M targeting sequence
uggguuguuguugauaauuu

SEQ ID NO: 1688 - RNA, 20 nt, Artificial Sequence
  B2M targeting sequence
acaacaacccaggacagccu

SEQ ID NO: 1689 - RNA, 20 nt, Artificial Sequence
  B2M targeting sequence
ccaaccuaguaaaauuauca

SEQ ID NO: 1690 - RNA, 20 nt, Artificial Sequence
  B2M targeting sequence
caccaaccuaguaaaauuau

SEQ ID NO: 1691 - RNA, 20 nt, Artificial Sequence
  B2M targeting sequence
gggcuuuauuuuucucacca

SEQ ID NO: 1692 - RNA, 20 nt, Artificial Sequence
  B2M targeting sequence
ucugggcuuuauuuuucuca

SEQ ID NO: 1693 - RNA, 20 nt, Artificial Sequence
  B2M targeting sequence
cucuucugggcuuuauuuuu

SEQ ID NO: 1694 - RNA, 20 nt, Artificial Sequence
  B2M targeting sequence
gucacccauuaugauauaau

SEQ ID NO: 1695 - RNA, 20 nt, Artificial Sequence
  B2M targeting sequence
cccauuaugauauaauuagc

SEQ ID NO: 1696 - RNA, 20 nt, Artificial Sequence
  B2M targeting sequence
uaaugggugacugaaagguc

SEQ ID NO: 1697 - RNA, 20 nt, Artificial Sequence
  B2M targeting sequence
acuugcuaauuauaucauaa

SEQ ID NO: 1698 - RNA, 20 nt, Artificial Sequence
  B2M targeting sequence
uccacuugcuaauuauauca

SEQ ID NO: 1699 - RNA, 20 nt, Artificial Sequence
  B2M targeting sequence
aaauucuuccacuugcuaau

SEQ ID NO: 1700 - RNA, 20 nt, Artificial Sequence
  B2M targeting sequence
agugacucuggacauccaau

SEQ ID NO: 1701 - RNA, 20 nt, Artificial Sequence
  B2M targeting sequence
cuggaaguuauuccaaauuc

SEQ ID NO: 1702 - RNA, 20 nt, Artificial Sequence
  B2M targeting sequence
ggacauccaaucccauaugu

SEQ ID NO: 1703 - RNA, 20 nt, Artificial Sequence
  B2M targeting sequence
agagucacuggaaguuauuc

SEQ ID NO: 1704 - RNA, 20 nt, Artificial Sequence
  B2M targeting sequence
aaucccauaugugaaacaga

SEQ ID NO: 1705 - RNA, 20 nt, Artificial Sequence
  B2M targeting sequence
cauaugugaaacagaccagc

SEQ ID NO: 1706 - RNA, 20 nt, Artificial Sequence
  B2M targeting sequence
cauaugggauuggaugucca

SEQ ID NO: 1707 - RNA, 20 nt, Artificial Sequence
  B2M targeting sequence
guuucacauaugggauugga

SEQ ID NO: 1708 - RNA, 20 nt, Artificial Sequence
  B2M targeting sequence
gcaugcuggggcauuuuaua

SEQ ID NO: 1709 - RNA, 20 nt, Artificial Sequence
  B2M targeting sequence
cggcccacuuguugauaccu

SEQ ID NO: 1710 - RNA, 20 nt, Artificial Sequence
  B2M targeting sequence
acaagugggccgugauguua

SEQ ID NO: 1711 - RNA, 20 nt, Artificial Sequence
  B2M targeting sequence
aggcaauucaucuuggcagg

SEQ ID NO: 1712 - RNA, 20 nt, Artificial Sequence
  B2M targeting sequence
ucuuggcaggcugguggacu

SEQ ID NO: 1713 - RNA, 20 nt, Artificial Sequence
  B2M targeting sequence
uggcaggcugguggacuucc

SEQ ID NO: 1714 - RNA, 20 nt, Artificial Sequence
  B2M targeting sequence
accagccugccaagaugaau

SEQ ID NO: 1715 - RNA, 20 nt, Artificial Sequence
  B2M targeting sequence
uucuuagccguguccuccag

SEQ ID NO: 1716 - RNA, 20 nt, Artificial Sequence
  B2M targeting sequence
uagccguguccuccagugaa

SEQ ID NO: 1717 - RNA, 20 nt, Artificial Sequence
  B2M targeting sequence
uccagugaaacagcauugcc

SEQ ID NO: 1718 - RNA, 20 nt, Artificial Sequence
  B2M targeting sequence
agugaaacagcauugccagc

SEQ ID NO: 1719 - RNA, 20 nt, Artificial Sequence
  B2M targeting sequence
cuggaggacacggcuaagaa

SEQ ID NO: 1720 - RNA, 20 nt, Artificial Sequence
  B2M targeting sequence
ggaagguaaaccugagacaa

SEQ ID NO: 1721 - RNA, 20 nt, Artificial Sequence
  B2M targeting sequence
agaggcuggcaaugcuguuu

SEQ ID NO: 1722 - RNA, 20 nt, Artificial Sequence
  B2M targeting sequence
gguuuaccuuccagaggcug

SEQ ID NO: 1723 - RNA, 20 nt, Artificial Sequence
  B2M targeting sequence
cagguuuaccuuccagaggc

SEQ ID NO: 1724 - RNA, 20 nt, Artificial Sequence
  B2M targeting sequence
ugucucagguuuaccuucca

SEQ ID NO: 1725 - RNA, 20 nt, Artificial Sequence
  B2M targeting sequence
uucuugucucagguuuaccu

SEQ ID NO: 1726 - RNA, 20 nt, Artificial Sequence
  B2M targeting sequence
uggccucuuucuugucucag

SEQ ID NO: 1727 - RNA, 20 nt, Artificial Sequence
  B2M targeting sequence
ucagucaguaaggaugacau

SEQ ID NO: 1728 - RNA, 20 nt, Artificial Sequence
  B2M targeting sequence
gucaguaaggaugacauggc

SEQ ID NO: 1729 - RNA, 20 nt, Artificial Sequence
  B2M targeting sequence
guaaggaugacauggcaccc

SEQ ID NO: 1730 - RNA, 20 nt, Artificial Sequence
  B2M targeting sequence
uuacugacugaggauggugc

SEQ ID NO: 1731 - RNA, 20 nt, Artificial Sequence
  B2M targeting sequence
uccuuacugacugaggaugg

SEQ ID NO: 1732 - RNA, 20 nt, Artificial Sequence
  B2M targeting sequence
auggcuguuuuagggugcca

SEQ ID NO: 1733 - RNA, 20 nt, Artificial Sequence
  B2M targeting sequence
ucccagcaagaugguuagag

SEQ ID NO: 1734 - RNA, 20 nt, Artificial Sequence
  B2M targeting sequence
cagcaagaugguuagagaau

SEQ ID NO: 1735 - RNA, 20 nt, Artificial Sequence
  B2M targeting sequence
ugcugggaggauuccauggc

SEQ ID NO: 1736 - RNA, 20 nt, Artificial Sequence
  B2M targeting sequence
aaccaucuugcugggaggau

SEQ ID NO: 1737 - RNA, 20 nt, Artificial Sequence
  B2M targeting sequence
cuaaccaucuugcugggagg

SEQ ID NO: 1738 - RNA, 20 nt, Artificial Sequence
  B2M targeting sequence
uggccauggucuugaggaga

SEQ ID NO: 1739 - RNA, 20 nt, Artificial Sequence
  B2M targeting sequence
ugaggagagagacccugggg

SEQ ID NO: 1740 - RNA, 20 nt, Artificial Sequence
  B2M targeting sequence
agaccauggccaagaauucu

SEQ ID NO: 1741 - RNA, 20 nt, Artificial Sequence
  B2M targeting sequence
ucaagaccauggccaagaau

SEQ ID NO: 1742 - RNA, 20 nt, Artificial Sequence
  B2M targeting sequence
ccucaagaccauggccaaga

SEQ ID NO: 1743 - RNA, 20 nt, Artificial Sequence
  B2M targeting sequence
cuccucaagaccauggccaa

SEQ ID NO: 1744 - RNA, 20 nt, Artificial Sequence
  B2M targeting sequence
cucuccucaagaccauggcc

SEQ ID NO: 1745 - RNA, 20 nt, Artificial Sequence
  B2M targeting sequence
cagacugccauaaacaccca

SEQ ID NO: 1746 - RNA, 20 nt, Artificial Sequence
  B2M targeting sequence
gacugccauaaacacccacc

SEQ ID NO: 1747 - RNA, 20 nt, Artificial Sequence
  B2M targeting sequence
gagaccccagggucucucuc

SEQ ID NO: 1748 - RNA, 20 nt, Artificial Sequence
  B2M targeting sequence
cagcucggcucuagggagcu

SEQ ID NO: 1749 - RNA, 20 nt, Artificial Sequence
  B2M targeting sequence
gcucuagggagcugucccac

SEQ ID NO: 1750 - RNA, 20 nt, Artificial Sequence
  B2M targeting sequence
agggagcugucccacaaagg

SEQ ID NO: 1751 - RNA, 20 nt, Artificial Sequence
  B2M targeting sequence
cuagagccgagcugggaggg

SEQ ID NO: 1752 - RNA, 20 nt, Artificial Sequence
  B2M targeting sequence
cacaaagggacagaaaugag

SEQ ID NO: 1753 - RNA, 20 nt, Artificial Sequence
  B2M targeting sequence
cuuugugggacagcucccua

SEQ ID NO: 1754 - RNA, 20 nt, Artificial Sequence
  B2M targeting sequence
gucccuuugugggacagcuc

SEQ ID NO: 1755 - RNA, 20 nt, Artificial Sequence
  B2M targeting sequence
uuucugucccuuugugggac

SEQ ID NO: 1756 - RNA, 20 nt, Artificial Sequence
  B2M targeting sequence
agccugugccucauuucugu

SEQ ID NO: 1757 - RNA, 20 nt, Artificial Sequence
  B2M targeting sequence
ugcuucuagccugugccuca

SEQ ID NO: 1758 - RNA, 20 nt, Artificial Sequence
  B2M targeting sequence
uccugcuucuagccugugcc

SEQ ID NO: 1759 - RNA, 20 nt, Artificial Sequence
  B2M targeting sequence
cuuccugcuucuagccugug

SEQ ID NO: 1760 - RNA, 20 nt, Artificial Sequence
  B2M targeting sequence
caaccgacaucaccagucac

SEQ ID NO: 1761 - RNA, 20 nt, Artificial Sequence
  B2M targeting sequence
guugggaaguacuucucuuc

SEQ ID NO: 1762 - RNA, 20 nt, Artificial Sequence
  B2M targeting sequence
ccagucaccguccgagugug

SEQ ID NO: 1763 - RNA, 20 nt, Artificial Sequence
  B2M targeting sequence
ccguccgaguguggugaugc

SEQ ID NO: 1764 - RNA, 20 nt, Artificial Sequence
  B2M targeting sequence
gaguguggugaugccuugcu

SEQ ID NO: 1765 - RNA, 20 nt, Artificial Sequence
  B2M targeting sequence
gacggugacuggugaugucg

SEQ ID NO: 1766 - RNA, 20 nt, Artificial Sequence
  B2M targeting sequence
ccacacucggacggugacug

SEQ ID NO: 1767 - RNA, 20 nt, Artificial Sequence
  B2M targeting sequence
gcagcaaggcaucaccacac

SEQ ID NO: 1768 - RNA, 20 nt, Artificial Sequence
  B2M targeting sequence
gguggugggugucggcagca

SEQ ID NO: 1769 - RNA, 20 nt, Artificial Sequence
  B2M targeting sequence
uuucuguuuaaguuauucau

SEQ ID NO: 1770 - RNA, 20 nt, Artificial Sequence
  B2M targeting sequence
guuuaaguuauucauagcag

SEQ ID NO: 1771 - RNA, 20 nt, Artificial Sequence
  B2M targeting sequence
uagcagccugggccaggacc

SEQ ID NO: 1772 - RNA, 20 nt, Artificial Sequence
  B2M targeting sequence
uggcccaggcugcuaugaau

SEQ ID NO: 1773 - RNA, 20 nt, Artificial Sequence
  B2M targeting sequence
uggcuuuaaaagucccagcu

SEQ ID NO: 1774 - RNA, 20 nt, Artificial Sequence
  B2M targeting sequence
cagcuccuccccugcucacc

SEQ ID NO: 1775 - RNA, 20 nt, Artificial Sequence
  B2M targeting sequence
uccccugcucacccauuaaa

SEQ ID NO: 1776 - RNA, 20 nt, Artificial Sequence
  B2M targeting sequence
ccugcucacccauuaaaggg

SEQ ID NO: 1777 - RNA, 20 nt, Artificial Sequence
  B2M targeting sequence
cccauuaaagggcuagcauc

SEQ ID NO: 1778 - RNA, 20 nt, Artificial Sequence
  B2M targeting sequence
uccauccauuggggccugau

SEQ ID NO: 1779 - RNA, 20 nt, Artificial Sequence
  B2M targeting sequence
auccauuggggccugaugga

SEQ ID NO: 1780 - RNA, 20 nt, Artificial Sequence
  B2M targeting sequence
auuggggccugauggaaaua

SEQ ID NO: 1781 - RNA, 20 nt, Artificial Sequence
  B2M targeting sequence
ggccccaauggauggaggau

SEQ ID NO: 1782 - RNA, 20 nt, Artificial Sequence
  B2M targeting sequence
aucaggccccaauggaugga

SEQ ID NO: 1783 - RNA, 20 nt, Artificial Sequence
  B2M targeting sequence
uauuuccaucaggccccaau

SEQ ID NO: 1784 - RNA, 20 nt, Artificial Sequence
  B2M targeting sequence
cauauuuccaucaggcccca

SEQ ID NO: 1785 - RNA, 20 nt, Artificial Sequence
  B2M targeting sequence
uuaaacuauguucucauauu

SEQ ID NO: 1786 - RNA, 20 nt, Artificial Sequence
  B2M targeting sequence
agcguuuuuuuaaucauuaa

SEQ ID NO: 1787 - RNA, 20 nt, Artificial Sequence
  B2M targeting sequence
auucaagcguuuuuuuaauc

SEQ ID NO: 1788 - RNA, 20 nt, Artificial Sequence
  B2M targeting sequence
ccauucaagcguuuuuuuaa

SEQ ID NO: 1789 - RNA, 20 nt, Artificial Sequence
  B2M targeting sequence
uuucuccauucaagcguuuu

SEQ ID NO: 1790 - RNA, 20 nt, Artificial Sequence
  B2M targeting sequence
auggcuuuuaguacaguuua

SEQ ID NO: 1791 - RNA, 20 nt, Artificial Sequence
  B2M targeting sequence
caauaaacuguacuaaaagc

SEQ ID NO: 1792 - RNA, 20 nt, Artificial Sequence
  B2M targeting sequence
aucccaauaaacuguacuaa

SEQ ID NO: 1793 - RNA, 20 nt, Artificial Sequence
  B2M targeting sequence
gcccccaaauaucaauccca

SEQ ID NO: 1794 - RNA, 20 nt, Artificial Sequence
  B2M targeting sequence
uuuuaacuaucugcccccaa

SEQ ID NO: 1795 - RNA, 20 nt, Artificial Sequence
  B2M targeting sequence
ucuuuuuaacuaucugcccc

SEQ ID NO: 1796 - RNA, 20 nt, Artificial Sequence
  B2M targeting sequence
cuguuuuccacacccuucau

SEQ ID NO: 1797 - RNA, 20 nt, Artificial Sequence
  B2M targeting sequence
acacccuucauugguaguuu

SEQ ID NO: 1798 - RNA, 20 nt, Artificial Sequence
  B2M targeting sequence
uugguaguuugugagguugc

SEQ ID NO: 1799 - RNA, 20 nt, Artificial Sequence
  B2M targeting sequence
caaacuaccaaugaagggug

SEQ ID NO: 1800 - RNA, 20 nt, Artificial Sequence
  B2M targeting sequence
cuagguuuugcuucaacaaa

SEQ ID NO: 1801 - RNA, 20 nt, Artificial Sequence
  B2M targeting sequence
acaaaauuggauaggaaagu

SEQ ID NO: 1802 - RNA, 20 nt, Artificial Sequence
  B2M targeting sequence
aauuuuguugaagcaaaacc

SEQ ID NO: 1803 - RNA, 20 nt, Artificial Sequence
  B2M targeting sequence
uauccaauuuuguugaagca

SEQ ID NO: 1804 - RNA, 20 nt, Artificial Sequence
  B2M targeting sequence
uggguagauccuggggagga

SEQ ID NO: 1805 - RNA, 20 nt, Artificial Sequence
  B2M targeting sequence
acccaggacuuuccuaucca

SEQ ID NO: 1806 - RNA, 20 nt, Artificial Sequence
  B2M targeting sequence
uggggaggaugccuagcaac

SEQ ID NO: 1807 - RNA, 20 nt, Artificial Sequence
  B2M targeting sequence
ccaggaucuacccaggacuu

SEQ ID NO: 1808 - RNA, 20 nt, Artificial Sequence
  B2M targeting sequence
uccccaggaucuacccagga

SEQ ID NO: 1809 - RNA, 20 nt, Artificial Sequence
  B2M targeting sequence
uggcgcuucagggcagcgua

SEQ ID NO: 1810 - RNA, 20 nt, Artificial Sequence
  B2M targeting sequence
gggcagcguacuugaagccc

SEQ ID NO: 1811 - RNA, 20 nt, Artificial Sequence
  B2M targeting sequence
aguacgcugcccugaagcgc

SEQ ID NO: 1812 - RNA, 20 nt, Artificial Sequence
  B2M targeting sequence
aguccaccugaugaugcuug

SEQ ID NO: 1813 - RNA, 20 nt, Artificial Sequence
  B2M targeting sequence
accugaugaugcuugcccuu

SEQ ID NO: 1814 - RNA, 20 nt, Artificial Sequence
  B2M targeting sequence
gguggacuugagggcuucaa

SEQ ID NO: 1815 - RNA, 20 nt, Artificial Sequence
  B2M targeting sequence
ucagguggacuugagggcuu

SEQ ID NO: 1816 - RNA, 20 nt, Artificial Sequence
  B2M targeting sequence
ccgggucaugugagcuuaag

SEQ ID NO: 1817 - RNA, 20 nt, Artificial Sequence
  B2M targeting sequence
ugugagcuuaagucagcuac

SEQ ID NO: 1818 - RNA, 20 nt, Artificial Sequence
  B2M targeting sequence
caugacccggugaagggcaa

SEQ ID NO: 1819 - RNA, 20 nt, Artificial Sequence
  B2M targeting sequence
gcuacucagcucugacugau

SEQ ID NO: 1820 - RNA, 20 nt, Artificial Sequence
  B2M targeting sequence
gcucugacugaugagagacc

SEQ ID NO: 1821 - RNA, 20 nt, Artificial Sequence
  B2M targeting sequence
gacugaugagagaccccugu

SEQ ID NO: 1822 - RNA, 20 nt, Artificial Sequence
  B2M targeting sequence
gagcugaguagcugacuuaa

SEQ ID NO: 1823 - RNA, 20 nt, Artificial Sequence
  B2M targeting sequence
gucagagcugaguagcugac

SEQ ID NO: 1824 - RNA, 20 nt, Artificial Sequence
  B2M targeting sequence
ucagucagagcugaguagcu

SEQ ID NO: 1825 - RNA, 20 nt, Artificial Sequence
  B2M targeting sequence
caucagucagagcugaguag

SEQ ID NO: 1826 - RNA, 20 nt, Artificial Sequence
  B2M targeting sequence
cucaucagucagagcugagu

SEQ ID NO: 1827 - RNA, 20 nt, Artificial Sequence
  B2M targeting sequence
caggggucucucaucaguca

SEQ ID NO: 1828 - RNA, 20 nt, Artificial Sequence
  B2M targeting sequence
aaauucacaggggucucuca

SEQ ID NO: 1829 - RNA, 20 nt, Artificial Sequence
  B2M targeting sequence
gaucuucaugguaaaaacac

SEQ ID NO: 1830 - RNA, 20 nt, Artificial Sequence
  B2M targeting sequence
gacuuccaaauucacagggg

SEQ ID NO: 1831 - RNA, 20 nt, Artificial Sequence
  B2M targeting sequence
ucaugguaaaaacacuuuug

SEQ ID NO: 1832 - RNA, 20 nt, Artificial Sequence
  B2M targeting sequence
ugguaaaaacacuuuugcau

SEQ ID NO: 1833 - RNA, 20 nt, Artificial Sequence
  B2M targeting sequence
ugcaaaaguguuuuuaccau

SEQ ID NO: 1834 - RNA, 20 nt, Artificial Sequence
  B2M targeting sequence
caugcaaaaguguuuuuacc

SEQ ID NO: 1835 - RNA, 20 nt, Artificial Sequence
  B2M targeting sequence
uacaucuucuuggcugcucu

SEQ ID NO: 1836 - RNA, 20 nt, Artificial Sequence
  B2M targeting sequence
ucuuggcugcucuaauggca

SEQ ID NO: 1837 - RNA, 20 nt, Artificial Sequence
  B2M targeting sequence
uggcugcucuaauggcaaac

SEQ ID NO: 1838 - RNA, 20 nt, Artificial Sequence
  B2M targeting sequence
aauggcaaacugguccagaa

SEQ ID NO: 1839 - RNA, 20 nt, Artificial Sequence
  B2M targeting sequence
agaagcucaggaguaaaaac

SEQ ID NO: 1840 - RNA, 20 nt, Artificial Sequence
  B2M targeting sequence
ggaccaguuugccauuagag

SEQ ID NO: 1841 - RNA, 20 nt, Artificial Sequence
  B2M targeting sequence
ggaguaaaaacaaaucaaca

SEQ ID NO: 1842 - RNA, 20 nt, Artificial Sequence
  B2M targeting sequence
ugagcuucuggaccaguuug

SEQ ID NO: 1843 - RNA, 20 nt, Artificial Sequence
  B2M targeting sequence
acaacaacaaaaacaaaaac

SEQ ID NO: 1844 - RNA, 20 nt, Artificial Sequence
  B2M targeting sequence
ugguaggcaaaacccaacac

SEQ ID NO: 1845 - RNA, 20 nt, Artificial Sequence
  B2M targeting sequence
caagucucaucuaacccuca

SEQ ID NO: 1846 - RNA, 20 nt, Artificial Sequence
  B2M targeting sequence
caucuaacccucaagcaacc

SEQ ID NO: 1847 - RNA, 20 nt, Artificial Sequence
  B2M targeting sequence
ucuaacccucaagcaacccu

SEQ ID NO: 1848 - RNA, 20 nt, Artificial Sequence
  B2M targeting sequence
aacccucaagcaacccuggg

SEQ ID NO: 1849 - RNA, 20 nt, Artificial Sequence
  B2M targeting sequence
agcaacccuggguucugugc

SEQ ID NO: 1850 - RNA, 20 nt, Artificial Sequence
  B2M targeting sequence
gugcccacauccuguguuca

SEQ ID NO: 1851 - RNA, 20 nt, Artificial Sequence
  B2M targeting sequence
uguguucagcugaaacccac

SEQ ID NO: 1852 - RNA, 20 nt, Artificial Sequence
  B2M targeting sequence
gcugaaacccacaugacuuu

SEQ ID NO: 1853 - RNA, 20 nt, Artificial Sequence
  B2M targeting sequence
gcugaacacaggaugugggc

SEQ ID NO: 1854 - RNA, 20 nt, Artificial Sequence
  B2M targeting sequence
uguggguuucagcugaacac

SEQ ID NO: 1855 - RNA, 20 nt, Artificial Sequence
  B2M targeting sequence
acaaagucauguggguuuca

SEQ ID NO: 1856 - RNA, 20 nt, Artificial Sequence
  B2M targeting sequence
gaauaagaauaaaaacuaag

SEQ ID NO: 1857 - RNA, 20 nt, Artificial Sequence
  B2M targeting sequence
gaaguucuacaaagucaugu

SEQ ID NO: 1858 - RNA, 20 nt, Artificial Sequence
  B2M targeting sequence
uauucagaaguucuacaaag

SEQ ID NO: 1859 - RNA, 20 nt, Artificial Sequence
  B2M targeting sequence
cuacaucaaaaaugaaaguu

SEQ ID NO: 1860 - RNA, 20 nt, Artificial Sequence
  B2M targeting sequence
aaaaugaaaguuaggacccu

SEQ ID NO: 1861 - RNA, 20 nt, Artificial Sequence
  B2M targeting sequence
uuuuugauguagggaaauua

SEQ ID NO: 1862 - RNA, 20 nt, Artificial Sequence
  B2M targeting sequence
uaacuuucauuuuugaugua

SEQ ID NO: 1863 - RNA, 20 nt, Artificial Sequence
  B2M targeting sequence
ugucauggugauaagaccau

SEQ ID NO: 1864 - RNA, 20 nt, Artificial Sequence
  B2M targeting sequence
uggugauaagaccaugauuc

SEQ ID NO: 1865 - RNA, 20 nt, Artificial Sequence
  B2M targeting sequence
ccaugacaagaggguccuaa

SEQ ID NO: 1866 - RNA, 20 nt, Artificial Sequence
  B2M targeting sequence
uaucaccaugacaagagggu

SEQ ID NO: 1867 - RNA, 20 nt, Artificial Sequence
  B2M targeting sequence
uggucuuaucaccaugacaa

SEQ ID NO: 1868 - RNA, 20 nt, Artificial Sequence
  B2M targeting sequence
uggugccuuuaaaggaaaau

SEQ ID NO: 1869 - RNA, 20 nt, Artificial Sequence
  B2M targeting sequence
uuuaaaggcaccaagaauca

SEQ ID NO: 1870 - RNA, 20 nt, Artificial Sequence
  B2M targeting sequence
gaaguuuuacugcaggucau

SEQ ID NO: 1871 - RNA, 20 nt, Artificial Sequence
  B2M targeting sequence
gaaacaaauauuuuccuuua

SEQ ID NO: 1872 - RNA, 20 nt, Artificial Sequence
  B2M targeting sequence
uaacuauaugggugggggaa

SEQ ID NO: 1873 - RNA, 20 nt, Artificial Sequence
  B2M targeting sequence
cccacccauauaguuaugac

SEQ ID NO: 1874 - RNA, 20 nt, Artificial Sequence
  B2M targeting sequence
agcuacuuauauuuguuccc

SEQ ID NO: 1875 - RNA, 20 nt, Artificial Sequence
  B2M targeting sequence
guaacuuucaagcuacuuau

SEQ ID NO: 1876 - RNA, 20 nt, Artificial Sequence
  B2M targeting sequence
cauauaucuugagauagcau

SEQ ID NO: 1877 - RNA, 20 nt, Artificial Sequence
  B2M targeting sequence
uauaucuugagauagcaucu

SEQ ID NO: 1878 - RNA, 20 nt, Artificial Sequence
  B2M targeting sequence
ugagauagcaucuuacucug

SEQ ID NO: 1879 - RNA, 20 nt, Artificial Sequence
  B2M targeting sequence
agauauaugagaaguuuuuc

SEQ ID NO: 1880 - RNA, 20 nt, Artificial Sequence
  B2M targeting sequence
caagauauaugagaaguuuu

SEQ ID NO: 1881 - RNA, 20 nt, Artificial Sequence
  B2M targeting sequence
uacucugucacccaggcuug

SEQ ID NO: 1882 - RNA, 20 nt, Artificial Sequence
  B2M targeting sequence
gucacccaggcuugagugca

SEQ ID NO: 1883 - RNA, 20 nt, Artificial Sequence
  B2M targeting sequence
cccaggcuugagugcagugg

SEQ ID NO: 1884 - RNA, 20 nt, Artificial Sequence
  B2M targeting sequence
agccugggugacagaguaag

SEQ ID NO: 1885 - RNA, 20 nt, Artificial Sequence
  B2M targeting sequence
ugccacugcacucaagccug

SEQ ID NO: 1886 - RNA, 20 nt, Artificial Sequence
  B2M targeting sequence
uggcccacugcagccuccac

SEQ ID NO: 1887 - RNA, 20 nt, Artificial Sequence
  B2M targeting sequence
accucccggguucaagauuc

SEQ ID NO: 1888 - RNA, 20 nt, Artificial Sequence
  B2M targeting sequence
cggguucaagauucuccugc

SEQ ID NO: 1889 - RNA, 20 nt, Artificial Sequence
  B2M targeting sequence
agauucuccugccucagccu

SEQ ID NO: 1890 - RNA, 20 nt, Artificial Sequence
  B2M targeting sequence
ugaacccgggagguggaggc

SEQ ID NO: 1891 - RNA, 20 nt, Artificial Sequence
  B2M targeting sequence
ccugccucagccucccgagu

SEQ ID NO: 1892 - RNA, 20 nt, Artificial Sequence
  B2M targeting sequence
ugccucagccucccgaguag

SEQ ID NO: 1893 - RNA, 20 nt, Artificial Sequence
  B2M targeting sequence
gccucccgaguagcugggau

SEQ ID NO: 1894 - RNA, 20 nt, Artificial Sequence
  B2M targeting sequence
cgaguagcugggauuacagg

SEQ ID NO: 1895 - RNA, 20 nt, Artificial Sequence
  B2M targeting sequence
ggaggcugaggcaggagaau

SEQ ID NO: 1896 - RNA, 20 nt, Artificial Sequence
  B2M targeting sequence
cagcuacucgggaggcugag

SEQ ID NO: 1897 - RNA, 20 nt, Artificial Sequence
  B2M targeting sequence
guagaaacaggguuucgcca

SEQ ID NO: 1898 - RNA, 20 nt, Artificial Sequence
  B2M targeting sequence
acugaaaaaaaauauauaua

SEQ ID NO: 1899 - RNA, 20 nt, Artificial Sequence
  B2M targeting sequence
ccauguuggccaggcuuguc

SEQ ID NO: 1900 - RNA, 20 nt, Artificial Sequence
  B2M targeting sequence
caaacuccugaccucaagua

SEQ ID NO: 1901 - RNA, 20 nt, Artificial Sequence
  B2M targeting sequence
aacuccugaccucaaguaau

SEQ ID NO: 1902 - RNA, 20 nt, Artificial Sequence
  B2M targeting sequence
ugaccucaaguaauccaccu

SEQ ID NO: 1903 - RNA, 20 nt, Artificial Sequence
  B2M targeting sequence
ggaguuugagacaagccugg

SEQ ID NO: 1904 - RNA, 20 nt, Artificial Sequence
  B2M targeting sequence
aguaauccaccugccuuggc

SEQ ID NO: 1905 - RNA, 20 nt, Artificial Sequence
  B2M targeting sequence
accugccuuggccucccaaa

SEQ ID NO: 1906 - RNA, 20 nt, Artificial Sequence
  B2M targeting sequence
caaagggcugggauuacaag

SEQ ID NO: 1907 - RNA, 20 nt, Artificial Sequence
  B2M targeting sequence
cagcccuuugggaggccaag

SEQ ID NO: 1908 - RNA, 20 nt, Artificial Sequence
  B2M targeting sequence
ggccuuuuugguaauguuau

SEQ ID NO: 1909 - RNA, 20 nt, Artificial Sequence
  B2M targeting sequence
gcuguuucucucaggaacuu

SEQ ID NO: 1910 - RNA, 20 nt, Artificial Sequence
  B2M targeting sequence
cucaggaacuuccuaauaac

SEQ ID NO: 1911 - RNA, 20 nt, Artificial Sequence
  B2M targeting sequence
caggaacuuccuaauaacgu

SEQ ID NO: 1912 - RNA, 20 nt, Artificial Sequence
  B2M targeting sequence
ggaacuuccuaauaacguac

SEQ ID NO: 1913 - RNA, 20 nt, Artificial Sequence
  B2M targeting sequence
ugagagaaacagcugaauaa

SEQ ID NO: 1914 - RNA, 20 nt, Artificial Sequence
  B2M targeting sequence
uaauaacguacuuuagcacu

SEQ ID NO: 1915 - RNA, 20 nt, Artificial Sequence
  B2M targeting sequence
uuuuguuaauagugcuaaag

SEQ ID NO: 1916 - RNA, 20 nt, Artificial Sequence
  B2M targeting sequence
ccaugugguccuuuuguuaa

SEQ ID NO: 1917 - RNA, 20 nt, Artificial Sequence
  B2M targeting sequence
guguuccagaggugauucau

SEQ ID NO: 1918 - RNA, 20 nt, Artificial Sequence
  B2M targeting sequence
agaggugauucauuagguug

SEQ ID NO: 1919 - RNA, 20 nt, Artificial Sequence
  B2M targeting sequence
ggaacacugaaauucaccau

SEQ ID NO: 1920 - RNA, 20 nt, Artificial Sequence
  B2M targeting sequence
ccucuggaacacugaaauuc

SEQ ID NO: 1921 - RNA, 20 nt, Artificial Sequence
  B2M targeting sequence
uuagguuguuguagagacua

SEQ ID NO: 1922 - RNA, 20 nt, Artificial Sequence
  B2M targeting sequence
acaacaaccuaaugaaucac

SEQ ID NO: 1923 - RNA, 20 nt, Artificial Sequence
  B2M targeting sequence
cuacaacaaccuaaugaauc

SEQ ID NO: 1924 - RNA, 20 nt, Artificial Sequence
  B2M targeting sequence
agucucuacaacaaccuaau

SEQ ID NO: 1925 - RNA, 20 nt, Artificial Sequence
  B2M targeting sequence
uaaggagaaacuuguugcau

SEQ ID NO: 1926 - RNA, 20 nt, Artificial Sequence
  B2M targeting sequence
uuaagaucuagucucuacaa

SEQ ID NO: 1927 - RNA, 20 nt, Artificial Sequence
  B2M targeting sequence
ccuuaagaucuagucucuac

SEQ ID NO: 1928 - RNA, 20 nt, Artificial Sequence
  B2M targeting sequence
ugcaacaaguuucuccuuaa

SEQ ID NO: 1929 - RNA, 20 nt, Artificial Sequence
  B2M targeting sequence
ucaugcaacaaguuucuccu

SEQ ID NO: 1930 - RNA, 20 nt, Artificial Sequence
  B2M targeting sequence
uucugaagggacuucuggua

SEQ ID NO: 1931 - RNA, 20 nt, Artificial Sequence
  B2M targeting sequence
gaagggacuucugguacuga

SEQ ID NO: 1932 - RNA, 20 nt, Artificial Sequence
  B2M targeting sequence
gaaugaaaaucuucaugcaa

SEQ ID NO: 1933 - RNA, 20 nt, Artificial Sequence
  B2M targeting sequence
cuucagaaugaaaaucuuca

SEQ ID NO: 1934 - RNA, 20 nt, Artificial Sequence
  B2M targeting sequence
gguacugacuaguaccaaag

SEQ ID NO: 1935 - RNA, 20 nt, Artificial Sequence
  B2M targeting sequence
guaccagaagucccuucaga

SEQ ID NO: 1936 - RNA, 20 nt, Artificial Sequence
  B2M targeting sequence
accugcuuugguacuaguca

SEQ ID NO: 1937 - RNA, 20 nt, Artificial Sequence
  B2M targeting sequence
gucuuaaagaucacagcccu

SEQ ID NO: 1938 - RNA, 20 nt, Artificial Sequence
  B2M targeting sequence
uaaagaucacagcccugccc

SEQ ID NO: 1939 - RNA, 20 nt, Artificial Sequence
  B2M targeting sequence
uuaagacugagcccuagucc

SEQ ID NO: 1940 - RNA, 20 nt, Artificial Sequence
  B2M targeting sequence
cagcccugcccuggcuguuu

SEQ ID NO: 1941 - RNA, 20 nt, Artificial Sequence
  B2M targeting sequence
aaacagccagggcagggcug

SEQ ID NO: 1942 - RNA, 20 nt, Artificial Sequence
  B2M targeting sequence
cuugggaccuacuguuuuuu

SEQ ID NO: 1943 - RNA, 20 nt, Artificial Sequence
  B2M targeting sequence
caagugaaacuccaaacagc

SEQ ID NO: 1944 - RNA, 20 nt, Artificial Sequence
  B2M targeting sequence
uaaaaaacaguaggucccaa

SEQ ID NO: 1945 - RNA, 20 nt, Artificial Sequence
  B2M targeting sequence
ccuacccuuaucugaagucu

SEQ ID NO: 1946 - RNA, 20 nt, Artificial Sequence
  B2M targeting sequence
gaagucucauaugucuacug

SEQ ID NO: 1947 - RNA, 20 nt, Artificial Sequence
  B2M targeting sequence
gauaaggguaggggaccuuc

SEQ ID NO: 1948 - RNA, 20 nt, Artificial Sequence
  B2M targeting sequence
cauaugucuacugauccccu

SEQ ID NO: 1949 - RNA, 20 nt, Artificial Sequence
  B2M targeting sequence
uaugucuacugauccccuag

SEQ ID NO: 1950 - RNA, 20 nt, Artificial Sequence
  B2M targeting sequence
acugauccccuagauguucu

SEQ ID NO: 1951 - RNA, 20 nt, Artificial Sequence
  B2M targeting sequence
guagacauaugagacuucag

SEQ ID NO: 1952 - RNA, 20 nt, Artificial Sequence
  B2M targeting sequence
ccuagauguucuaacuuucc

SEQ ID NO: 1953 - RNA, 20 nt, Artificial Sequence
  B2M targeting sequence
aggggaucaguagacauaug

SEQ ID NO: 1954 - RNA, 20 nt, Artificial Sequence
  B2M targeting sequence
aacuuuccugccaucauuuc

SEQ ID NO: 1955 - RNA, 20 nt, Artificial Sequence
  B2M targeting sequence
ugccaucauuucauuauguu

SEQ ID NO: 1956 - RNA, 20 nt, Artificial Sequence
  B2M targeting sequence
uuucauuauguuaaguucaa

SEQ ID NO: 1957 - RNA, 20 nt, Artificial Sequence
  B2M targeting sequence
uuauguuaaguucaagccaa

SEQ ID NO: 1958 - RNA, 20 nt, Artificial Sequence
  B2M targeting sequence
agccaagccuauguuaggcu

SEQ ID NO: 1959 - RNA, 20 nt, Artificial Sequence
  B2M targeting sequence
cuguuuaccccaagccuaac

SEQ ID NO: 1960 - RNA, 20 nt, Artificial Sequence
  B2M targeting sequence
gcuuuauucacuguuuaccc

SEQ ID NO: 1961 - RNA, 20 nt, Artificial Sequence
  B2M targeting sequence
cacagccuguuagagcuucu

SEQ ID NO: 1962 - RNA, 20 nt, Artificial Sequence
  B2M targeting sequence
aacaggcugugggaagcauc

SEQ ID NO: 1963 - RNA, 20 nt, Artificial Sequence
  B2M targeting sequence
ucuagaauaagaaguacaca

SEQ ID NO: 1964 - RNA, 20 nt, Artificial Sequence
  B2M targeting sequence
agaauaagaaguacacacag

SEQ ID NO: 1965 - RNA, 20 nt, Artificial Sequence
  B2M targeting sequence
agaagaagcucuaacaggcu

SEQ ID NO: 1966 - RNA, 20 nt, Artificial Sequence
  B2M targeting sequence
uauucuagaagaagcucuaa

SEQ ID NO: 1967 - RNA, 20 nt, Artificial Sequence
  B2M targeting sequence
uguguaccuguguguacuuc

SEQ ID NO: 1968 - RNA, 20 nt, Artificial Sequence
  B2M targeting sequence
gauuuuaaaaagacauuaga

SEQ ID NO: 1969 - RNA, 20 nt, Artificial Sequence
  B2M targeting sequence
gacccaacaauccuguguac

SEQ ID NO: 1970 - RNA, 20 nt, Artificial Sequence
  B2M targeting sequence
uuuuaaaaucugacccaaca

SEQ ID NO: 1971 - RNA, 20 nt, Artificial Sequence
  B2M targeting sequence
aaugucuuuuuaaaaucuga

SEQ ID NO: 1972 - RNA, 20 nt, Artificial Sequence
  B2M targeting sequence
uaccuguaaucccagcacuu

SEQ ID NO: 1973 - RNA, 20 nt, Artificial Sequence
  B2M targeting sequence
cagcacuuugggaagcugag

SEQ ID NO: 1974 - RNA, 20 nt, Artificial Sequence
  B2M targeting sequence
caaagugcugggauuacagg

SEQ ID NO: 1975 - RNA, 20 nt, Artificial Sequence
  B2M targeting sequence
gcuucccaaagugcugggau

SEQ ID NO: 1976 - RNA, 20 nt, Artificial Sequence
  B2M targeting sequence
ugccucagcuucccaaagug

SEQ ID NO: 1977 - RNA, 20 nt, Artificial Sequence
  B2M targeting sequence
uccugccucagcuucccaaa

SEQ ID NO: 1978 - RNA, 20 nt, Artificial Sequence
  B2M targeting sequence
agcuauccuccugccucagc

SEQ ID NO: 1979 - RNA, 20 nt, Artificial Sequence
  B2M targeting sequence
ugggcucaagcuauccuccu

SEQ ID NO: 1980 - RNA, 20 nt, Artificial Sequence
  B2M targeting sequence
agacaagccuggacaacaua

SEQ ID NO: 1981 - RNA, 20 nt, Artificial Sequence
  B2M targeting sequence
ugaacucaugggcucaagcu

SEQ ID NO: 1982 - RNA, 20 nt, Artificial Sequence
  B2M targeting sequence
aggcuugucuugaacucaug

SEQ ID NO: 1983 - RNA, 20 nt, Artificial Sequence
  B2M targeting sequence
cuauguuguccaggcuuguc

SEQ ID NO: 1984 - RNA, 20 nt, Artificial Sequence
  B2M targeting sequence
cacuauguuguccaggcuug

SEQ ID NO: 1985 - RNA, 20 nt, Artificial Sequence
  B2M targeting sequence
cuauuaaaaauuuuuucuua

SEQ ID NO: 1986 - RNA, 20 nt, Artificial Sequence
  B2M targeting sequence
auuaaaaauuuuuucuuaaa

SEQ ID NO: 1987 - RNA, 20 nt, Artificial Sequence
  B2M targeting sequence
uaaagaaaaaaaaugacauu

SEQ ID NO: 1988 - RNA, 20 nt, Artificial Sequence
  B2M targeting sequence
uuaagaaaaaauuuuuaaua

SEQ ID NO: 1989 - RNA, 20 nt, Artificial Sequence
  B2M targeting sequence
uuuuuuuucuuuaagaaaaa

SEQ ID NO: 1990 - RNA, 20 nt, Artificial Sequence
  B2M targeting sequence
aaugucauuuuuuuucuuua

SEQ ID NO: 1991 - RNA, 20 nt, Artificial Sequence
  B2M targeting sequence
uuuauggggagauuuuuuau

SEQ ID NO: 1992 - RNA, 20 nt, Artificial Sequence
  B2M targeting sequence
ccauaaaagaguguuuuaug

SEQ ID NO: 1993 - RNA, 20 nt, Artificial Sequence
  B2M targeting sequence
ccccauaaaagaguguuuua

SEQ ID NO: 1994 - RNA, 20 nt, Artificial Sequence
  B2M targeting sequence
auuguuucagguucuuuaau

SEQ ID NO: 1995 - RNA, 20 nt, Artificial Sequence
  B2M targeting sequence
gguucuuuaauagcaguaga

SEQ ID NO: 1996 - RNA, 20 nt, Artificial Sequence
  B2M targeting sequence
uuaauagcaguagaucuagu

SEQ ID NO: 1997 - RNA, 20 nt, Artificial Sequence
  B2M targeting sequence
acugcuauuaaagaaccuga

SEQ ID NO: 1998 - RNA, 20 nt, Artificial Sequence
  B2M targeting sequence
agucuggcuuucaauuucuu

SEQ ID NO: 1999 - RNA, 20 nt, Artificial Sequence
  B2M targeting sequence
ggcuuucaauuucuucuuga

SEQ ID NO: 2000 - RNA, 20 nt, Artificial Sequence
  B2M targeting sequence
auuucuucuugaguuuuaag

SEQ ID NO: 2001 - RNA, 20 nt, Artificial Sequence
  B2M targeting sequence
ucuugaguuuuaaguuauau

SEQ ID NO: 2002 - RNA, 20 nt, Artificial Sequence
  B2M targeting sequence
ugaguuuuaaguuauauauc

SEQ ID NO: 2003 - RNA, 20 nt, Artificial Sequence
  B2M targeting sequence
agaagaaauugaaagccaga

SEQ ID NO: 2004 - RNA, 20 nt, Artificial Sequence
  B2M targeting sequence
ucuaggaauuuguccauuac

SEQ ID NO: 2005 - RNA, 20 nt, Artificial Sequence
  B2M targeting sequence
aggaauuuguccauuacuua

SEQ ID NO: 2006 - RNA, 20 nt, Artificial Sequence
  B2M targeting sequence
uagaagauauauaacuuaaa

SEQ ID NO: 2007 - RNA, 20 nt, Artificial Sequence
  B2M targeting sequence
auuacuuauaaauuuucaaa

SEQ ID NO: 2008 - RNA, 20 nt, Artificial Sequence
  B2M targeting sequence
aauuuguuggcauaaaguug

SEQ ID NO: 2009 - RNA, 20 nt, Artificial Sequence
  B2M targeting sequence
uaguauaaguguauuuaaaa

SEQ ID NO: 2010 - RNA, 20 nt, Artificial Sequence
  B2M targeting sequence
augcuauaacuguacuuugu

SEQ ID NO: 2011 - RNA, 20 nt, Artificial Sequence
  B2M targeting sequence
cuccugcccccuuucauuua

SEQ ID NO: 2012 - RNA, 20 nt, Artificial Sequence
  B2M targeting sequence
ccugcccccuuucauuuacu

SEQ ID NO: 2013 - RNA, 20 nt, Artificial Sequence
  B2M targeting sequence
ugcccccuuucauuuacuug

SEQ ID NO: 2014 - RNA, 20 nt, Artificial Sequence
  B2M targeting sequence
uuuacuuguuuauuuugaga

SEQ ID NO: 2015 - RNA, 20 nt, Artificial Sequence
  B2M targeting sequence
aaauaaacaaguaaaugaaa

SEQ ID NO: 2016 - RNA, 20 nt, Artificial Sequence
  B2M targeting sequence
caaaauaaacaaguaaauga

SEQ ID NO: 2017 - RNA, 20 nt, Artificial Sequence
  B2M targeting sequence
gucucaaaauaaacaaguaa

SEQ ID NO: 2018 - RNA, 20 nt, Artificial Sequence
  B2M targeting sequence
ugccugucacucaggcugga

SEQ ID NO: 2019 - RNA, 20 nt, Artificial Sequence
  B2M targeting sequence
cucaggcuggagugcauugg

SEQ ID NO: 2020 - RNA, 20 nt, Artificial Sequence
  B2M targeting sequence
ggcuggagugcauuggcacg

SEQ ID NO: 2021 - RNA, 20 nt, Artificial Sequence
  B2M targeting sequence
agccugagugacaggcaaga

SEQ ID NO: 2022 - RNA, 20 nt, Artificial Sequence
  B2M targeting sequence
ugccaaugcacuccagccug

SEQ ID NO: 2023 - RNA, 20 nt, Artificial Sequence
  B2M targeting sequence
caacucacugcaaccuccac

SEQ ID NO: 2024 - RNA, 20 nt, Artificial Sequence
  B2M targeting sequence
acucacugcaaccuccaccu

SEQ ID NO: 2025 - RNA, 20 nt, Artificial Sequence
  B2M targeting sequence
cugcaaccuccaccuccugu

SEQ ID NO: 2026 - RNA, 20 nt, Artificial Sequence
  B2M targeting sequence
accuccuguguucaagcaau

SEQ ID NO: 2027 - RNA, 20 nt, Artificial Sequence
  B2M targeting sequence
uguguucaagcaauucuccu

SEQ ID NO: 2028 - RNA, 20 nt, Artificial Sequence
  B2M targeting sequence
agcaauucuccugccucagc

SEQ ID NO: 2029 - RNA, 20 nt, Artificial Sequence
  B2M targeting sequence
ccugccucagccuccagagu

SEQ ID NO: 2030 - RNA, 20 nt, Artificial Sequence
  B2M targeting sequence
ugccucagccuccagaguag

SEQ ID NO: 2031 - RNA, 20 nt, Artificial Sequence
  B2M targeting sequence
gccuccagaguagcugagaa

SEQ ID NO: 2032 - RNA, 20 nt, Artificial Sequence
  B2M targeting sequence
agaguagcugagaauacagg

SEQ ID NO: 2033 - RNA, 20 nt, Artificial Sequence
  B2M targeting sequence
ggaggcugaggcaggagaau

SEQ ID NO: 2034 - RNA, 20 nt, Artificial Sequence
  B2M targeting sequence
gcuacucuggaggcugaggc

SEQ ID NO: 2035 - RNA, 20 nt, Artificial Sequence
  B2M targeting sequence
cagcuacucuggaggcugag

SEQ ID NO: 2036 - RNA, 20 nt, Artificial Sequence
  B2M targeting sequence
aaaaaaaaaaaaaauuaauu

SEQ ID NO: 2037 - RNA, 20 nt, Artificial Sequence
  B2M targeting sequence
caaaaaaaaaaaaaaauuaa

SEQ ID NO: 2038 - RNA, 20 nt, Artificial Sequence
  B2M targeting sequence
gucucaaaaaaaaaaaaaaa

SEQ ID NO: 2039 - RNA, 20 nt, Artificial Sequence
  B2M targeting sequence
ugcucugucagccaggcugg

SEQ ID NO: 2040 - RNA, 20 nt, Artificial Sequence
  B2M targeting sequence
gucagccaggcuggagugca

SEQ ID NO: 2041 - RNA, 20 nt, Artificial Sequence
  B2M targeting sequence
gccaggcuggagugcagugg

SEQ ID NO: 2042 - RNA, 20 nt, Artificial Sequence
  B2M targeting sequence
agccuggcugacagagcaag

SEQ ID NO: 2043 - RNA, 20 nt, Artificial Sequence
  B2M targeting sequence
cggcucacugcaaccucugc

SEQ ID NO: 2044 - RNA, 20 nt, Artificial Sequence
  B2M targeting sequence
gcucacugcaaccucugccu

SEQ ID NO: 2045 - RNA, 20 nt, Artificial Sequence
  B2M targeting sequence
cugcaaccucugccuccugg

SEQ ID NO: 2046 - RNA, 20 nt, Artificial Sequence
  B2M targeting sequence
gccuccugggaucaagcaau

SEQ ID NO: 2047 - RNA, 20 nt, Artificial Sequence
  B2M targeting sequence
ugggaucaagcaauuguccu

SEQ ID NO: 2048 - RNA, 20 nt, Artificial Sequence
  B2M targeting sequence
caggaggcagagguugcagu

SEQ ID NO: 2049 - RNA, 20 nt, Artificial Sequence
  B2M targeting sequence
agcaauuguccugccucagc

SEQ ID NO: 2050 - RNA, 20 nt, Artificial Sequence
  B2M targeting sequence
ugccucagccuccugaauag

SEQ ID NO: 2051 - RNA, 20 nt, Artificial Sequence
  B2M targeting sequence
gccuccugaauagcugggau

SEQ ID NO: 2052 - RNA, 20 nt, Artificial Sequence
  B2M targeting sequence
ugaauagcugggauuacagg

SEQ ID NO: 2053 - RNA, 20 nt, Artificial Sequence
  B2M targeting sequence
ggaggcugaggcaggacaau

SEQ ID NO: 2054 - RNA, 20 nt, Artificial Sequence
  B2M targeting sequence
cagcuauucaggaggcugag

SEQ ID NO: 2055 - RNA, 20 nt, Artificial Sequence
  B2M targeting sequence
auacuaaaaauacaaaaauu

SEQ ID NO: 2056 - RNA, 20 nt, Artificial Sequence
  B2M targeting sequence
ccauguuggccagucugguc

SEQ ID NO: 2057 - RNA, 20 nt, Artificial Sequence
  B2M targeting sequence
ggucuugaacuccugaccuc

SEQ ID NO: 2058 - RNA, 20 nt, Artificial Sequence
  B2M targeting sequence
ugaacuccugaccucagcua

SEQ ID NO: 2059 - RNA, 20 nt, Artificial Sequence
  B2M targeting sequence
agaccagacuggccaacaug

SEQ ID NO: 2060 - RNA, 20 nt, Artificial Sequence
  B2M targeting sequence
ugaccucagcuaauccacuu

SEQ ID NO: 2061 - RNA, 20 nt, Artificial Sequence
  B2M targeting sequence
ggaguucaagaccagacugg

SEQ ID NO: 2062 - RNA, 20 nt, Artificial Sequence
  B2M targeting sequence
gcuaauccacuuaccucggc

SEQ ID NO: 2063 - RNA, 20 nt, Artificial Sequence
  B2M targeting sequence
acuuaccucggccucccaaa

SEQ ID NO: 2064 - RNA, 20 nt, Artificial Sequence
  B2M targeting sequence
gccucccaaagugcugggau

SEQ ID NO: 2065 - RNA, 20 nt, Artificial Sequence
  B2M targeting sequence
caaagugcugggauuacagg

SEQ ID NO: 2066 - RNA, 20 nt, Artificial Sequence
  B2M targeting sequence
cagcacuuugggaggccgag

SEQ ID NO: 2067 - RNA, 20 nt, Artificial Sequence
  B2M targeting sequence
cgccuguaaucccagcacuu

SEQ ID NO: 2068 - RNA, 20 nt, Artificial Sequence
  B2M targeting sequence
uuuucuuuuucuuuuuuuuu

SEQ ID NO: 2069 - RNA, 20 nt, Artificial Sequence
  B2M targeting sequence
uuuucuuuuuuuuuuuuuuu

SEQ ID NO: 2070 - RNA, 20 nt, Artificial Sequence
  B2M targeting sequence
uuuuuuuuuuuuuuuuuuua

SEQ ID NO: 2071 - RNA, 20 nt, Artificial Sequence
  B2M targeting sequence
acuaaaaaaaaaaaaaaaaa

SEQ ID NO: 2072 - RNA, 20 nt, Artificial Sequence
  B2M targeting sequence
cuacuaaaaaaaaaaaaaaa

SEQ ID NO: 2073 - RNA, 20 nt, Artificial Sequence
  B2M targeting sequence
caaacuccuggcuucaagug

SEQ ID NO: 2074 - RNA, 20 nt, Artificial Sequence
  B2M targeting sequence
aacuccuggcuucaagugau

SEQ ID NO: 2075 - RNA, 20 nt, Artificial Sequence
  B2M targeting sequence
uggcuucaagugauccaccu

SEQ ID NO: 2076 - RNA, 20 nt, Artificial Sequence
  B2M targeting sequence
agugauccaccugccucggc

SEQ ID NO: 2077 - RNA, 20 nt, Artificial Sequence
  B2M targeting sequence
cuugaagccaggaguuugag

SEQ ID NO: 2078 - RNA, 20 nt, Artificial Sequence
  B2M targeting sequence
accugccucggccuccagag

SEQ ID NO: 2079 - RNA, 20 nt, Artificial Sequence
  B2M targeting sequence
gccuccagagugcuaggauu

SEQ ID NO: 2080 - RNA, 20 nt, Artificial Sequence
  B2M targeting sequence
agagugcuaggauuacaggc

SEQ ID NO: 2081 - RNA, 20 nt, Artificial Sequence
  B2M targeting sequence
ggaggccgaggcagguggau

SEQ ID NO: 2082 - RNA, 20 nt, Artificial Sequence
  B2M targeting sequence
uagcacucuggaggccgagg

SEQ ID NO: 2083 - RNA, 20 nt, Artificial Sequence
  B2M targeting sequence
cgccuguaauccuagcacuc

SEQ ID NO: 2084 - RNA, 20 nt, Artificial Sequence
  B2M targeting sequence
ggcccuuugucucccuuuuu

SEQ ID NO: 2085 - RNA, 20 nt, Artificial Sequence
  B2M targeting sequence
cccuuuuuauuccuaauauu

SEQ ID NO: 2086 - RNA, 20 nt, Artificial Sequence
  B2M targeting sequence
cuuuuuauuccuaauauuau

SEQ ID NO: 2087 - RNA, 20 nt, Artificial Sequence
  B2M targeting sequence
uaauauuauucaucuccucc

SEQ ID NO: 2088 - RNA, 20 nt, Artificial Sequence
  B2M targeting sequence
ucuccuccuuuguucuucuu

SEQ ID NO: 2089 - RNA, 20 nt, Artificial Sequence
  B2M targeting sequence
ccuccuuuguucuucuuucu

SEQ ID NO: 2090 - RNA, 20 nt, Artificial Sequence
  B2M targeting sequence
uccuuuguucuucuuucuag

SEQ ID NO: 2091 - RNA, 20 nt, Artificial Sequence
  B2M targeting sequence
uuuguucuucuuucuagagu

SEQ ID NO: 2092 - RNA, 20 nt, Artificial Sequence
  B2M targeting sequence
ucuuucuagaguuugucuau

SEQ ID NO: 2093 - RNA, 20 nt, Artificial Sequence
  B2M targeting sequence
uucuagaguuugucuauuuu

SEQ ID NO: 2094 - RNA, 20 nt, Artificial Sequence
  B2M targeting sequence
agaguuugucuauuuuauua

SEQ ID NO: 2095 - RNA, 20 nt, Artificial Sequence
  B2M targeting sequence
agaaagaagaacaaaggagg

SEQ ID NO: 2096 - RNA, 20 nt, Artificial Sequence
  B2M targeting sequence
auuuuauuagucuuuuuaaa

SEQ ID NO: 2097 - RNA, 20 nt, Artificial Sequence
  B2M targeting sequence
uuuuaaagaaccauguaugu

SEQ ID NO: 2098 - RNA, 20 nt, Artificial Sequence
  B2M targeting sequence
uuaaaaagacuaauaaaaua

SEQ ID NO: 2099 - RNA, 20 nt, Artificial Sequence
  B2M targeting sequence
gguuuccuucaggaaauaga

SEQ ID NO: 2100 - RNA, 20 nt, Artificial Sequence
  B2M targeting sequence
uucaggaaauagauggugua

SEQ ID NO: 2101 - RNA, 108 nt, Artificial Sequence
  gNA Variant Scaffold
uacuggcgcuuuuaucucauuacuuugagagccaucaccagcgacuaugucguauggguaaagcgcaggugggacgaccucucggucguccuaucugaagcaucaaag

SEQ ID NO: 2102 - RNA, 99 nt, Artificial Sequence
  gNA Variant Scaffold
uacuggcgcuuuuaucucauuacuuugagagccaucaccagcgacuaugucguauggguaaagcgcugcucgacgcguccucgagcagaagcaucaaag

SEQ ID NO: 2103 - RNA, 97 nt, Artificial Sequence
  gNA Variant Scaffold
uacuggcgcuuuuaucucauuacuuugagagccaucaccagcgacuaugucguauggguaaagcgcugcucgcuccguucgagcagaagcaucaaag

SEQ ID NO: 2104 - RNA, 91 nt, Artificial Sequence
  gNA Variant Scaffold
guacuggcgcuuuuaucucauuacuuugagagccaucaccagcgacuaugucguauggguaaagcgcccucuucggagggaagcaucaaag

SEQ ID NO: 2105 - RNA, 99 nt, Artificial Sequence
  gNA Variant Scaffold
uacuggcgcuuuuaucucauuacuuugagagccaucaccagcgacuaugucguauggguaaagcgcaggaguuucuauggaaacccugaagcaucaaag

SEQ ID NO: 2106 - RNA, 99 nt, Artificial Sequence
  gNA Variant Scaffold
guacuggcgccuuuaucucauuacuuugagagccaucaccagcgacuaugucguauggguaaagcgcuuacggacuucgguccguaagaagcaucaaag

SEQ ID NO: 2107 - RNA, 90 nt, Artificial Sequence
  gNA Variant Scaffold
uacuggcgcuuuuaucucauuacuuugagagccaucaccagcgacuaugucguauggguaaagcgcugcgcuugcgcagaagcaucaaag

SEQ ID NO: 2108 - RNA, 108 nt, Artificial Sequence
  gNA Variant Scaffold
uacuggcgcuuuuaucugauuacuuugagagccaucaccagcgacuaugucguauggguaaagcgcuuauuuaucggagagaaauccgauaaauaagaagcaucaaag

SEQ ID NO: 2109 - RNA, 108 nt, Artificial Sequence
  gNA Variant Scaffold
uacuggcgcuuuuaucgcauuacuuugagagccaucaccagcgacuaugucguauggguaaagcgcuuauuuaucggagagaaauccgauaaauaagaagcaucaaag

SEQ ID NO: 2110 - RNA, 110 nt, Artificial Sequence
  gNA Variant Scaffold
uacuggcgcuuuuaucucauuacuuugagagccaucaccagcgacuaugucguauggguaaagcgcuuauuuaucggagacuucgguccgauaaauaagaagcaucaaag

SEQ ID NO: 2111 - RNA, 97 nt, Artificial Sequence
  gNA Variant Scaffold
uacuggcgcuuuuaucucauuacuuugagagccaucaccagcgacuaugucguauggguaaagcgcacaugaggauuacccaugugaagcaucaaag

SEQ ID NO: 2112 - RNA, 106 nt, Artificial Sequence
  gNA Variant Scaffold
gcuggcgcuuuuaucucauuacuuugagagccaucaccagcgacuaugucguauggguaaagcgcuuauuuaucgugagaaauccgauaaauaagaagcaucaaag

SEQ ID NO: 2113 - RNA, 96 nt, Artificial Sequence
  gNA Variant Scaffold
uacuggcgcuuuuaucucauuacuuugagagccaucaccagcgacuaugucguauggguaaagcgcugcaugucuaagacagcagaagcaucaaag

SEQ ID NO: 2114 - RNA, 90 nt, Artificial Sequence
  gNA Variant Scaffold
uacuggcgcuuuuaucucauuacuuugagagccaucaccagcgacuaugucguauggguaaagcgcagggcuucggccgaagcaucaaag

SEQ ID NO: 2115 - RNA, 98 nt, Artificial Sequence
  gNA Variant Scaffold
uacuggcgcuuuuaucucauuacuuugagagccaucaccagcgacuaugucguauggguaaagcgcaauccauugcacuccggauugaagcaucaaag

SEQ ID NO: 2116 - RNA, 108 nt, Artificial Sequence
  gNA Variant Scaffold
uacuggcgcuuuucucgcauuacuuugagagccaucaccagcgacuaugucguauggguaaagcgcuuauuuaucggagagaaauccgauaaauaagaagcaucaaag

SEQ ID NO: 2117 - RNA, 108 nt, Artificial Sequence
  gNA Variant Scaffold
uacuggcgcuuuuaucucauuacuuugagagccaucaccagcgacuaugucguauggguaaagcgcuuauuuaucggacuucgguccgauaaauaagaagcaucaaag

SEQ ID NO: 2118 - RNA, 100 nt, Artificial Sequence
  gNA Variant Scaffold
uacuggcgcuuuuaucucauuacuuugagagccaucaccagcgacuaugucguauggguaaagcgcugcucguuugcggcuacgagcagaagcaucaaag

SEQ ID NO: 2119 - RNA, 100 nt, Artificial Sequence
  gNA Variant Scaffold
uacuggcgcuuuuaucucauuacuuugagagccaucaccagcgacuaugucguauggguaaagcgcuuauuuaucgagagauaaauaagaagcaucaaag

SEQ ID NO: 2120 - RNA, 107 nt, Artificial Sequence
  gNA Variant Scaffold
uacggcgcuuuuaucucauuacuuugagagccaucaccagcgacuaugucguauggguaaagcgcuuauuuaucggagagaaauccgauaaauaagaagcaucaaag

SEQ ID NO: 2121 - RNA, 99 nt, Artificial Sequence
  gNA Variant Scaffold
uacuggcgccuuuuaucucauuacuuugagagccaucaccagcgacuaugucguauggguaaagcgcuuacggacuucgguccguaagaagcaucaaag

SEQ ID NO: 2122 - RNA, 108 nt, Artificial Sequence
  gNA Variant Scaffold
uacuggcgcuuuuaucucauuacuuugagagccaucaccagcgacuaugucguaucgguaaagcgcuuauuuaucggagagaaauccgauaaauaagaagcaucaaag

SEQ ID NO: 2123 - RNA, 108 nt, Artificial Sequence
  gNA Variant Scaffold
uacuggcgccuuuaucucauuacuuugagagccaucaccagcgacuaugucguauggguaaagcgcuuauuuaucggacuucgguccgauaaauaagaagcaucaaag

SEQ ID NO: 2124 - RNA, 105 nt, Artificial Sequence
  gNA Variant Scaffold
uacuggcgcuuuuaucucauuacuuugagagccaucaccagcgacuaugucguauggguaaagcgcuuauuuaucgagaaauccgauaaauaagaagcaucaaag

SEQ ID NO: 2125 - RNA, 103 nt, Artificial Sequence
  gNA Variant Scaffold
gcgcuuuuaucucauuacuuugagagccaucaccagcgacuaugucguauggguaaagcgcuuauuuaucggagagaaauccgauaaauaagaagcaucaaag

SEQ ID NO: 2126 - RNA, 103 nt, Artificial Sequence
  gNA Variant Scaffold
uacuggcgcuuuuaucucauuacuuugagagccaucaccagcgacuaugucguauggguaaagcgcuuauuuaucggagagagauaaauaagaagcaucaaag

SEQ ID NO: 2127 - RNA, 108 nt, Artificial Sequence
  gNA Variant Scaffold
uacuggcgcuuuuaucucauuacuuuggagagccaucaccagcgacuaugucguauggguaaagcgcuuauuuaucggagaguauccgauaaauaagaagcaucaaag

SEQ ID NO: 2128 - RNA, 109 nt, Artificial Sequence
  gNA Variant Scaffold
uacuggcgcuuuuaucucauuacuuugagagccaucaccagcgacuauguucguauggguaaagcgcuuauuuaucggagagaaauccgauaaauaagaagcaucaaag

SEQ ID NO: 2129 - RNA, 105 nt, Artificial Sequence
  gNA Variant Scaffold
agcgcuuuuaucucauuacuuugagagccaucaccagcgacuaugucguauggguaaagcgcuuauuuaucggagagaaaugccgauaaauaagaagcaucaaag

SEQ ID NO: 2130 - RNA, 109 nt, Artificial Sequence
  gNA Variant Scaffold
uacuggcgcuuuuaucucauuacuuugagagccaucaccagcgacuaugucguauggguaaagcgcuuauuuaucggagagaaauccgauaaaauaagaagcaucaaag

SEQ ID NO: 2131 - RNA, 109 nt, Artificial Sequence
  gNA Variant Scaffold
uacuggcgcuuuuaucucauuacuuugagagccaucaccagcgacuaugucguauggguaaagcgcuuauuguaucggagagaaauccgauaaauaagaagcaucaaag

SEQ ID NO: 2132 - RNA, 102 nt, Artificial Sequence
  gNA Variant Scaffold
gcgcuuuuaucucauuacuuugagagccaucaccagcgacuaugucguauggguaaagcgcuuauuuaucggacuucgguccgauaaauaagcgcaucaaag

SEQ ID NO: 2133 - RNA, 108 nt, Artificial Sequence
  gNA Variant Scaffold
uacuggcgcuuuucucucauuacuuugagagccaucaccagcgacuaugucguauggguaaagcgcuuauuuaucggagagaaauccgauaaauaagaagcaucaaag

SEQ ID NO: 2134 - RNA, 106 nt, Artificial Sequence
  gNA Variant Scaffold
guggcgcuuuuaucucauuacuuugagagccaucaccagcgacuaugucguauggguaaagcgcuuauuuaucggagagaaauccgauaaauaagaagcaucaaag

SEQ ID NO: 2135 - RNA, 110 nt, Artificial Sequence
  gNA Variant Scaffold
uacuggcgcuuuuaucucauuacuuugagagccaucaccagcgaccuuaugucguauggguaaagcgcuuauuuaucggagagaaauccgauaaauaagaagcaucaaag

SEQ ID NO: 2136 - RNA, 107 nt, Artificial Sequence
  gNA Variant Scaffold
gauggcgcuuuuaucucauuacuuugagagccaucaccagcgacuaugucguauggguaaagcgcuuauuuaucggacuucgguccgauaaauaagaagcaucaaag

SEQ ID NO: 2137 - RNA, 106 nt, Artificial Sequence
  gNA Variant Scaffold
uacuggcgcuuuuaucucauuacuuugagagccaucaccagcgacuaugucguauggguaaagcgcuuauuuaucggagagaaauccgauaaaagaagcaucaaag

SEQ ID NO: 2138 - RNA, 109 nt, Artificial Sequence
  gNA Variant Scaffold
uacuggcgcuuuuaucucauuacuuugagagccaucaccagcgaucuaugucguauggguaaagcgcuuauuuaucggagagaaauccgauaaauaagaagcaucaaag

SEQ ID NO: 2139 - RNA, 106 nt, Artificial Sequence
  gNA Variant Scaffold
uacuggcgcuuuuaucucauuacuuugagagccaucaccagcgacuaugucguauggguaaaggcuuauuuaucggagagaaauccgauaaaaagaagcaucaaag

SEQ ID NO: 2140 - RNA, 107 nt, Artificial Sequence
  gNA Variant Scaffold
uacuggcgcuuuuaucucauuacuuugagagccaucaccagcgacuaugucguauggguaaagcgcuuauuuaucggagagaaauccgauaaaaagaagcaucaaag

SEQ ID NO: 2141 - RNA, 107 nt, Artificial Sequence
  gNA Variant Scaffold
uacuggcgcuuuaucucauuacuuugagagccaucaccagcgacuaugucguauggguaaagcgcuuauuuaucggacuucgguccgauaaauaagaagcaucaaag

SEQ ID NO: 2142 - RNA, 98 nt, Artificial Sequence
  gNA Variant Scaffold
cggcgcuuuucucgcauuacuuugagagccaucaccagcgacuaugucguauggguaaagcgcuuauuguaucgagagauaaauaagaagcaucaaag

SEQ ID NO: 2143 - RNA, 107 nt, Artificial Sequence
  gNA Variant Scaffold
cacuggcgcuuuuaucucauuacuuugagagccaucaccagcgacuaugucguauggguaaagcgcuuauuuucggagagaaauccgauaaauaagaagcaucaaag

SEQ ID NO: 2144 - RNA, 106 nt, Artificial Sequence
  gNA Variant Scaffold
uacuggcgcuuuaucucauuacuuugagagccaucaccagcgacuucggucguauggguaaagcgcuuauguaucggcuucggccgauacauaagaagcaucaaag

SEQ ID NO: 2145 - RNA, 107 nt, Artificial Sequence
  gNA Variant Scaffold
uacuggcgcuuuuaucucauuacuuugagagccaucaccagcgacuucggucguauggguaaagcgcuuauguaucggcuucggccgauacauaagaagcaucaaag

SEQ ID NO: 2146 - RNA, 109 nt, Artificial Sequence
  gNA Variant Scaffold
uacuggcgcuuuuaucucauuacuuugagagccaucaccagcgacuaugucguaugggugaaagcgcuuauuuaucggagagaaauccgauaaauaagaagcaucaaag

SEQ ID NO: 2147 - RNA, 64 nt, Artificial Sequence
  gNA Variant Scaffold
uacuggcgcuuuuaucucauuacuuugagagccaucaccagcgacuucggucguauggguaaag

SEQ ID NO: 2148 - RNA, 62 nt, Artificial Sequence
  gNA Variant Scaffold
gaugggcuuuuaucucauuacuuugagagccaucaccagcgacuucggucguauggguaaag

SEQ ID NO: 2149 - RNA, 105 nt, Artificial Sequence
  gNA Variant Scaffold
gaugggcuuuuaucucauuacuuugagagccaucaccagcgacuucggucguauggguaaagcgcuuauuuaucggcuucggccgauaaauaagaagcaucaaag

SEQ ID NO: 2150 - RNA, 156 nt, Artificial Sequence
  gNA Variant Scaffold
uacuggcgcuuuuaucucauuacuuugagagccaucaccagcgacuaugucguauggguaaagcgcuacacugggaucgcugaauuagagaucggcguccuuucauucuauauacuuuggaguuuuaaaaugucucuaaguacagaagcaucaaag

SEQ ID NO: 2151 - RNA, 103 nt, Artificial Sequence
  gNA Variant Scaffold
ggcgcuuuuaucucauuacuuugagagccaucaccagcgacuucggucguauggguaaagcgcuuauuuaucggcuucggccgauaaauaagaagcaucaaag

SEQ ID NO: 2152 - RNA, 106 nt, Artificial Sequence
  gNA Variant Scaffold
gcuggcgcuuuuaucucauuacuuugagagccaucaccagcgacuucggucguauggguaaagcgcuuauuuaucggcuucggccgauaaauaagaagcaucaaag

SEQ ID NO: 2153 - RNA, 109 nt, Artificial Sequence
  gNA Variant Scaffold
uacuggcgcuuuuaucucauuacuuugagagccaucaccagcgacuucggucguauggguaaagcgcuuauuuaucggagagaaauccgauaaauaagaagcaucaaag

SEQ ID NO: 2154 - RNA, 112 nt, Artificial Sequence
  gNA Variant Scaffold
uacuggcgcuuuuaucucauuacuuugagagccaugcuccaccagcgacuaugucguauggguaaagcgcuuauuuaucggagagaaauccgauaaauaagaagcaucaaag

SEQ ID NO: 2155 - RNA, 97 nt, Artificial Sequence
  gNA Variant Scaffold
uacuggcgcuuuuaucucauuacuuugagagccaucaccagcgacuaugucguauggguaaagcgggguuaggguuaggguuagggaagcaucaaag

SEQ ID NO: 2156 - RNA, 96 nt, Artificial Sequence
  gNA Variant Scaffold
uacuggcgcuuuuaucucauuacuuugagagccaucaccagcgacuaugucguauggguaaagcggagggagggagggagagggaaagcaucaaag

SEQ ID NO: 2157 - RNA, 101 nt, Artificial Sequence
  gNA Variant Scaffold
uacuggcgcuuuuaucucauuacuuugagagccaucaccagcgacuaugucguauggguaaagcguuggguuaggguuaggguuagggaaaagcaucaaag

SEQ ID NO: 2158 - RNA, 91 nt, Artificial Sequence
  gNA Variant Scaffold
uacuggcgcuuuuaucucauuacuuugagagccaucaccagcgacuaugucguauggguaaagcgcagggcuucggccggaagcaucaaag

SEQ ID NO: 2159 - RNA, 103 nt, Artificial Sequence
  gNA Variant Scaffold
uacuggcgcuuuuaucucauuacuuugagagccaucaccagcgacuaugucguauggguaaagcgccugcucaguacgagaggaaccgcaggaagcaucaaag

SEQ ID NO: 2160 - RNA, 90 nt, Artificial Sequence
  gNA Variant Scaffold
uacuggcgcuuuuaucugauuacuuugagagccaucaccagcgacuaugucguauggguaaagcgcccucuucggagggaagcaucaaag

SEQ ID NO: 2161 - RNA, 98 nt, Artificial Sequence
  gNA Variant Scaffold
uacuggcgccuuuaucugauuacuuugagagccaucaccagcgacuaugucguauggguaaagcgcuuacggacuucgguccguaagaagcaucaaag

SEQ ID NO: 2162 - RNA, 98 nt, Artificial Sequence
  gNA Variant Scaffold
uacuggcgcuuuuaucugauuacuuugagagccaucaccagcgacuaugucguauggguaaagcgcggacgaccucucggucguccgaagcaucaaag

SEQ ID NO: 2163 - RNA, 108 nt, Artificial Sequence
  gNA Variant Scaffold
uacuggcgcuuuuaucugauuacuuugagagccaucaccagcgacuaugucguauggguaaagcgcaggugggacgaccucucggucguccuaucugaagcaucaaag

SEQ ID NO: 2164 - RNA, 99 nt, Artificial Sequence
  gNA Variant Scaffold
uacuggcgccuuuaucugcauuacuuugagagccaucaccagcgacuaugucguauggguaaagcgcuuacggacuucgguccguaagaagcaucaaag

SEQ ID NO: 2165 - RNA, 97 nt, Artificial Sequence
  gNA Variant Scaffold
gcuggcgcuuuuaucugauuacuuugagagccaucaccagcgacuaugucguauggguaaagcgcuuacggacuucgguccguaagaagcaucaaag

SEQ ID NO: 2166 - RNA, 108 nt, Artificial Sequence
  gNA Variant Scaffold
uacuggcgccuuuaucugauuacuuugagagccaucaccagcgacuaugucguauggguaaagcgcaggugggacgaccucucggucguccuaucugaagcaucaaag

SEQ ID NO: 2167 - RNA, 98 nt, Artificial Sequence
  gNA Variant Scaffold
uacuggcgccuuuaucugauuacuuugagagccaucaccagcgacuaugucguauggguaaagcgcggacgaccucucggucguccgaagcaucaaag

SEQ ID NO: 2168 - RNA, 90 nt, Artificial Sequence
  gNA Variant Scaffold
uacuggcgccuuuaucucauuacuuugagagccaucaccagcgacuaugucguauggguaaagcgcccucuucggagggaagcaucaaag

SEQ ID NO: 2169 - RNA, 98 nt, Artificial Sequence
  gNA Variant Scaffold
uacuggcgcuuuuaucucauuacuuugagagccaucaccagcgacuaugucguauggguaaagcgcuuacggacuucgguccguaagaagcaucaaag

SEQ ID NO: 2170 - RNA, 99 nt, Artificial Sequence
  gNA Variant Scaffold
uacuggcgccuuuaucaucauuacuuugagagccaucaccagcgacuaugucguauggguaaagcgcuuacggacuucgguccguaagaagcaucaaag

SEQ ID NO: 2171 - RNA, 194 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagggccggcauggucccagccuccucgcuggcgccggcugggcaacauuccgaggggaccguccccucgguaauggcgaaugggaccc

SEQ ID NO: 2172 - RNA, 108 nt, Artificial Sequence
  gNA Variant Scaffold
uacuggcgccuuuaucucauuacuuugagagccaucaccagcgacuaugucguauggguaaagcgcaggugggacgaccucucggucguccuaucugaagcaucaaag

SEQ ID NO: 2173 - RNA, 106 nt, Artificial Sequence
  gNA Variant Scaffold
uacuggcgcuuuuaucucauuacuuugagagccaucaccagcgacuaugucguauggguaaagcgcuuauuuaucggagaaauccgauaaauaagaagcaucaaag

SEQ ID NO: 2174 - RNA, 98 nt, Artificial Sequence
  gNA Variant Scaffold
uacuggcgccuuuaucucauuacuuugagagccaucaccagcgacuaugucguauggguaaagcgcggacgaccucucggucguccgaagcaucaaag

SEQ ID NO: 2175 - RNA, 92 nt, Artificial Sequence
  gNA Variant Scaffold
uacuggcgcuuuuaucucauuacuuugagagccaucaccagcgacuaugucguauggguaaagcgccggacuucgguccggaagcaucaaag

SEQ ID NO: 2176 - RNA, 108 nt, Artificial Sequence
  gNA Variant Scaffold
uacuggcgcuuuuaucggauuacuuugagagccaucaccagcgacuaugucguauggguaaagcgcuuauuuaucggagagaaauccgauaaauaagaagcaucaaag

SEQ ID NO: 2177 - RNA, 98 nt, Artificial Sequence
  gNA Variant Scaffold
uacuggcgcuuuuaucucauuacuuugagagccaucaccagcgacuaugucguauggguaaagcgcggacgaccucucggucguccgaagcaucaaag

SEQ ID NO: 2178 - RNA, 89 nt, Artificial Sequence
  gNA Variant Scaffold
gcuggcgcuuuuaucugauuacuuugagagccaucaccagcgacuaugucguauggguaaagcgcccucuucggagggaagcaucaaag

SEQ ID NO: 2179 - RNA, 88 nt, Artificial Sequence
  gNA Variant Scaffold
gcuggcgccuuuaucugauuacuuugagagccaucaccagcgacuaugucguauggguaaagcucccucuucggagggagcaucaaag

SEQ ID NO: 2180 - RNA, 197 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaaggggucggcauggcaucuccaccuccucgcgguccgaccugggcauccgaaggaggacgcacguccacucggauggcuaagggagagcca

SEQ ID NO: 2181 - RNA, 88 nt, Artificial Sequence
  gNA Variant Scaffold
gcuggcgccuuuaucugauuacuuugagagccaucaccagcgacuaugucguauggguaaagcgcccucuucggagggcgcaucaaag

SEQ ID NO: 2182 - RNA, 186 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaaguuuuggccggcauggucccagccuccucgcuggcgccggcugggcaacaugcuucggcauggcgaaugggaccccggg

SEQ ID NO: 2183 - RNA, 97 nt, Artificial Sequence
  gNA Variant Scaffold
gauggcgccuuuaucucauuacuuugagagccaucaccagcgacuaugucguauggguaaagcgcuuacggacuucgguccguaagaagcaucaaag

SEQ ID NO: 2184 - RNA, 89 nt, Artificial Sequence
  gNA Variant Scaffold
gcuggcgcuuuuaucucauuacuuugagagccaucaccagcgacuaugucguauggguaaagcgcccucuucggagggaagcaucaaag

SEQ ID NO: 2185 - RNA, 96 nt, Artificial Sequence
  gNA Variant Scaffold
gcuggcgccuuuaucugauuacuuugagagccaucaccagcgacuaugucguauggguaaagcucuuacggacuucgguccguaagagcaucaaag

SEQ ID NO: 2186 - RNA, 96 nt, Artificial Sequence
  gNA Variant Scaffold
gcuggcgccuuuaucugauuacuuugagagccaucaccagcgacuaugucguauggguaaagcucggacgaccucucggucguccgagcaucaaag

SEQ ID NO: 2187 - RNA, 160 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagccugucaccggaugugcuuuccggucugaugaguccgugaggacgaaacagg

SEQ ID NO: 2188 - RNA, 97 nt, Artificial Sequence
  gNA Variant Scaffold
gcuggcgcuuuuaucugauuacuuugagagccaucaccagcgacuaugucguauggguaaagcgcggacgaccucucggucguccgaagcaucaaag

SEQ ID NO: 2189 - RNA, 97 nt, Artificial Sequence
  gNA Variant Scaffold
gcuggcgccuuuaucugauuacuuugagagccaucaccagcgacuaugucguauggguaaagcgcggacgaccucucggucguccgaagcaucaaag

SEQ ID NO: 2190 - RNA, 106 nt, Artificial Sequence
  gNA Variant Scaffold
gcuggcgccuuuaucugauuacuuugagagccaucaccagcgacuaugucguauggguaaagcucaggugggacgaccucucggucguccuaucugagcaucaaag

SEQ ID NO: 2191 - RNA, 177 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaaggauggccggcauggucccagccuccucgcuggcgccggcugggcaacaccuucggguggcgaaugggac

SEQ ID NO: 2192 - RNA, 107 nt, Artificial Sequence
  gNA Variant Scaffold
gcuggcgcuuuuaucugauuacuuugagagccaucaccagcgacuaugucguauggguaaagcgcaggugggacgaccucucggucguccuaucugaagcaucaaag

SEQ ID NO: 2193 - RNA, 109 nt, Artificial Sequence
  gNA Variant Scaffold
uacuggcgcuuuuaucucauuacuuugagagccaucaccagcgacuaugucguacuggguaaagcgcuuauuuaucggagagaaauccgauaaauaagaagcaucaaag

SEQ ID NO: 2194 - RNA, 107 nt, Artificial Sequence
  gNA Variant Scaffold
uacuggcgcuuuuaucucauuacuuugagagccaucaccagcgacuaugucguauggguaaagcgcuuauuuaucgugagaaauccgauaaauaagaagcaucaaag

SEQ ID NO: 2195 - RNA, 109 nt, Artificial Sequence
  gNA Variant Scaffold
guacuggcgcuuuuaucucauuacuuugagagccaucaccagcgacuaugucguauggguaaagcgcuuauuuaucggagagaaauccgauaaauaagaagcaucaaag

SEQ ID NO: 2196 - RNA, 97 nt, Artificial Sequence
  gNA Variant Scaffold
gcuggcgcuuuuaucucauuacuuugagagccaucaccagcgacuaugucguauggguaaagcgcggacgaccucucggucguccgaagcaucaaag

SEQ ID NO: 2197 - RNA, 97 nt, Artificial Sequence
  gNA Variant Scaffold
gcuggcgccuuuaucugauuacuuugagagccaucaccagcgacuaugucguauggguaaagcgcuuacggacuucgguccguaagaagcaucaaag

SEQ ID NO: 2198 - RNA, 107 nt, Artificial Sequence
  gNA Variant Scaffold
gcuggcgcuuuuaucucauuacuuugagagccaucaccagcgacuaugucguauggguaaagcgcuuauuuaucggagagaaauccgauaaauaagaagcaucaaag

SEQ ID NO: 2199 - RNA, 97 nt, Artificial Sequence
  gNA Variant Scaffold
gcuggcgccuuuaucucauuacuuugagagccaucaccagcgacuaugucguauggguaaagcgcuuacggacuucgguccguaagaagcaucaaag

SEQ ID NO: 2200 - RNA, 89 nt, Artificial Sequence
  gNA Variant Scaffold
gcuggcgccuuuaucugauuacuuugagagccaucaccagcgacuaugucguauggguaaagcgcccucuucggagggaagcaucaaag

SEQ ID NO: 2201 - RNA, 107 nt, Artificial Sequence
  gNA Variant Scaffold
gcuggcgcuuuuaucucauuacuuugagagccaucaccagcgacuaugucguauggguaaagcgcaggugggacgaccucucggucguccuaucugaagcaucaaag

SEQ ID NO: 2202 - RNA, 107 nt, Artificial Sequence
  gNA Variant Scaffold
gcuggcgccuuuaucucauuacuuugagagccaucaccagcgacuaugucguauggguaaagcgcaggugggacgaccucucggucguccuaucugaagcaucaaag

SEQ ID NO: 2203 - RNA, 107 nt, Artificial Sequence
  gNA Variant Scaffold
gcuggcgccuuuaucugauuacuuugagagccaucaccagcgacuaugucguauggguaaagcgcaggugggacgaccucucggucguccuaucugaagcaucaaag

SEQ ID NO: 2204 - RNA, 98 nt, Artificial Sequence
  gNA Variant Scaffold
uacuggcgcuuuuaucugauuacuuugagagccaucaccagcgacuaugucguauggguaaagcgcuuacggacuucgguccguaagaagcaucaaag

SEQ ID NO: 2205 - RNA, 89 nt, Artificial Sequence
  gNA Variant Scaffold
gcuggcgccuuuaucucauuacuuugagagccaucaccagcgacuaugucguauggguaaagcgcccucuucggagggaagcaucaaag

SEQ ID NO: 2206 - RNA, 97 nt, Artificial Sequence
  gNA Variant Scaffold
gcuggcgcuuuuaucucauuacuuugagagccaucaccagcgacuaugucguauggguaaagcgcuuacggacuucgguccguaagaagcaucaaag

SEQ ID NO: 2207 - RNA, 97 nt, Artificial Sequence
  gNA Variant Scaffold
gcuggcgccuuuaucucauuacuuugagagccaucaccagcgacuaugucguauggguaaagcgcggacgaccucucggucguccgaagcaucaaag

SEQ ID NO: 2208 - RNA, 177 nt, Artificial Sequence
  gNA Variant Scaffold
gauggccggcauggucccagccuccucgcuggcgccggcugggcaacaccuucggguggcgaaugggacuacuggcgcuuuuaucucauuacuuugagagccaucaccagcgacuaugucguauggguaaagcgcuuauuuaucggagagaaauccgauaaauaagaagcaucaaag

SEQ ID NO: 2209 - RNA, 194 nt, Artificial Sequence
  gNA Variant Scaffold
ggccggcauggucccagccuccucgcuggcgccggcugggcaacauuccgaggggaccguccccucgguaauggcgaaugggacccuacuggcgcuuuuaucucauuacuuugagagccaucaccagcgacuaugucguauggguaaagcgcuuauuuaucggagagaaauccgauaaauaagaagcaucaaag

SEQ ID NO: 2210 - RNA, 96 nt, Artificial Sequence
  gNA Variant Scaffold
gcuggcgccuuuaucugauuacuuugagagccaucaccagcgacuaugucguauggguaaagcgcuuacggacuucgguccguaagcgcaucaaag

SEQ ID NO: 2211 - RNA, 172 nt, Artificial Sequence
  gNA Variant Scaffold
cgugguuagggccacguuaaauaguugcuuaagcccuaagcguugaucuucggaucaggugcaauacuggcgcuuuuaucucauuacuuugagagccaucaccagcgacuaugucguauggguaaagcgcuuauuuaucggagagaaauccgauaaauaagaagcaucaaag

SEQ ID NO: 2212 - RNA, 197 nt, Artificial Sequence
  gNA Variant Scaffold
gggucggcauggcaucuccaccuccucgcgguccgaccugggcauccgaaggaggacgcacguccacucggauggcuaagggagagccauacuggcgcuuuuaucucauuacuuugagagccaucaccagcgacuaugucguauggguaaagcgcuuauuuaucggagagaaauccgauaaauaagaagcaucaaag

SEQ ID NO: 2213 - RNA, 171 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagccaguacugaugaguccgugaggacgaaacgaguaagcucgucuacuggcgcuuuuaucucau

SEQ ID NO: 2214 - RNA, 99 nt, Artificial Sequence
  gNA Variant Scaffold
uacuggcgccuuuaucucauuacuuuagagagccaucaccagcgacuaugucguauggguaaagcgcuuacggacuucgguccguaagaagcaucaaag

SEQ ID NO: 2215 - RNA, 157 nt, Artificial Sequence
  gNA Variant Scaffold
cgacuacugaugaguccgugaggacgaaacgaguaagcucgucuagucguacuggcgcuuuuaucucauuacuuugagagccaucaccagcgacuaugucguauggguaaagcgcuuauuuaucggagagaaauccgauaaauaagaagcaucaaag

SEQ ID NO: 2216 - RNA, 106 nt, Artificial Sequence
  gNA Variant Scaffold
gcuggcgccuuuaucugauuacuuugagagccaucaccagcgacuaugucguauggguaaagcgcaggugggacgaccucucggucguccuaucugcgcaucaaag

SEQ ID NO: 2217 - RNA, 97 nt, Artificial Sequence
  gNA Variant Scaffold
uacuggcgccuuuaucucauuacuuuagagccaucaccagcgacuaugucguauggguaaagcgcuuacggacuucgguccguaagaagcaucaaag

SEQ ID NO: 2218 - RNA, 186 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagcauuccucagaaaaugacaaaccuguggggcguaaguagaucuucggaucuaugaucgugcagacguuaaaaucaggu

SEQ ID NO: 2219 - RNA, 171 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagcgacuacugaugaguccgugaggacgaaacgaguaagcucgucuagucgcguguagcgaagca

SEQ ID NO: 2220 - RNA, 186 nt, Artificial Sequence
  gNA Variant Scaffold
cauuccucagaaaaugacaaaccuguggggcguaaguagaucuucggaucuaugaucgugcagacguuaaaaucagguuacuggcgcuuuuaucucauuacuuugagagccaucaccagcgacuaugucguauggguaaagcgcuuauuuaucggagagaaauccgauaaauaagaagcaucaaag

SEQ ID NO: 2221 - RNA, 186 nt, Artificial Sequence
  gNA Variant Scaffold
uuuuggccggcauggucccagccuccucgcuggcgccggcugggcaacaugcuucggcauggcgaaugggaccccggguacuggcgcuuuuaucucauuacuuugagagccaucaccagcgacuaugucguauggguaaagcgcuuauuuaucggagagaaauccgauaaauaagaagcaucaaag

SEQ ID NO: 2222 - RNA, 171 nt, Artificial Sequence
  gNA Variant Scaffold
cgacuacugaugaguccgugaggacgaaacgaguaagcucgucuagucgcguguagcgaagcauacuggcgcuuuuaucucauuacuuugagagccaucaccagcgacuaugucguauggguaaagcgcuuauuuaucggagagaaauccgauaaauaagaagcaucaaag

SEQ ID NO: 2223 - RNA, 168 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaaggggagccccgcugaugaggucggggagaccgaaagggacuucggucccuacggggcuccc

SEQ ID NO: 2224 - RNA, 144 nt, Artificial Sequence
  gNA Variant Scaffold
ccacccccaccaccacccccacccccaccaccacccuacuggcgcuuuuaucucauuacuuugagagccaucaccagcgacuaugucguauggguaaagcgcuuauuuaucggagagaaauccgauaaauaagaagcaucaaag

SEQ ID NO: 2225 - RNA, 157 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagcgacuacugaugaguccgugaggacgaaacgaguaagcucgucuagucg

SEQ ID NO: 2226 - RNA, 172 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagcgugguuagggccacguuaaauaguugcuuaagcccuaagcguugaucuucggaucaggugcaa

SEQ ID NO: 2227 - RNA, 184 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagggcaauaaagcgguuacaagcccgcaaaaauagcagaguaaugucgcgauagcgcggcauuaaugcagcuuuauug

SEQ ID NO: 2228 - RNA, 122 nt, Artificial Sequence
  gNA Variant Scaffold
uacuggcgcuuuuaucucauuacuauuaucucauuacuuugagagccaucaccagcgacuaugucguauggguaaagcgcuuauuuaucggagagaaauccgauaaauaagaagcaucaaag

SEQ ID NO: 2229 - RNA, 184 nt, Artificial Sequence
  gNA Variant Scaffold
ggcaauaaagcgguuacaagcccgcaaaaauagcagaguaaugucgcgauagcgcggcauuaaugcagcuuuauuguacuggcgcuuuuaucucauuacuuugagagccaucaccagcgacuaugucguauggguaaagcgcuuauuuaucggagagaaauccgauaaauaagaagcaucaaag

SEQ ID NO: 2230 - RNA, 185 nt, Artificial Sequence
  gNA Variant Scaffold
uacuggcgcuuuuaucucauuacuuugagagccaucaccagcgacuaugucguauggguaaagcgcuuauuuaucggagagaaauccgauaaauaagaagcaucaaagacccgcaaggccgacggcauccgccgccgcuggugcaaguccagccgccccuucgggggcgggcgcucauggguaac

SEQ ID NO: 2231 - RNA, 63 nt, Artificial Sequence
  gNA Variant Scaffold
uacuggcgcuuuuaucucauuacuuugagagccaucaccagcgacuaugucguauggguaaag

SEQ ID NO: 2232 - RNA, 168 nt, Artificial Sequence
  gNA Variant Scaffold
gggagccccgcugaugaggucggggagaccgaaagggacuucggucccuacggggcucccuacuggcgcuuuuaucucauuacuuugagagccaucaccagcgacuaugucguauggguaaagcgcuuauuuaucggagagaaauccgauaaauaagaagcaucaaag

SEQ ID NO: 2233 - RNA, 171 nt, Artificial Sequence
  gNA Variant Scaffold
ccaguacugaugaguccgugaggacgaaacgaguaagcucgucuacuggcgcuuuuaucucauuacuggcgcuuuuaucucauuacuuugagagccaucaccagcgacuaugucguauggguaaagcgcuuauuuaucggagagaaauccgauaaauaagaagcaucaaag

SEQ ID NO: 2234 - RNA, 185 nt, Artificial Sequence
  gNA Variant Scaffold
acccgcaaggccgacggcauccgccgccgcuggugcaaguccagccgccccuucgggggcgggcgcucauggguaacuacuggcgcuuuuaucucauuacuuugagagccaucaccagcgacuaugucguauggguaaagcgcuuauuuaucggagagaaauccgauaaauaagaagcaucaaag

SEQ ID NO: 2235 - RNA, 160 nt, Artificial Sequence
  gNA Variant Scaffold
ccugucaccggaugugcuuuccggucugaugaguccgugaggacgaaacagguacuggcgcuuuuaucucauuacuuugagagccaucaccagcgacuaugucguauggguaaagcgcuuauuuaucggagagaaauccgauaaauaagaagcaucaaag

SEQ ID NO: 2236 - RNA, 100 nt, Artificial Sequence
  gNA Variant Scaffold
guacuggcgccuuuaucucauuacuuugagagccaucaccagcgacuaugucguaguggguaaagcgcuuacggacuucgguccguaagaagcaucaaag

SEQ ID NO: 2237 - RNA, 91 nt, Artificial Sequence
  gNA Variant Scaffold
guacuggcgcuuuuaucugauuacuuugagagccaucaccagcgacuaugucguaguggguaaagcucccucuucggagggagcaucaaag

SEQ ID NO: 2238 - RNA, 89 nt, Artificial Sequence; identical to SEQ ID NO: 33
  gNA Variant Scaffold

SEQ ID NO: 2239 - RNA, 97 nt, Artificial Sequence
  gNA Variant Scaffold
acuggcgccuuuaucucauuacuuugagagccaucaccagcgacuaugucguauggguaaagcgcuuacggacuucgguccguaagaagcaucaaag

SEQ ID NO: 2240 - RNA, 89 nt, Artificial Sequence
  gNA Variant Scaffold
gcuggcgcuuuuaucugauuacuuugagagccaucaccagcgacuaugucguaguggguaaagcucccucuucggagggagcaucaaag

SEQ ID NO: 2241 - RNA, 88 nt, Artificial Sequence
  gNA Variant Scaffold
acuggcgcuuuuaucugauuacuuugagagccaucaccagcgacuaugucguauggguaaagcucccucuucggagggagcaucaaag

SEQ ID NO: 2242 - RNA, 97 nt, Artificial Sequence
  gNA Variant Scaffold
acuggcgccuuuaucugauuacuuugagagccaucaccagcgacuaugucguauggguaaagcgcuuacggacuucgguccguaagaagcaucaaag

SEQ ID NO: 2243 - RNA, 97 nt, Artificial Sequence
  gNA Variant Scaffold
acuggcgcuuuuaucugauuacuuugagagccaucaccagcgacuaugucguauggguaaagcgcuuacggacuucgguccguaagaagcaucaaag

SEQ ID NO: 2244 - RNA, 98 nt, Artificial Sequence
  gNA Variant Scaffold
acuggcgcuuuuaucugauuacuuugagagccaucaccagcgacuaugucguaguggguaaagcgcuuacggacuucgguccguaagaagcaucaaag

SEQ ID NO: 2245 - RNA, 89 nt, Artificial Sequence
  gNA Variant Scaffold
acuggcgcuuuuaucugauuacuuugagagccaucaccagcgacuaugucguauuggguaaagcucccucuucggagggagcaucaaag

SEQ ID NO: 2246 - RNA, 98 nt, Artificial Sequence
  gNA Variant Scaffold
acuggcgcuuuuaucugauuacuuugagagccaucaccagcgacuaugucguauuggguaaagcgcuuacggacuucgguccguaagaagcaucaaag

SEQ ID NO: 2247 - RNA, 98 nt, Artificial Sequence
  gNA Variant Scaffold
acuggcgccuuuaucaucauuacuuugagagccaucaccagcgacuaugucguauggguaaagcgcuuacggacuucgguccguaagaagcaucaaag

SEQ ID NO: 2248 - RNA, 90 nt, Artificial Sequence
  gNA Variant Scaffold
acuggcgcuuuuaucugauuacuuugagagccaucaccagcgacuaugucguaguggguaaagcgcccucuucggagggaagcaucaaag

SEQ ID NO: 2249 - RNA, 96 nt, Artificial Sequence
  gNA Variant Scaffold
acuggcgcuuuuaucugauuacuuugagagccaucaccagcgacuaugucguaguggguaaagcucacaugaggaucacccaugugagcaucaaag

SEQ ID NO: 2250 - RNA, 89 nt, Artificial Sequence
  gNA Variant Scaffold
acuggcacuuuuaccugauuacuuugagagccaacaccagcgacuaugucguaguggguaaagcucccucuucggagggagcaucaaag

SEQ ID NO: 2251 - RNA, 89 nt, Artificial Sequence
  gNA Variant Scaffold
acuggcacuuuuaucugauuacuuugagagccaucaccagcgacuaugucguaguggguaaagcucccucuucggagggagcaucaaag

SEQ ID NO: 2252 - RNA, 89 nt, Artificial Sequence
  gNA Variant Scaffold
acuggcccuuuuaucugauuacuuugagagccaucaccagcgacuaugucguaguggguaaagcucccucuucggagggagcaucaaag

SEQ ID NO: 2253 - RNA, 89 nt, Artificial Sequence
  gNA Variant Scaffold
acuggcgcuuuuaccugauuacuuugagagccaucaccagcgacuaugucguaguggguaaagcucccucuucggagggagcaucaaag

SEQ ID NO: 2254 - RNA, 89 nt, Artificial Sequence
  gNA Variant Scaffold
acuggcgcuuuuaucugauuacuuugagagccaacaccagcgacuaugucguaguggguaaagcucccucuucggagggagcaucaaag

SEQ ID NO: 2255 - RNA, 97 nt, Artificial Sequence
  gNA Variant Scaffold
acuggcaccuuuaccugauuacuuugagagccaacaccagcgacuaugucguauggguaaagcgcuuacggacuucgguccguaagaagcaucaaag

SEQ ID NO: 2256 - RNA, 97 nt, Artificial Sequence
  gNA Variant Scaffold
acuggcaccuuuaucugauuacuuugagagccaucaccagcgacuaugucguauggguaaagcgcuuacggacuucgguccguaagaagcaucaaag

SEQ ID NO: 2257 - RNA, 97 nt, Artificial Sequence
  gNA Variant Scaffold
acuggccccuuuaucugauuacuuugagagccaucaccagcgacuaugucguauggguaaagcgcuuacggacuucgguccguaagaagcaucaaag

SEQ ID NO: 2258 - RNA, 97 nt, Artificial Sequence
  gNA Variant Scaffold
acuggcgccuuuaucugauuacuuugagagccaacaccagcgacuaugucguauggguaaagcgcuuacggacuucgguccguaagaagcaucaaag

SEQ ID NO: 2259 - RNA, 89 nt, Artificial Sequence; identical to SEQ ID NO: 2240
  gNA Variant Scaffold

SEQ ID NO: 2260 - RNA, 90 nt, Artificial Sequence
  gNA Variant Scaffold
gacuggcgcuuuuaucugauuacuuugagagccaucaccagcgacuaugucguaguggguaaagcucccucuucggagggagcaucaaag

SEQ ID NO: 2261 - RNA, 90 nt, Artificial Sequence
  gNA Variant Scaffold
acuggcgccuuuaucugauuacuuuggagagccaucaccagcgacuaugucguaguggguaaagcucccucuucggagggagcaucaaag

SEQ ID NO: 2262 - RNA, 89 nt, Artificial Sequence
  gNA Variant Scaffold
acuggcgcauuuaucugauuacuuugugagccaucaccagcgacuaugucguaguggguaaagcucccucuucggagggagcaucaaag

SEQ ID NO: 2263 - RNA, 89 nt, Artificial Sequence
  gNA Variant Scaffold
acuggcgccuuuaucugauuacuuugagagccaucaccagcgacuaugucguaguggguaaagcucccucuucggagggagcaucaaag

SEQ ID NO: 2264 - RNA, 90 nt, Artificial Sequence
  gNA Variant Scaffold
acuggcgcuuuuaucugauuacuuuggagagccaucaccagcgacuaugucguaguggguaaagcucccucuucggagggagcaucaaag

SEQ ID NO: 2265 - RNA, 89 nt, Artificial Sequence
  gNA Variant Scaffold
acuggcgcauuuaucugauuacuuugagagccaucaccagcgacuaugucguaguggguaaagcucccucuucggagggagcaucaaag

SEQ ID NO: 2266 - RNA, 89 nt, Artificial Sequence
  gNA Variant Scaffold
acuggcgcuuuuaucugauuacuuugugagccaucaccagcgacuaugucguaguggguaaagcucccucuucggagggagcaucaaag

SEQ ID NO: 2267 - RNA, 90 nt, Artificial Sequence
  gNA Variant Scaffold
acuggcgcuuuuauucugauuacuuugagagccaucaccagcgacuaugucguaguggguaaagcucccucuucggagggagcaucaaag

SEQ ID NO: 2268 - RNA, 88 nt, Artificial Sequence
  gNA Variant Scaffold
acggcgcuuuuaucugauuacuuugagagccaucaccagcgacuaugucguaguggguaaagcucccucuucggagggagcaucaaag

SEQ ID NO: 2269 - RNA, 89 nt, Artificial Sequence
  gNA Variant Scaffold
acuggcgcuuuuauaugauuacuuugagagccaucaccagcgacuaugucguaguggguaaagcucccucuucggagggagcaucaaag

SEQ ID NO: 2270 - RNA, 90 nt, Artificial Sequence
  gNA Variant Scaffold
acuggcgcuuuuaucuugauuacuuugagagccaucaccagcgacuaugucguaguggguaaagcucccucuucggagggagcaucaaag

SEQ ID NO: 2271 - RNA, 89 nt, Artificial Sequence
  gNA Variant Scaffold
acuggcgcuuuuaucugauuacuuugagagccagcaccagcgacuaugucguaguggguaaagcucccucuucggagggagcaucaaag

SEQ ID NO: 2272 - RNA, 89 nt, Artificial Sequence
  gNA Variant Scaffold
acuggcgcuguuaucugauuacuucgagagccaucaccagcgacuaugucguaguggguaaagcucccucuucggagggagcaucgaag

SEQ ID NO: 2273 - RNA, 89 nt, Artificial Sequence
  gNA Variant Scaffold
acuggcgcucuuaucugauuacuucgagagccaucaccagcgacuaugucguaguggguaaagcucccucuucggagggagcaucgaag

SEQ ID NO: 2274 - RNA, 89 nt, Artificial Sequence
  gNA Variant Scaffold
acuggcgcuuguaucugauuacucugagagccaucaccagcgacuaugucguaguggguaaagcucccucuucggagggagcaucagag

SEQ ID NO: 2275 - RNA, 89 nt, Artificial Sequence
  gNA Variant Scaffold
acuggcgcuucuaucugauuacucugagagccaucaccagcgacuaugucguaguggguaaagcucccucuucggagggagcaucagag

SEQ ID NO: 2276 - RNA, 89 nt, Artificial Sequence
  gNA Variant Scaffold
acuggcgcuuugaucugauuaccuugagagccaucaccagcgacuaugucguaguggguaaagcucccucuucggagggagcaucaagg

SEQ ID NO: 2277 - RNA, 89 nt, Artificial Sequence
  gNA Variant Scaffold
acuggcgcuuucaucugauuaccuugagagccaucaccagcgacuaugucguaguggguaaagcucccucuucggagggagcaucaagg

SEQ ID NO: 2278 - RNA, 89 nt, Artificial Sequence
  gNA Variant Scaffold
acuggcgcuguuaucugauuacuuugagagccaucaccagcgacuaugucguaguggguaaagcucccucuucggagggagcaucaaag

SEQ ID NO: 2279 - RNA, 89 nt, Artificial Sequence
  gNA Variant Scaffold
acuggcgcuuuuaucugauuacuuugagagccaucaccagcgacuaugucguaguggguaaagcucccucuucggagggagcaucgaag

SEQ ID NO: 2280 - RNA, 89 nt, Artificial Sequence
  gNA Variant Scaffold
acuggcgcuuuuaucugauuacuucgagagccaucaccagcgacuaugucguaguggguaaagcucccucuucggagggagcaucaaag

SEQ ID NO: 2281 - RNA, 20 nt, Artificial Sequence
  B2M targeting sequence
ggaaauagaugguguauuca

SEQ ID NO: 2282 - RNA, 20 nt, Artificial Sequence
  B2M targeting sequence
ugaaggaaaccugacauaca

SEQ ID NO: 2283 - RNA, 20 nt, Artificial Sequence
  B2M targeting sequence
auuuccugaaggaaaccuga

SEQ ID NO: 2284 - RNA, 20 nt, Artificial Sequence
  B2M targeting sequence
aacuggauaaucuaauaaag

SEQ ID NO: 2285 - RNA, 20 nt, Artificial Sequence
  B2M targeting sequence
aguuugaauacaccaucuau

SEQ ID NO: 2286 - RNA, 20 nt, Artificial Sequence
  B2M targeting sequence
aauaaaguuauauuuauaaa

SEQ ID NO: 2287 - RNA, 20 nt, Artificial Sequence
  B2M targeting sequence
auacuuuuauaaauauaacu

SEQ ID NO: 2288 - RNA, 20 nt, Artificial Sequence
  B2M targeting sequence
uucuauacuuuuauaaauau

SEQ ID NO: 2289 - RNA, 20 nt, Artificial Sequence
  B2M targeting sequence
cuauacucuuucuauacuuu

SEQ ID NO: 2290 - RNA, 20 nt, Artificial Sequence
  B2M targeting sequence
gcuauuacuugugguuucac

SEQ ID NO: 2291 - RNA, 20 nt, Artificial Sequence
  B2M targeting sequence
ccugggacugggacaagagg

SEQ ID NO: 2292 - RNA, 20 nt, Artificial Sequence
  B2M targeting sequence
caggggauucugcuauuacu

SEQ ID NO: 2293 - RNA, 20 nt, Artificial Sequence
  B2M targeting sequence
cagucccaggggauucugcu

SEQ ID NO: 2294 - RNA, 20 nt, Artificial Sequence
  B2M targeting sequence
ugucccagucccaggggauu

SEQ ID NO: 2295 - RNA, 20 nt, Artificial Sequence
  B2M targeting sequence
ucuugucccagucccagggg

SEQ ID NO: 2296 - RNA, 20 nt, Artificial Sequence
  B2M targeting sequence
auccucuugucccaguccca

SEQ ID NO: 2297 - RNA, 20 nt, Artificial Sequence
  B2M targeting sequence
ccagaaccuggagacagaga

SEQ ID NO: 2298 - RNA, 20 nt, Artificial Sequence
  B2M targeting sequence
ggugacugcuccauccucuu

SEQ ID NO: 2299 - RNA, 20 nt, Artificial Sequence
  B2M targeting sequence
agguucuggugacugcucca

SEQ ID NO: 2300 - RNA, 20 nt, Artificial Sequence
  B2M targeting sequence
ccagguucuggugacugcuc

SEQ ID NO: 2301 - RNA, 20 nt, Artificial Sequence
  B2M targeting sequence
gucuccagguucuggugacu

SEQ ID NO: 2302 - RNA, 20 nt, Artificial Sequence
  B2M targeting sequence
cugucuccagguucugguga

SEQ ID NO: 2303 - RNA, 20 nt, Artificial Sequence
  B2M targeting sequence
gauaaugucagcaucugugc

SEQ ID NO: 2304 - RNA, 20 nt, Artificial Sequence
  B2M targeting sequence
gaagccaggcagcccucucu

SEQ ID NO: 2305 - RNA, 20 nt, Artificial Sequence
  B2M targeting sequence
gcaucugugcuguaugaguu

SEQ ID NO: 2306 - RNA, 20 nt, Artificial Sequence
  B2M targeting sequence
gugcuguaugaguuccagug

SEQ ID NO: 2307 - RNA, 20 nt, Artificial Sequence
  B2M targeting sequence
uacagcacagaugcugacau

SEQ ID NO: 2308 - RNA, 20 nt, Artificial Sequence
  B2M targeting sequence
aguguggcagcccucuccua

SEQ ID NO: 2309 - RNA, 20 nt, Artificial Sequence
  B2M targeting sequence
ccuaaauuaccccaauuccc

SEQ ID NO: 2310 - RNA, 20 nt, Artificial Sequence
  B2M targeting sequence
uaaauuaccccaauucccuc

SEQ ID NO: 2311 - RNA, 20 nt, Artificial Sequence
  B2M targeting sequence
cucuggaucugggaucugcu

SEQ ID NO: 2312 - RNA, 20 nt, Artificial Sequence
  B2M targeting sequence
ggaucugggaucugcucccu

SEQ ID NO: 2313 - RNA, 20 nt, Artificial Sequence
  B2M targeting sequence
agagggaauugggguaauuu

SEQ ID NO: 2314 - RNA, 20 nt, Artificial Sequence
  B2M targeting sequence
gggaucugcucccuccucuu

SEQ ID NO: 2315 - RNA, 20 nt, Artificial Sequence
  B2M targeting sequence
cagauccagagggaauuggg

SEQ ID NO: 2316 - RNA, 20 nt, Artificial Sequence
  B2M targeting sequence
gcucccuccucuugccccug

SEQ ID NO: 2317 - RNA, 20 nt, Artificial Sequence
  B2M targeting sequence
cuccucuugccccugagguc

SEQ ID NO: 2318 - RNA, 20 nt, Artificial Sequence
  B2M targeting sequence
ucuugccccugaggucuggg

SEQ ID NO: 2319 - RNA, 20 nt, Artificial Sequence
  B2M targeting sequence
ugccccugaggucugggggu

SEQ ID NO: 2320 - RNA, 20 nt, Artificial Sequence
  B2M targeting sequence
ggggcaagaggagggagcag

SEQ ID NO: 2321 - RNA, 20 nt, Artificial Sequence
  B2M targeting sequence
gggggugggaaaggcucccc

SEQ ID NO: 2322 - RNA, 20 nt, Artificial Sequence
  B2M targeting sequence
cacccccagaccucaggggc

SEQ ID NO: 2323 - RNA, 20 nt, Artificial Sequence
  B2M targeting sequence
ccacucuugcuaguuccagg

SEQ ID NO: 2324 - RNA, 20 nt, Artificial Sequence
  B2M targeting sequence
ugcuaguuccagggugcuuc

SEQ ID NO: 2325 - RNA, 20 nt, Artificial Sequence
  B2M targeting sequence
agggugcuucacuggccuuu

SEQ ID NO: 2326 - RNA, 20 nt, Artificial Sequence
  B2M targeting sequence
cuggccuuuaugaguuuccc

SEQ ID NO: 2327 - RNA, 20 nt, Artificial Sequence
  B2M targeting sequence
uaaaggccagugaagcaccc

SEQ ID NO: 2328 - RNA, 20 nt, Artificial Sequence
  B2M targeting sequence
cuucacccuguucacaccuu

SEQ ID NO: 2329 - RNA, 20 nt, Artificial Sequence
  B2M targeting sequence
cccuguucacaccuugguga

SEQ ID NO: 2330 - RNA, 20 nt, Artificial Sequence
  B2M targeting sequence
caccuuggugaauauucucu

SEQ ID NO: 2331 - RNA, 20 nt, Artificial Sequence
  B2M targeting sequence
ccaaggugugaacaggguga

SEQ ID NO: 2332 - RNA, 20 nt, Artificial Sequence
  B2M targeting sequence
cuuccugacaugcuccucag

SEQ ID NO: 2333 - RNA, 20 nt, Artificial Sequence
  B2M targeting sequence
uccugacaugcuccucaguu

SEQ ID NO: 2334 - RNA, 20 nt, Artificial Sequence
  B2M targeting sequence
ugacaugcuccucaguuaca

SEQ ID NO: 2335 - RNA, 20 nt, Artificial Sequence
  B2M targeting sequence
ggaagagaauauucaccaag

SEQ ID NO: 2336 - RNA, 20 nt, Artificial Sequence
  B2M targeting sequence
ucaguuacaccacuugaaug

SEQ ID NO: 2337 - RNA, 20 nt, Artificial Sequence
  B2M targeting sequence
guuacaccacuugaaugugc

SEQ ID NO: 2338 - RNA, 20 nt, Artificial Sequence
  B2M targeting sequence
agugguguaacugaggagca

SEQ ID NO: 2339 - RNA, 20 nt, Artificial Sequence
  B2M targeting sequence
gcuucuugucgggaccauga

SEQ ID NO: 2340 - RNA, 20 nt, Artificial Sequence
  B2M targeting sequence
ugucgggaccaugacugaca

SEQ ID NO: 2341 - RNA, 20 nt, Artificial Sequence
  B2M targeting sequence
ggaccaugacugacacugcu

SEQ ID NO: 2342 - RNA, 20 nt, Artificial Sequence
  B2M targeting sequence
cgacaagaagcagauggcac

SEQ ID NO: 2343 - RNA, 20 nt, Artificial Sequence
  B2M targeting sequence
uggucccgacaagaagcaga

SEQ ID NO: 2344 - RNA, 20 nt, Artificial Sequence
  B2M targeting sequence
gucauggucccgacaagaag

SEQ ID NO: 2345 - RNA, 20 nt, Artificial Sequence
  B2M targeting sequence
aucaccagccugcugagcug

SEQ ID NO: 2346 - RNA, 20 nt, Artificial Sequence
  B2M targeting sequence
ccagccugcugagcuguucu

SEQ ID NO: 2347 - RNA, 20 nt, Artificial Sequence
  B2M targeting sequence
gcaggcuggugauggagcag

SEQ ID NO: 2348 - RNA, 20 nt, Artificial Sequence
  B2M targeting sequence
uuaauuuguccuuguuuagc

SEQ ID NO: 2349 - RNA, 20 nt, Artificial Sequence
  B2M targeting sequence
uuguuuagcugccuuuccca

SEQ ID NO: 2350 - RNA, 20 nt, Artificial Sequence
  B2M targeting sequence
cauacaucccucaucaguga

SEQ ID NO: 2351 - RNA, 20 nt, Artificial Sequence
  B2M targeting sequence
cucaucagugauucuaaaaa

SEQ ID NO: 2352 - RNA, 20 nt, Artificial Sequence
  B2M targeting sequence
ucagugauucuaaaaaauag

SEQ ID NO: 2353 - RNA, 20 nt, Artificial Sequence
  B2M targeting sequence
gugauucuaaaaaauaggca

SEQ ID NO: 2354 - RNA, 20 nt, Artificial Sequence
  B2M targeting sequence
cugaugagggauguauggga

SEQ ID NO: 2355 - RNA, 20 nt, Artificial Sequence
  B2M targeting sequence
aaaaaauaggcauuguccuc

SEQ ID NO: 2356 - RNA, 20 nt, Artificial Sequence
  B2M targeting sequence
uccuccagucuuccauacaa

SEQ ID NO: 2357 - RNA, 20 nt, Artificial Sequence
  B2M targeting sequence
uccagucuuccauacaacuc

SEQ ID NO: 2358 - RNA, 20 nt, Artificial Sequence
  B2M targeting sequence
agucuuccauacaacuccca

SEQ ID NO: 2359 - RNA, 20 nt, Artificial Sequence
  B2M targeting sequence
uccauacaacucccaucucu

SEQ ID NO: 2360 - RNA, 20 nt, Artificial Sequence
  B2M targeting sequence
auacaacucccaucucuacu

SEQ ID NO: 2361 - RNA, 20 nt, Artificial Sequence
  B2M targeting sequence
caucucuacucucagcaguc

SEQ ID NO: 2362 - RNA, 20 nt, Artificial Sequence
  B2M targeting sequence
cuacucucagcagucaaccu

SEQ ID NO: 2363 - RNA, 20 nt, Artificial Sequence
  B2M targeting sequence
acucucagcagucaaccuca

SEQ ID NO: 2364 - RNA, 20 nt, Artificial Sequence
  B2M targeting sequence
cagcagucaaccucaccucu

SEQ ID NO: 2365 - RNA, 20 nt, Artificial Sequence
  B2M targeting sequence
gcagucaaccucaccucuua

SEQ ID NO: 2366 - RNA, 20 nt, Artificial Sequence
  B2M targeting sequence
accucaccucuuauguuaug

SEQ ID NO: 2367 - RNA, 20 nt, Artificial Sequence
  B2M targeting sequence
ccucuuauguuauggggaaa

SEQ ID NO: 2368 - RNA, 20 nt, Artificial Sequence
  B2M targeting sequence
uauguuauggggaaaauaga

SEQ ID NO: 2369 - RNA, 20 nt, Artificial Sequence
  B2M targeting sequence
ccauaacauaagaggugagg

SEQ ID NO: 2370 - RNA, 20 nt, Artificial Sequence
  B2M targeting sequence
auuuuccccauaacauaaga

SEQ ID NO: 2371 - RNA, 20 nt, Artificial Sequence
  B2M targeting sequence
gccccaauggccucuauuuu

SEQ ID NO: 2372 - RNA, 20 nt, Artificial Sequence
  B2M targeting sequence
acuucaauucauacuuggag

SEQ ID NO: 2373 - RNA, 20 nt, Artificial Sequence
  B2M targeting sequence
auucauacuuggaggaaauu

SEQ ID NO: 2374 - RNA, 20 nt, Artificial Sequence
  B2M targeting sequence
uacuuggaggaaauuauaca

SEQ ID NO: 2375 - RNA, 20 nt, Artificial Sequence
  B2M targeting sequence
aaguaugaauugaaguggau

SEQ ID NO: 2376 - RNA, 20 nt, Artificial Sequence
  B2M targeting sequence
uccaaguaugaauugaagug

SEQ ID NO: 2377 - RNA, 20 nt, Artificial Sequence
  B2M targeting sequence
agguggggggcucuccuccu

SEQ ID NO: 2378 - RNA, 20 nt, Artificial Sequence
  B2M targeting sequence
ccuccucuucaaguccagac

SEQ ID NO: 2379 - RNA, 20 nt, Artificial Sequence
  B2M targeting sequence
uccucuucaaguccagacuc

SEQ ID NO: 2380 - RNA, 20 nt, Artificial Sequence
  B2M targeting sequence
ucuucaaguccagacucucu

SEQ ID NO: 2381 - RNA, 20 nt, Artificial Sequence
  B2M targeting sequence
ucaaguccagacucucuucc

SEQ ID NO: 2382 - RNA, 20 nt, Artificial Sequence
  B2M targeting sequence
aguccagacucucuuccugg

SEQ ID NO: 2383 - RNA, 20 nt, Artificial Sequence
  B2M targeting sequence
agacucucuuccuggaugcu

SEQ ID NO: 2384 - RNA, 20 nt, Artificial Sequence
  B2M targeting sequence
ggacuugaagaggaggagag

SEQ ID NO: 2385 - RNA, 20 nt, Artificial Sequence
  B2M targeting sequence
cuuccuggaugcuuggcccu

SEQ ID NO: 2386 - RNA, 20 nt, Artificial Sequence
  B2M targeting sequence
uccuggaugcuuggcccuuc

SEQ ID NO: 2387 - RNA, 20 nt, Artificial Sequence
  B2M targeting sequence
uggaugcuuggcccuucagc

SEQ ID NO: 2388 - RNA, 20 nt, Artificial Sequence
  B2M targeting sequence
aggaagagagucuggacuug

SEQ ID NO: 2389 - RNA, 20 nt, Artificial Sequence
  B2M targeting sequence
gccacuuuucucugugucuu

SEQ ID NO: 2390 - RNA, 20 nt, Artificial Sequence
  B2M targeting sequence
cugugucuugagccucucug

SEQ ID NO: 2391 - RNA, 20 nt, Artificial Sequence
  B2M targeting sequence
gugucuugagccucucuguu

SEQ ID NO: 2392 - RNA, 20 nt, Artificial Sequence
  B2M targeting sequence
ugagccucucuguuuucccc

SEQ ID NO: 2393 - RNA, 20 nt, Artificial Sequence
  B2M targeting sequence
agacacagagaaaaguggcu

SEQ ID NO: 2394 - RNA, 20 nt, Artificial Sequence
  B2M targeting sequence
cuguuuuccccuuucuuuuu

SEQ ID NO: 2395 - RNA, 20 nt, Artificial Sequence
  B2M targeting sequence
guuuuccccuuucuuuuucu

SEQ ID NO: 2396 - RNA, 20 nt, Artificial Sequence
  B2M targeting sequence
ccuuucuuuuucuuagugua

SEQ ID NO: 2397 - RNA, 20 nt, Artificial Sequence
  B2M targeting sequence
uuuucuuaguguauaggaua

SEQ ID NO: 2398 - RNA, 20 nt, Artificial Sequence
  B2M targeting sequence
uaguguauaggauagaaaua

SEQ ID NO: 2399 - RNA, 20 nt, Artificial Sequence
  B2M targeting sequence
uauacacuaagaaaaagaaa

SEQ ID NO: 2400 - RNA, 20 nt, Artificial Sequence
  B2M targeting sequence
auccuauacacuaagaaaaa

SEQ ID NO: 2401 - RNA, 20 nt, Artificial Sequence
  B2M targeting sequence
ggauguguccacuucuugga

SEQ ID NO: 2402 - RNA, 20 nt, Artificial Sequence
  B2M targeting sequence
ugauauuucuauccuauaca

SEQ ID NO: 2403 - RNA, 20 nt, Artificial Sequence
  B2M targeting sequence
acuucuuggagacaaauccc

SEQ ID NO: 2404 - RNA, 20 nt, Artificial Sequence
  B2M targeting sequence
uggagacaaaucccugucuu

SEQ ID NO: 2405 - RNA, 20 nt, Artificial Sequence
  B2M targeting sequence
aagaaguggacacauccuga

SEQ ID NO: 2406 - RNA, 20 nt, Artificial Sequence
  B2M targeting sequence
ccaagaaguggacacauccu

SEQ ID NO: 2407 - RNA, 20 nt, Artificial Sequence
  B2M targeting sequence
cugucuuguuuuuguuucuu

SEQ ID NO: 2408 - RNA, 20 nt, Artificial Sequence
  B2M targeting sequence
uguuuuuguuucuuauuuua

SEQ ID NO: 2409 - RNA, 20 nt, Artificial Sequence
  B2M targeting sequence
uauuuuaacugcccuucagg

SEQ ID NO: 2410 - RNA, 20 nt, Artificial Sequence
  B2M targeting sequence
ggucucuccuaccuaacaaa

SEQ ID NO: 2411 - RNA, 20 nt, Artificial Sequence
  B2M targeting sequence
cuccuaccuaacaaaccaaa

SEQ ID NO: 2412 - RNA, 20 nt, Artificial Sequence
  B2M targeting sequence
ccuaccuaacaaaccaaacu

SEQ ID NO: 2413 - RNA, 20 nt, Artificial Sequence
  B2M targeting sequence
uaccuaacaaaccaaacuuc

SEQ ID NO: 2414 - RNA, 20 nt, Artificial Sequence
  B2M targeting sequence
ccauuuccucacaucauucc

SEQ ID NO: 2415 - RNA, 20 nt, Artificial Sequence
  B2M targeting sequence
auuuccucacaucauuccuu

SEQ ID NO: 2416 - RNA, 20 nt, Artificial Sequence
  B2M targeting sequence
ucacaucauuccuucaacug

SEQ ID NO: 2417 - RNA, 20 nt, Artificial Sequence
  B2M targeting sequence
uggccucaagugaucugccu

SEQ ID NO: 2418 - RNA, 20 nt, Artificial Sequence
  B2M targeting sequence
aacuccuggccucaagugau

SEQ ID NO: 2419 - RNA, 20 nt, Artificial Sequence
  B2M targeting sequence
caaacuccuggccucaagug

SEQ ID NO: 2420 - RNA, 20 nt, Artificial Sequence
  B2M targeting sequence
ccauguuagccaggcugguc

SEQ ID NO: 2421 - RNA, 20 nt, Artificial Sequence
  B2M targeting sequence
cuacuaaaaauaugaaaauu

SEQ ID NO: 2422 - RNA, 20 nt, Artificial Sequence
  B2M targeting sequence
acuaaaaauaugaaaauuag

SEQ ID NO: 2423 - RNA, 20 nt, Artificial Sequence
  B2M targeting sequence
uauuuuuaguagagauaggg

SEQ ID NO: 2424 - RNA, 20 nt, Artificial Sequence
  B2M targeting sequence
uucagcuacucaggaagcug

SEQ ID NO: 2425 - RNA, 20 nt, Artificial Sequence
  B2M targeting sequence
gcuacucaggaagcugaggc

SEQ ID NO: 2426 - RNA, 20 nt, Artificial Sequence
  B2M targeting sequence
ggaagcugaggcaugagaau

SEQ ID NO: 2427 - RNA, 20 nt, Artificial Sequence
  B2M targeting sequence
ugaguagcugaaagaacagg

SEQ ID NO: 2428 - RNA, 20 nt, Artificial Sequence
  B2M targeting sequence
gcuuccugaguagcugaaag

SEQ ID NO: 2429 - RNA, 20 nt, Artificial Sequence
  B2M targeting sequence
ugccucagcuuccugaguag

SEQ ID NO: 2430 - RNA, 20 nt, Artificial Sequence
  B2M targeting sequence
caugccucagcuuccugagu

SEQ ID NO: 2431 - RNA, 20 nt, Artificial Sequence
  B2M targeting sequence
agcaauucucaugccucagc

SEQ ID NO: 2432 - RNA, 20 nt, Artificial Sequence
  B2M targeting sequence
acccccuggguucaagcaau

SEQ ID NO: 2433 - RNA, 20 nt, Artificial Sequence
  B2M targeting sequence
cugcaaccuccacccccugg

SEQ ID NO: 2434 - RNA, 20 nt, Artificial Sequence
  B2M targeting sequence
gcucacugcaaccuccaccc

SEQ ID NO: 2435 - RNA, 20 nt, Artificial Sequence
  B2M targeting sequence
cagcucacugcaaccuccac

SEQ ID NO: 2436 - RNA, 20 nt, Artificial Sequence
  B2M targeting sequence
agccugggugacagagugag

SEQ ID NO: 2437 - RNA, 20 nt, Artificial Sequence
  B2M targeting sequence
cccaggcuggagggcagugg

SEQ ID NO: 2438 - RNA, 20 nt, Artificial Sequence
  B2M targeting sequence
gucacccaggcuggagggca

SEQ ID NO: 2439 - RNA, 20 nt, Artificial Sequence
  B2M targeting sequence
cucugucacccaggcuggag

SEQ ID NO: 2440 - RNA, 20 nt, Artificial Sequence
  B2M targeting sequence
cacucugucacccaggcugg

SEQ ID NO: 2441 - RNA, 20 nt, Artificial Sequence
  B2M targeting sequence
caaaaaaaaaaaaaaaaaaa

SEQ ID NO: 2442 - RNA, 20 nt, Artificial Sequence
  B2M targeting sequence
aaaaaaaaaaaaaaaaaaaa

SEQ ID NO: 2443 - RNA, 20 nt, Artificial Sequence
  B2M targeting sequence
uuuuuuuuuuuuuuuuuuuu

SEQ ID NO: 2444 - RNA, 20 nt, Artificial Sequence
  B2M targeting sequence
cuuuuuuuuuuuuuuuuuuu

SEQ ID NO: 2445 - RNA, 20 nt, Artificial Sequence
  B2M targeting sequence
gguauuucucuuuuuuuuuu

SEQ ID NO: 2446 - RNA, 20 nt, Artificial Sequence
  B2M targeting sequence
gggaaauuuacaaagaaaag

SEQ ID NO: 2447 - RNA, 20 nt, Artificial Sequence
  B2M targeting sequence
cagacucagguauuucucuu

SEQ ID NO: 2448 - RNA, 20 nt, Artificial Sequence
  B2M targeting sequence
uuguaaauuucccagacuca

SEQ ID NO: 2449 - RNA, 20 nt, Artificial Sequence
  B2M targeting sequence
uuucuuuguaaauuucccag

SEQ ID NO: 2450 - RNA, 20 nt, Artificial Sequence
  B2M targeting sequence
guaggcuguacaaacauagu

SEQ ID NO: 2451 - RNA, 20 nt, Artificial Sequence
  B2M targeting sequence
gcucagcuacuggggagacc

SEQ ID NO: 2452 - RNA, 20 nt, Artificial Sequence
  B2M targeting sequence
gcuacuggggagaccucagg

SEQ ID NO: 2453 - RNA, 20 nt, Artificial Sequence
  B2M targeting sequence
ccaguagcugagcagaugcc

SEQ ID NO: 2454 - RNA, 20 nt, Artificial Sequence
  B2M targeting sequence
ccccaguagcugagcagaug

SEQ ID NO: 2455 - RNA, 20 nt, Artificial Sequence
  B2M targeting sequence
gggagcuuuuacucaucgca

SEQ ID NO: 2456 - RNA, 20 nt, Artificial Sequence
  B2M targeting sequence
cugaggucuccccaguagcu

SEQ ID NO: 2457 - RNA, 20 nt, Artificial Sequence
  B2M targeting sequence
ucgcagaagggugccaggca

SEQ ID NO: 2458 - RNA, 20 nt, Artificial Sequence
  B2M targeting sequence
cagaagggugccaggcacuu

SEQ ID NO: 2459 - RNA, 20 nt, Artificial Sequence
  B2M targeting sequence
gcgaugaguaaaagcucccu

SEQ ID NO: 2460 - RNA, 20 nt, Artificial Sequence
  B2M targeting sequence
caugguaagauuuggagcaa

SEQ ID NO: 2461 - RNA, 20 nt, Artificial Sequence
  B2M targeting sequence
uaccaugugaagugccuggc

SEQ ID NO: 2462 - RNA, 20 nt, Artificial Sequence
  B2M targeting sequence
aaaucuuaccaugugaagug

SEQ ID NO: 2463 - RNA, 20 nt, Artificial Sequence
  B2M targeting sequence
ugcuccaaaucuuaccaugu

SEQ ID NO: 2464 - RNA, 20 nt, Artificial Sequence
  B2M targeting sequence
ccccaccaccucuugcucca

SEQ ID NO: 2465 - RNA, 20 nt, Artificial Sequence
  B2M targeting sequence
cauuuuaccaacaaccagau

SEQ ID NO: 2466 - RNA, 20 nt, Artificial Sequence
  B2M targeting sequence
gguuguugguaaaaugugac

SEQ ID NO: 2467 - RNA, 20 nt, Artificial Sequence
  B2M targeting sequence
cucaagaaugcacucacuau

SEQ ID NO: 2468 - RNA, 20 nt, Artificial Sequence
  B2M targeting sequence
caagaaugcacucacuauug

SEQ ID NO: 2469 - RNA, 20 nt, Artificial Sequence
  B2M targeting sequence
agaaugcacucacuauugug

SEQ ID NO: 2470 - RNA, 20 nt, Artificial Sequence
  B2M targeting sequence
ugagagaucugguuguuggu

SEQ ID NO: 2471 - RNA, 20 nt, Artificial Sequence
  B2M targeting sequence
cuauugugaggacagcacca

SEQ ID NO: 2472 - RNA, 20 nt, Artificial Sequence
  B2M targeting sequence
caauagugagugcauucuug

SEQ ID NO: 2473 - RNA, 20 nt, Artificial Sequence
  B2M targeting sequence
ucacaauagugagugcauuc

SEQ ID NO: 2474 - RNA, 20 nt, Artificial Sequence
  B2M targeting sequence
uggcuuggugcuguccucac

SEQ ID NO: 2475 - RNA, 20 nt, Artificial Sequence
  B2M targeting sequence
cucauggcuuggugcugucc

SEQ ID NO: 2476 - RNA, 20 nt, Artificial Sequence
  B2M targeting sequence
gcccccaugauccaaacacc

SEQ ID NO: 2477 - RNA, 20 nt, Artificial Sequence
  B2M targeting sequence
ugggggcagaucccucaugg

SEQ ID NO: 2478 - RNA, 20 nt, Artificial Sequence
  B2M targeting sequence
aaacaccuaucaccaggccc

SEQ ID NO: 2479 - RNA, 20 nt, Artificial Sequence
  B2M targeting sequence
ccaggccccaccuccaauac

SEQ ID NO: 2480 - RNA, 20 nt, Artificial Sequence
  B2M targeting sequence
aauacuagggauuacaauuc

SEQ ID NO: 2481 - RNA, 20 nt, Artificial Sequence
  B2M targeting sequence
cuaguauuggagguggggcc

SEQ ID NO: 2482 - RNA, 20 nt, Artificial Sequence
  B2M targeting sequence
acaugagauuuggguaggga

SEQ ID NO: 2483 - RNA, 20 nt, Artificial Sequence
  B2M targeting sequence
uguugaauuguaaucccuag

SEQ ID NO: 2484 - RNA, 20 nt, Artificial Sequence
  B2M targeting sequence
cauguugaauuguaaucccu

SEQ ID NO: 2485 - RNA, 20 nt, Artificial Sequence
  B2M targeting sequence
cuacccaaaucucauguuga

SEQ ID NO: 2486 - RNA, 20 nt, Artificial Sequence
  B2M targeting sequence
auauuugucccuacccaaau

SEQ ID NO: 2487 - RNA, 20 nt, Artificial Sequence
  B2M targeting sequence
guugguauuaguucuucuuc

SEQ ID NO: 2488 - RNA, 20 nt, Artificial Sequence
  B2M targeting sequence
ucuucauauguuuaguaaca

SEQ ID NO: 2489 - RNA, 20 nt, Artificial Sequence
  B2M targeting sequence
ucauauguuuaguaacauuu

SEQ ID NO: 2490 - RNA, 20 nt, Artificial Sequence
  B2M targeting sequence
uauguuuaguaacauuuagc

SEQ ID NO: 2491 - RNA, 20 nt, Artificial Sequence
  B2M targeting sequence
cugcuaaauguuacuaaaca

SEQ ID NO: 2492 - RNA, 20 nt, Artificial Sequence
  B2M targeting sequence
ucacugcuaaauguuacuaa

SEQ ID NO: 2493 - RNA, 20 nt, Artificial Sequence
  B2M targeting sequence
augucuucacugcuaaaugu

SEQ ID NO: 2494 - RNA, 20 nt, Artificial Sequence
  B2M targeting sequence
ugggcuuucauuuguuacuu

SEQ ID NO: 2495 - RNA, 20 nt, Artificial Sequence
  B2M targeting sequence
uuuguuacuuguuauugguc

SEQ ID NO: 2496 - RNA, 20 nt, Artificial Sequence
  B2M targeting sequence
guucugguuuuggauuucuu

SEQ ID NO: 2497 - RNA, 20 nt, Artificial Sequence
  B2M targeting sequence
gguuuuggauuucuucaagg

SEQ ID NO: 2498 - RNA, 20 nt, Artificial Sequence
  B2M targeting sequence
aaaaccagaacagaccaaua

SEQ ID NO: 2499 - RNA, 20 nt, Artificial Sequence
  B2M targeting sequence
ucaagguucgaucuuggcag

SEQ ID NO: 2500 - RNA, 20 nt, Artificial Sequence
  B2M targeting sequence
agguucgaucuuggcagguu

SEQ ID NO: 2501 - RNA, 20 nt, Artificial Sequence
  B2M targeting sequence
aucuuggcagguuguaugug

SEQ ID NO: 2502 - RNA, 20 nt, Artificial Sequence
  B2M targeting sequence
aaccuugaagaaauccaaaa

SEQ ID NO: 2503 - RNA, 20 nt, Artificial Sequence
  B2M targeting sequence
uggcagguuguaugugucua

SEQ ID NO: 2504 - RNA, 20 nt, Artificial Sequence
  B2M targeting sequence
aggaauguauccauuucuuc

SEQ ID NO: 2505 - RNA, 20 nt, Artificial Sequence
  B2M targeting sequence
uagacacauacaaccugcca

SEQ ID NO: 2506 - RNA, 20 nt, Artificial Sequence
  B2M targeting sequence
auuucuucuagguuuuccaa

SEQ ID NO: 2507 - RNA, 20 nt, Artificial Sequence
  B2M targeting sequence
ucuagguuuuccaauuuauu

SEQ ID NO: 2508 - RNA, 20 nt, Artificial Sequence
  B2M targeting sequence
agguuuuccaauuuauuggc

SEQ ID NO: 2509 - RNA, 20 nt, Artificial Sequence
  B2M targeting sequence
aauuuauuggcauguaguug

SEQ ID NO: 2510 - RNA, 20 nt, Artificial Sequence
  B2M targeting sequence
uaguagccucuaaugaucgu

SEQ ID NO: 2511 - RNA, 20 nt, Artificial Sequence
  B2M targeting sequence
aaugaucguuugaauuucuu

SEQ ID NO: 2512 - RNA, 20 nt, Artificial Sequence
  B2M targeting sequence
uuagaggcuacuaugagcaa

SEQ ID NO: 2513 - RNA, 20 nt, Artificial Sequence
  B2M targeting sequence
uuugaauuucuuugauauug

SEQ ID NO: 2514 - RNA, 20 nt, Artificial Sequence
  B2M targeting sequence
aacgaucauuagaggcuacu

SEQ ID NO: 2515 - RNA, 20 nt, Artificial Sequence
  B2M targeting sequence
uugauauugguuguaauguu

SEQ ID NO: 2516 - RNA, 20 nt, Artificial Sequence
  B2M targeting sequence
aagaaauucaaacgaucauu

SEQ ID NO: 2517 - RNA, 20 nt, Artificial Sequence
  B2M targeting sequence
uuuuucaucucugauuuuau

SEQ ID NO: 2518 - RNA, 20 nt, Artificial Sequence
  B2M targeting sequence
ucucugauuuuauuuauaug

SEQ ID NO: 2519 - RNA, 20 nt, Artificial Sequence
  B2M targeting sequence
cugauuuuauuuauaugagu

SEQ ID NO: 2520 - RNA, 20 nt, Artificial Sequence
  B2M targeting sequence
gauuuuauuuauaugagucu

SEQ ID NO: 2521 - RNA, 20 nt, Artificial Sequence
  B2M targeting sequence
gagaugaaaaaggaaacauu

SEQ ID NO: 2522 - RNA, 20 nt, Artificial Sequence
  B2M targeting sequence
uauaaauaaaaucagagaug

SEQ ID NO: 2523 - RNA, 20 nt, Artificial Sequence
  B2M targeting sequence
ucucuccuuuuuuucuuagc

SEQ ID NO: 2524 - RNA, 20 nt, Artificial Sequence
  B2M targeting sequence
cuccuuuuuuucuuagcgag

SEQ ID NO: 2525 - RNA, 20 nt, Artificial Sequence
  B2M targeting sequence
ccuuuuuuucuuagcgaguc

SEQ ID NO: 2526 - RNA, 20 nt, Artificial Sequence
  B2M targeting sequence
uuuuuuucuuagcgagucug

SEQ ID NO: 2527 - RNA, 20 nt, Artificial Sequence
  B2M targeting sequence
uagcgagucuggcuaaggaa

SEQ ID NO: 2528 - RNA, 20 nt, Artificial Sequence
  B2M targeting sequence
cuaagaaaaaaaggagagaa

SEQ ID NO: 2529 - RNA, 20 nt, Artificial Sequence
  B2M targeting sequence
ggcuaaggaauuguugauuu

SEQ ID NO: 2530 - RNA, 20 nt, Artificial Sequence
  B2M targeting sequence
uuagccagacucgcuaagaa

SEQ ID NO: 2531 - RNA, 20 nt, Artificial Sequence
  B2M targeting sequence
acaauuccuuagccagacuc

SEQ ID NO: 2532 - RNA, 20 nt, Artificial Sequence
  B2M targeting sequence
uuaaaaaaacaacuuuucuu

SEQ ID NO: 2533 - RNA, 20 nt, Artificial Sequence
  B2M targeting sequence
uuuuguugaucuuuucuauu

SEQ ID NO: 2534 - RNA, 20 nt, Artificial Sequence
  B2M targeting sequence
acaaaaagaaaaguuguuuu

SEQ ID NO: 2535 - RNA, 20 nt, Artificial Sequence
  B2M targeting sequence
uuucuauuguuuccuucauu

SEQ ID NO: 2536 - RNA, 20 nt, Artificial Sequence
  B2M targeting sequence
auuguuuccuucauuucaau

SEQ ID NO: 2537 - RNA, 20 nt, Artificial Sequence
  B2M targeting sequence
uucauuucaauuucauuuau

SEQ ID NO: 2538 - RNA, 20 nt, Artificial Sequence
  B2M targeting sequence
uuucaauuucauuuauuuuu

SEQ ID NO: 2539 - RNA, 20 nt, Artificial Sequence
  B2M targeting sequence
auuucauuuauuuuugcucu

SEQ ID NO: 2540 - RNA, 20 nt, Artificial Sequence
  B2M targeting sequence
uuuauuuuugcucucaucuu

SEQ ID NO: 2541 - RNA, 20 nt, Artificial Sequence
  B2M targeting sequence
caucuuuauuauuucuuucc

SEQ ID NO: 2542 - RNA, 20 nt, Artificial Sequence
  B2M targeting sequence
ucuuuauuauuucuuuccuu

SEQ ID NO: 2543 - RNA, 20 nt, Artificial Sequence
  B2M targeting sequence
uuauuauuucuuuccuucua

SEQ ID NO: 2544 - RNA, 20 nt, Artificial Sequence
  B2M targeting sequence
uuccuucuaauaauuuuggg

SEQ ID NO: 2545 - RNA, 20 nt, Artificial Sequence
  B2M targeting sequence
uucuaauaauuuuggguuug

SEQ ID NO: 2546 - RNA, 20 nt, Artificial Sequence
  B2M targeting sequence
aauaauuuuggguuuggcuu

SEQ ID NO: 2547 - RNA, 20 nt, Artificial Sequence
  B2M targeting sequence
ugcuuuucuaguucuuugaa

SEQ ID NO: 2548 - RNA, 20 nt, Artificial Sequence
  B2M targeting sequence
aguucuuugaaaugcaucau

SEQ ID NO: 2549 - RNA, 20 nt, Artificial Sequence
  B2M targeting sequence
uugaaaugcaucauuauguu

SEQ ID NO: 2550 - RNA, 20 nt, Artificial Sequence
  B2M targeting sequence
aagaacuagaaaagcaagag

SEQ ID NO: 2551 - RNA, 20 nt, Artificial Sequence
  B2M targeting sequence
uuauguuguuuauuugaagu

SEQ ID NO: 2552 - RNA, 20 nt, Artificial Sequence
  B2M targeting sequence
aauaaacaacauaaugaugc

SEQ ID NO: 2553 - RNA, 20 nt, Artificial Sequence
  B2M targeting sequence
guuuuucuuuuuuaauguag

SEQ ID NO: 2554 - RNA, 20 nt, Artificial Sequence
  B2M targeting sequence
uuuuuaauguaggugcuuau

SEQ ID NO: 2555 - RNA, 20 nt, Artificial Sequence
  B2M targeting sequence
ucuuauuacugccuucucug

SEQ ID NO: 2556 - RNA, 20 nt, Artificial Sequence
  B2M targeting sequence
uauuacugccuucucuguau

SEQ ID NO: 2557 - RNA, 20 nt, Artificial Sequence
  B2M targeting sequence
cuguaucccauagguuuugg

SEQ ID NO: 2558 - RNA, 20 nt, Artificial Sequence
  B2M targeting sequence
guaucccauagguuuuggua

SEQ ID NO: 2559 - RNA, 20 nt, Artificial Sequence
  B2M targeting sequence
cauagguuuugguauauugu

SEQ ID NO: 2560 - RNA, 20 nt, Artificial Sequence
  B2M targeting sequence
auuaucauuuguuuccagaa

SEQ ID NO: 2561 - RNA, 20 nt, Artificial Sequence
  B2M targeting sequence
uuuguuuccagaauuuaaaa

SEQ ID NO: 2562 - RNA, 20 nt, Artificial Sequence
  B2M targeting sequence
agaauuuaaaaaauuuccuu

SEQ ID NO: 2563 - RNA, 20 nt, Artificial Sequence
  B2M targeting sequence
ggaaacaaaugauaauggaa

SEQ ID NO: 2564 - RNA, 20 nt, Artificial Sequence
  B2M targeting sequence
uucuuaauuucuuuguugac

SEQ ID NO: 2565 - RNA, 20 nt, Artificial Sequence
  B2M targeting sequence
uaauuucuuuguugacccac

SEQ ID NO: 2566 - RNA, 20 nt, Artificial Sequence
  B2M targeting sequence
uuguugacccacagucacuu

SEQ ID NO: 2567 - RNA, 20 nt, Artificial Sequence
  B2M targeting sequence
acaaagaaauuaagaaggaa

SEQ ID NO: 2568 - RNA, 20 nt, Artificial Sequence
  B2M targeting sequence
cuuaggagcauauuuuaauu

SEQ ID NO: 2569 - RNA, 20 nt, Artificial Sequence
  B2M targeting sequence
uaagugacugugggucaaca

SEQ ID NO: 2570 - RNA, 20 nt, Artificial Sequence
  B2M targeting sequence
auauauuuguaugguuucaa

SEQ ID NO: 2571 - RNA, 20 nt, Artificial Sequence
  B2M targeting sequence
aacauuccucuuguuauuga

SEQ ID NO: 2572 - RNA, 20 nt, Artificial Sequence
  B2M targeting sequence
ucuuguuauugauuucuagu

SEQ ID NO: 2573 - RNA, 20 nt, Artificial Sequence
  B2M targeting sequence
uguuauugauuucuaguuuu

SEQ ID NO: 2574 - RNA, 20 nt, Artificial Sequence
  B2M targeting sequence
auaacaagaggaauguuuga

SEQ ID NO: 2575 - RNA, 20 nt, Artificial Sequence
  B2M targeting sequence
aguuuuuuuccauugugguc

SEQ ID NO: 2576 - RNA, 20 nt, Artificial Sequence
  B2M targeting sequence
auuguggucagagaagauau

SEQ ID NO: 2577 - RNA, 20 nt, Artificial Sequence
  B2M targeting sequence
gagaagauauuugauauaau

SEQ ID NO: 2578 - RNA, 20 nt, Artificial Sequence
  B2M targeting sequence
gaccacaauggaaaaaaacu

SEQ ID NO: 2579 - RNA, 20 nt, Artificial Sequence
  B2M targeting sequence
cugaccacaauggaaaaaaa

SEQ ID NO: 2580 - RNA, 20 nt, Artificial Sequence
  B2M targeting sequence
ucucugaccacaauggaaaa

SEQ ID NO: 2581 - RNA, 20 nt, Artificial Sequence
  B2M targeting sequence
aauaucuucucugaccacaa

SEQ ID NO: 2582 - RNA, 20 nt, Artificial Sequence
  B2M targeting sequence
aauuuuuuaagacuuauuuu

SEQ ID NO: 2583 - RNA, 20 nt, Artificial Sequence
  B2M targeting sequence
uaaaaaauuggaauuauauc

SEQ ID NO: 2584 - RNA, 20 nt, Artificial Sequence
  B2M targeting sequence
aacauauggucuauccuuga

SEQ ID NO: 2585 - RNA, 20 nt, Artificial Sequence
  B2M targeting sequence
auccuugagaaugauccaug

SEQ ID NO: 2586 - RNA, 20 nt, Artificial Sequence
  B2M targeting sequence
uugagaaugauccaugugcu

SEQ ID NO: 2587 - RNA, 20 nt, Artificial Sequence
  B2M targeting sequence
aggauagaccauauguuaga

SEQ ID NO: 2588 - RNA, 20 nt, Artificial Sequence
  B2M targeting sequence
caaggauagaccauauguua

SEQ ID NO: 2589 - RNA, 20 nt, Artificial Sequence
  B2M targeting sequence
uucucaaggauagaccauau

SEQ ID NO: 2590 - RNA, 20 nt, Artificial Sequence
  B2M targeting sequence
augugcugaggagaagaaug

SEQ ID NO: 2591 - RNA, 20 nt, Artificial Sequence
  B2M targeting sequence
gcacauggaucauucucaag

SEQ ID NO: 2592 - RNA, 20 nt, Artificial Sequence
  B2M targeting sequence
ucagcacauggaucauucuc

SEQ ID NO: 2593 - RNA, 20 nt, Artificial Sequence
  B2M targeting sequence
ccucagcacauggaucauuc

SEQ ID NO: 2594 - RNA, 20 nt, Artificial Sequence
  B2M targeting sequence
ucuccucagcacauggauca

SEQ ID NO: 2595 - RNA, 20 nt, Artificial Sequence
  B2M targeting sequence
guagccauuggauaaaaugu

SEQ ID NO: 2596 - RNA, 20 nt, Artificial Sequence
  B2M targeting sequence
aauggcuacagaauacccau

SEQ ID NO: 2597 - RNA, 20 nt, Artificial Sequence
  B2M targeting sequence
guaaauaucuauuagaucug

SEQ ID NO: 2598 - RNA, 20 nt, Artificial Sequence
  B2M targeting sequence
auuagaucuggccaggcacg

SEQ ID NO: 2599 - RNA, 20 nt, Artificial Sequence
  B2M targeting sequence
aauagauauuuacagaacau

SEQ ID NO: 2600 - RNA, 20 nt, Artificial Sequence
  B2M targeting sequence
ggccaggcacgguggcucau

SEQ ID NO: 2601 - RNA, 20 nt, Artificial Sequence
  B2M targeting sequence
ugccuguaacuccagcacuu

SEQ ID NO: 2602 - RNA, 20 nt, Artificial Sequence
  B2M targeting sequence
agcacuuugggaggccaagg

SEQ ID NO: 2603 - RNA, 20 nt, Artificial Sequence
  B2M targeting sequence
caaagugcuggaguuacagg

SEQ ID NO: 2604 - RNA, 20 nt, Artificial Sequence
  B2M targeting sequence
accugccuuggccucccaaa

SEQ ID NO: 2605 - RNA, 20 nt, Artificial Sequence
  B2M targeting sequence
caaggucaggagaucaagac

SEQ ID NO: 2606 - RNA, 20 nt, Artificial Sequence
  B2M targeting sequence
ggagaucaagaccauccuga

SEQ ID NO: 2607 - RNA, 20 nt, Artificial Sequence
  B2M targeting sequence
ugaccuugugauccaccugc

SEQ ID NO: 2608 - RNA, 20 nt, Artificial Sequence
  B2M targeting sequence
ccugaccuugugauccaccu

SEQ ID NO: 2609 - RNA, 20 nt, Artificial Sequence
  B2M targeting sequence
agaccauccugacuaacgug

SEQ ID NO: 2610 - RNA, 20 nt, Artificial Sequence
  B2M targeting sequence
ugaucuccugaccuugugau

SEQ ID NO: 2611 - RNA, 20 nt, Artificial Sequence
  B2M targeting sequence
ugacuaacguggagaaaccc

SEQ ID NO: 2612 - RNA, 20 nt, Artificial Sequence
  B2M targeting sequence
ggauggucuugaucuccuga

SEQ ID NO: 2613 - RNA, 20 nt, Artificial Sequence
  B2M targeting sequence
acguuagucaggauggucuu

SEQ ID NO: 2614 - RNA, 20 nt, Artificial Sequence
  B2M targeting sequence
ccacguuagucaggaugguc

SEQ ID NO: 2615 - RNA, 20 nt, Artificial Sequence
  B2M targeting sequence
guacuaaaaauacaaaaaaa

SEQ ID NO: 2616 - RNA, 20 nt, Artificial Sequence
  B2M targeting sequence
ccaccaugcccagcuaauuu

SEQ ID NO: 2617 - RNA, 20 nt, Artificial Sequence
  B2M targeting sequence
cagcuacucaggaggcugag

SEQ ID NO: 2618 - RNA, 20 nt, Artificial Sequence
  B2M targeting sequence
ggaggcugaggcaggagaau

SEQ ID NO: 2619 - RNA, 20 nt, Artificial Sequence
  B2M targeting sequence
ugaguagcugggacuacggg

SEQ ID NO: 2620 - RNA, 20 nt, Artificial Sequence
  B2M targeting sequence
gccuccugaguagcugggac

SEQ ID NO: 2621 - RNA, 20 nt, Artificial Sequence
  B2M targeting sequence
ugccucagccuccugaguag

SEQ ID NO: 2622 - RNA, 20 nt, Artificial Sequence
  B2M targeting sequence
ccugccucagccuccugagu

SEQ ID NO: 2623 - RNA, 20 nt, Artificial Sequence
  B2M targeting sequence
caccauucuccugccucagc

SEQ ID NO: 2624 - RNA, 20 nt, Artificial Sequence
  B2M targeting sequence
cagguucacaccauucuccu

SEQ ID NO: 2625 - RNA, 20 nt, Artificial Sequence
  B2M targeting sequence
accucccagguucacaccau

SEQ ID NO: 2626 - RNA, 20 nt, Artificial Sequence
  B2M targeting sequence
gcuuacugcaagcuccaccu

SEQ ID NO: 2627 - RNA, 20 nt, Artificial Sequence
  B2M targeting sequence
cagcuuacugcaagcuccac

SEQ ID NO: 2628 - RNA, 20 nt, Artificial Sequence
  B2M targeting sequence
caccacugcacuccagccug

SEQ ID NO: 2629 - RNA, 20 nt, Artificial Sequence
  B2M targeting sequence
agccugggcaacagagcaag

SEQ ID NO: 2630 - RNA, 20 nt, Artificial Sequence
  B2M targeting sequence
guugcccaggcuggagugca

SEQ ID NO: 2631 - RNA, 20 nt, Artificial Sequence
  B2M targeting sequence
ugcucuguugcccaggcugg

SEQ ID NO: 2632 - RNA, 20 nt, Artificial Sequence
  B2M targeting sequence
caaaaaagaaaaaaucuauu

SEQ ID NO: 2633 - RNA, 20 nt, Artificial Sequence
  B2M targeting sequence
aaaaagaaaaaaucuauuag

SEQ ID NO: 2634 - RNA, 20 nt, Artificial Sequence
  B2M targeting sequence
uuuuugagaugcagucuugc

SEQ ID NO: 2635 - RNA, 20 nt, Artificial Sequence
  B2M targeting sequence
auuagagccauuugaucuau

SEQ ID NO: 2636 - RNA, 20 nt, Artificial Sequence
  B2M targeting sequence
aauagauuuuuucuuuuuug

SEQ ID NO: 2637 - RNA, 20 nt, Artificial Sequence
  B2M targeting sequence
aauggcucuaauagauuuuu

SEQ ID NO: 2638 - RNA, 20 nt, Artificial Sequence
  B2M targeting sequence
auagugcagauuaagucuga

SEQ ID NO: 2639 - RNA, 20 nt, Artificial Sequence
  B2M targeting sequence
gcacuauagaucaaauggcu

SEQ ID NO: 2640 - RNA, 20 nt, Artificial Sequence
  B2M targeting sequence
gauguuucuuuguugauuuu

SEQ ID NO: 2641 - RNA, 20 nt, Artificial Sequence
  B2M targeting sequence
gacuuaaucugcacuauaga

SEQ ID NO: 2642 - RNA, 20 nt, Artificial Sequence
  B2M targeting sequence
uuguugauuuucagucugga

SEQ ID NO: 2643 - RNA, 20 nt, Artificial Sequence
  B2M targeting sequence
acaaagaaacaucagacuua

SEQ ID NO: 2644 - RNA, 20 nt, Artificial Sequence
  B2M targeting sequence
gucuggaugaucuguccaau

SEQ ID NO: 2645 - RNA, 20 nt, Artificial Sequence
  B2M targeting sequence
ggaugaucuguccaaugcug

SEQ ID NO: 2646 - RNA, 20 nt, Artificial Sequence
  B2M targeting sequence
agacugaaaaucaacaaaga

SEQ ID NO: 2647 - RNA, 20 nt, Artificial Sequence
  B2M targeting sequence
uccagacugaaaaucaacaa

SEQ ID NO: 2648 - RNA, 20 nt, Artificial Sequence
  B2M targeting sequence
guccaaugcugaaagugggg

SEQ ID NO: 2649 - RNA, 20 nt, Artificial Sequence
  B2M targeting sequence
aaugcugaaagugggguguu

SEQ ID NO: 2650 - RNA, 20 nt, Artificial Sequence
  B2M targeting sequence
gcauuggacagaucauccag

SEQ ID NO: 2651 - RNA, 20 nt, Artificial Sequence
  B2M targeting sequence
acaccccacuuucagcauug

SEQ ID NO: 2652 - RNA, 20 nt, Artificial Sequence
  B2M targeting sequence
ccagcuauuauuguauuggg

SEQ ID NO: 2653 - RNA, 20 nt, Artificial Sequence
  B2M targeting sequence
agcuauuauuguauuggggu

SEQ ID NO: 2654 - RNA, 20 nt, Artificial Sequence
  B2M targeting sequence
aucucucucuuuagcucuaa

SEQ ID NO: 2655 - RNA, 20 nt, Artificial Sequence
  B2M targeting sequence
cucucuuuagcucuaauaau

SEQ ID NO: 2656 - RNA, 20 nt, Artificial Sequence
  B2M targeting sequence
cucuuuagcucuaauaauau

SEQ ID NO: 2657 - RNA, 20 nt, Artificial Sequence
  B2M targeting sequence
cuuuagcucuaauaauauuu

SEQ ID NO: 2658 - RNA, 20 nt, Artificial Sequence
  B2M targeting sequence
uuagcucuaauaauauuuac

SEQ ID NO: 2659 - RNA, 20 nt, Artificial Sequence
  B2M targeting sequence
aauaauauuuacuuuauaua

SEQ ID NO: 2660 - RNA, 20 nt, Artificial Sequence
  B2M targeting sequence
aguuggaaugcauauauuuu

SEQ ID NO: 2661 - RNA, 20 nt, Artificial Sequence
  B2M targeting sequence
aacuggagcacccagcuaua

SEQ ID NO: 2662 - RNA, 20 nt, Artificial Sequence
  B2M targeting sequence
ggccgaauuaaccucuuuuc

SEQ ID NO: 2663 - RNA, 20 nt, Artificial Sequence
  B2M targeting sequence
gccagaguauauaacaauug

SEQ ID NO: 2664 - RNA, 20 nt, Artificial Sequence
  B2M targeting sequence
uuucauuauauaaugaccuu

SEQ ID NO: 2665 - RNA, 20 nt, Artificial Sequence
  B2M targeting sequence
uuauauaaugaccuucuuug

SEQ ID NO: 2666 - RNA, 20 nt, Artificial Sequence
  B2M targeting sequence
uuauauaaugaaaagagguu

SEQ ID NO: 2667 - RNA, 20 nt, Artificial Sequence
  B2M targeting sequence
uugucucuuuuuauaguuuu

SEQ ID NO: 2668 - RNA, 20 nt, Artificial Sequence
  B2M targeting sequence
cuuuuuauaguuuuugucuu

SEQ ID NO: 2669 - RNA, 20 nt, Artificial Sequence
  B2M targeting sequence
uuuuauaguuuuugucuuga

SEQ ID NO: 2670 - RNA, 20 nt, Artificial Sequence
  B2M targeting sequence
ugaaaucuauuuugucugau

SEQ ID NO: 2671 - RNA, 20 nt, Artificial Sequence
  B2M targeting sequence
agacaaaaacuauaaaaaga

SEQ ID NO: 2672 - RNA, 20 nt, Artificial Sequence
  B2M targeting sequence
auuuugucugauguaagcau

SEQ ID NO: 2673 - RNA, 20 nt, Artificial Sequence
  B2M targeting sequence
gauguaagcauagcuauuca

SEQ ID NO: 2674 - RNA, 20 nt, Artificial Sequence
  B2M targeting sequence
gacaaaauagauuucaagac

SEQ ID NO: 2675 - RNA, 20 nt, Artificial Sequence
  B2M targeting sequence
ugauccuuuuugguuuccau

SEQ ID NO: 2676 - RNA, 20 nt, Artificial Sequence
  B2M targeting sequence
ugaauagcuaugcuuacauc

SEQ ID NO: 2677 - RNA, 20 nt, Artificial Sequence
  B2M targeting sequence
uuuuugguuuccauuggaau

SEQ ID NO: 2678 - RNA, 20 nt, Artificial Sequence
  B2M targeting sequence
auuggaauggaauauauuuu

SEQ ID NO: 2679 - RNA, 20 nt, Artificial Sequence
  B2M targeting sequence
aauggaaaccaaaaaggauc

SEQ ID NO: 2680 - RNA, 20 nt, Artificial Sequence
  B2M targeting sequence
auuccaauggaaaccaaaaa

SEQ ID NO: 2681 - RNA, 20 nt, Artificial Sequence
  B2M targeting sequence
aucccuuuguuuuagucuau

SEQ ID NO: 2682 - RNA, 20 nt, Artificial Sequence
  B2M targeting sequence
cuuuguuuuagucuaugugu

SEQ ID NO: 2683 - RNA, 20 nt, Artificial Sequence
  B2M targeting sequence
augugugucuuuauggguga

SEQ ID NO: 2684 - RNA, 20 nt, Artificial Sequence
  B2M targeting sequence
uuaugggugaagugugcucc

SEQ ID NO: 2685 - RNA, 20 nt, Artificial Sequence
  B2M targeting sequence
cccauaaagacacacauaga

SEQ ID NO: 2686 - RNA, 20 nt, Artificial Sequence
  B2M targeting sequence
uuguaggcaacaaaucaccg

SEQ ID NO: 2687 - RNA, 20 nt, Artificial Sequence
  B2M targeting sequence
ccgggucuugcuuuuuuuuu

SEQ ID NO: 2688 - RNA, 20 nt, Artificial Sequence
  B2M targeting sequence
ugcuuuuuuuuuuuuuuuuu

SEQ ID NO: 2689 - RNA, 20 nt, Artificial Sequence
  B2M targeting sequence
auucagccacucuaugucuu

SEQ ID NO: 2690 - RNA, 20 nt, Artificial Sequence
  B2M targeting sequence
gccacucuaugucuuuugaa

SEQ ID NO: 2691 - RNA, 20 nt, Artificial Sequence
  B2M targeting sequence
augucuuuugaauggagagu

SEQ ID NO: 2692 - RNA, 20 nt, Artificial Sequence
  B2M targeting sequence
uuugaauggagaguuuaguc

SEQ ID NO: 2693 - RNA, 20 nt, Artificial Sequence
  B2M targeting sequence
aaagacauagaguggcugaa

SEQ ID NO: 2694 - RNA, 20 nt, Artificial Sequence
  B2M targeting sequence
auucaaaagacauagagugg

SEQ ID NO: 2695 - RNA, 20 nt, Artificial Sequence
  B2M targeting sequence
ccauucaaaagacauagagu

SEQ ID NO: 2696 - RNA, 20 nt, Artificial Sequence
  B2M targeting sequence
auuuagauucaauguuauua

SEQ ID NO: 2697 - RNA, 20 nt, Artificial Sequence
  B2M targeting sequence
aaauggacuaaacucuccau

SEQ ID NO: 2698 - RNA, 20 nt, Artificial Sequence
  B2M targeting sequence
auguuauuauugauaaguaa

SEQ ID NO: 2699 - RNA, 20 nt, Artificial Sequence
  B2M targeting sequence
auaauaacauugaaucuaaa

SEQ ID NO: 2700 - RNA, 20 nt, Artificial Sequence
  B2M targeting sequence
uuacuuaucaauaauaacau

SEQ ID NO: 2701 - RNA, 20 nt, Artificial Sequence
  B2M targeting sequence
ugccauuuuguuauuuguuu

SEQ ID NO: 2702 - RNA, 20 nt, Artificial Sequence
  B2M targeting sequence
aguuguuuugugguccucug

SEQ ID NO: 2703 - RNA, 20 nt, Artificial Sequence
  B2M targeting sequence
ucuguuccuuccuucuuuug

SEQ ID NO: 2704 - RNA, 20 nt, Artificial Sequence
  B2M targeting sequence
guuccuuccuucuuuuguuc

SEQ ID NO: 2705 - RNA, 20 nt, Artificial Sequence
  B2M targeting sequence
uuccuucuuuuguuccuguc

SEQ ID NO: 2706 - RNA, 20 nt, Artificial Sequence
  B2M targeting sequence
uucuuuuguuccugucuucc

SEQ ID NO: 2707 - RNA, 20 nt, Artificial Sequence
  B2M targeting sequence
uuuguuccugucuuccuuuc

SEQ ID NO: 2708 - RNA, 20 nt, Artificial Sequence
  B2M targeting sequence
ugucuuccuuucugugaagg

SEQ ID NO: 2709 - RNA, 20 nt, Artificial Sequence
  B2M targeting sequence
uccuuucugugaaggugauu

SEQ ID NO: 2710 - RNA, 20 nt, Artificial Sequence
  B2M targeting sequence
uuucugugaaggugauuuuc

SEQ ID NO: 2711 - RNA, 20 nt, Artificial Sequence
  B2M targeting sequence
gugaaggugauuuucucugg

SEQ ID NO: 2712 - RNA, 20 nt, Artificial Sequence
  B2M targeting sequence
cagaaaggaagacaggaaca

SEQ ID NO: 2713 - RNA, 20 nt, Artificial Sequence
  B2M targeting sequence
ccuucacagaaaggaagaca

SEQ ID NO: 2714 - RNA, 20 nt, Artificial Sequence
  B2M targeting sequence
cugguaguauuuaaaaauuu

SEQ ID NO: 2715 - RNA, 20 nt, Artificial Sequence
  B2M targeting sequence
gguaguauuuaaaaauuucu

SEQ ID NO: 2716 - RNA, 20 nt, Artificial Sequence
  B2M targeting sequence
ugcuuuuuauuuuuugugua

SEQ ID NO: 2717 - RNA, 20 nt, Artificial Sequence
  B2M targeting sequence
guuguauguuguuuugggga

SEQ ID NO: 2718 - RNA, 20 nt, Artificial Sequence
  B2M targeting sequence
ccaaaacaacauacaacaga

SEQ ID NO: 2719 - RNA, 20 nt, Artificial Sequence
  B2M targeting sequence
aaaaaaguccccaaaacaac

SEQ ID NO: 2720 - RNA, 20 nt, Artificial Sequence
  B2M targeting sequence
caaaaaaaguccccaaaaca

SEQ ID NO: 2721 - RNA, 20 nt, Artificial Sequence
  B2M targeting sequence
ccaucucaaaaaaagucccc

SEQ ID NO: 2722 - RNA, 20 nt, Artificial Sequence
  B2M targeting sequence
cgcuuugucacccaggcugg

SEQ ID NO: 2723 - RNA, 20 nt, Artificial Sequence
  B2M targeting sequence
cuuugucacccaggcuggag

SEQ ID NO: 2724 - RNA, 20 nt, Artificial Sequence
  B2M targeting sequence
cccaggcuggagugcagugg

SEQ ID NO: 2725 - RNA, 20 nt, Artificial Sequence
  B2M targeting sequence
agccugggugacaaagcgag

SEQ ID NO: 2726 - RNA, 20 nt, Artificial Sequence
  B2M targeting sequence
caccacugcacuccagccug

SEQ ID NO: 2727 - RNA, 20 nt, Artificial Sequence
  B2M targeting sequence
uggcucacugcaaccucugc

SEQ ID NO: 2728 - RNA, 20 nt, Artificial Sequence
  B2M targeting sequence
cugcaaccucugccuuucag

SEQ ID NO: 2729 - RNA, 20 nt, Artificial Sequence
  B2M targeting sequence
gccuuucaggcucaagugau

SEQ ID NO: 2730 - RNA, 20 nt, Artificial Sequence
  B2M targeting sequence
ggcucaagugaucugcccau

SEQ ID NO: 2731 - RNA, 20 nt, Artificial Sequence
  B2M targeting sequence
agugaucugcccaucucagc

SEQ ID NO: 2732 - RNA, 20 nt, Artificial Sequence
  B2M targeting sequence
cuugagccugaaaggcagag

SEQ ID NO: 2733 - RNA, 20 nt, Artificial Sequence
  B2M targeting sequence
gcccaucucagccucccaag

SEQ ID NO: 2734 - RNA, 20 nt, Artificial Sequence
  B2M targeting sequence
cagccucccaaguaguuggg

SEQ ID NO: 2735 - RNA, 20 nt, Artificial Sequence
  B2M targeting sequence
gccucccaaguaguugggac

SEQ ID NO: 2736 - RNA, 20 nt, Artificial Sequence
  B2M targeting sequence
caaguaguugggaccacagg

SEQ ID NO: 2737 - RNA, 20 nt, Artificial Sequence
  B2M targeting sequence
caacuacuugggaggcugag

SEQ ID NO: 2738 - RNA, 20 nt, Artificial Sequence
  B2M targeting sequence
ccuguggucccaacuacuug

SEQ ID NO: 2739 - RNA, 20 nt, Artificial Sequence
  B2M targeting sequence
ggcuaauuuuuuuuuuuuuu

SEQ ID NO: 2740 - RNA, 20 nt, Artificial Sequence
  B2M targeting sequence
accaaaaaaaaaaaaaaaaa

SEQ ID NO: 2741 - RNA, 20 nt, Artificial Sequence
  B2M targeting sequence
cuaccaaaaaaaaaaaaaaa

SEQ ID NO: 2742 - RNA, 20 nt, Artificial Sequence
  B2M targeting sequence
acaaaagugcuugucucuac

SEQ ID NO: 2743 - RNA, 20 nt, Artificial Sequence
  B2M targeting sequence
cuacaaaagugcuugucucu

SEQ ID NO: 2744 - RNA, 20 nt, Artificial Sequence
  B2M targeting sequence
ccaccguguuuuccaggcug

SEQ ID NO: 2745 - RNA, 20 nt, Artificial Sequence
  B2M targeting sequence
aggcugguuucaaacuccug

SEQ ID NO: 2746 - RNA, 20 nt, Artificial Sequence
  B2M targeting sequence
aacuccugagcucaagccaa

SEQ ID NO: 2747 - RNA, 20 nt, Artificial Sequence
  B2M targeting sequence
ugagcucaagccaaaggccu

SEQ ID NO: 2748 - RNA, 20 nt, Artificial Sequence
  B2M targeting sequence
ggaguuugaaaccagccugg

SEQ ID NO: 2749 - RNA, 20 nt, Artificial Sequence
  B2M targeting sequence
agccaaaggccugcuuuggc

SEQ ID NO: 2750 - RNA, 20 nt, Artificial Sequence
  B2M targeting sequence
caaagugcuaggauuacaag

SEQ ID NO: 2751 - RNA, 20 nt, Artificial Sequence
  B2M targeting sequence
uagcacuuugggaggccaaa

SEQ ID NO: 2752 - RNA, 20 nt, Artificial Sequence
  B2M targeting sequence
cacuuguaauccuagcacuu

SEQ ID NO: 2753 - RNA, 20 nt, Artificial Sequence
  B2M targeting sequence
uggccccuguuguaugcuuu

SEQ ID NO: 2754 - RNA, 20 nt, Artificial Sequence
  B2M targeting sequence
gguuaccauaaggcuuguau

SEQ ID NO: 2755 - RNA, 20 nt, Artificial Sequence
  B2M targeting sequence
caacauaacccauuauuuua

SEQ ID NO: 2756 - RNA, 20 nt, Artificial Sequence
  B2M targeting sequence
uugguuuaaaauaauggguu

SEQ ID NO: 2757 - RNA, 20 nt, Artificial Sequence
  B2M targeting sequence
gugguaaguuuucauugguu

SEQ ID NO: 2758 - RNA, 20 nt, Artificial Sequence
  B2M targeting sequence
uuauuuauguaaucaguggu

SEQ ID NO: 2759 - RNA, 20 nt, Artificial Sequence
  B2M targeting sequence
uugcuucuuuauuuauguaa

SEQ ID NO: 2760 - RNA, 20 nt, Artificial Sequence
  B2M targeting sequence
acauuuuaacuuuguccucc

SEQ ID NO: 2761 - RNA, 20 nt, Artificial Sequence
  B2M targeting sequence
uccugcuuuuuaauucuuug

SEQ ID NO: 2762 - RNA, 20 nt, Artificial Sequence
  B2M targeting sequence
ugcuuuuuaauucuuuguug

SEQ ID NO: 2763 - RNA, 20 nt, Artificial Sequence
  B2M targeting sequence
uuguuguuuguguuuguguc

SEQ ID NO: 2764 - RNA, 20 nt, Artificial Sequence
  B2M targeting sequence
uauuguacugucuaugucuu

SEQ ID NO: 2765 - RNA, 20 nt, Artificial Sequence
  B2M targeting sequence
augucuugaaaaguuguuau

SEQ ID NO: 2766 - RNA, 20 nt, Artificial Sequence
  B2M targeting sequence
ugaaaaguuguuauaguuau

SEQ ID NO: 2767 - RNA, 20 nt, Artificial Sequence
  B2M targeting sequence
agacauagacaguacaauau

SEQ ID NO: 2768 - RNA, 20 nt, Artificial Sequence
  B2M targeting sequence
aaacuaauaacuauaacaac

SEQ ID NO: 2769 - RNA, 20 nt, Artificial Sequence
  B2M targeting sequence
gcuuuuggucuuuccacuca

SEQ ID NO: 2770 - RNA, 20 nt, Artificial Sequence
  B2M targeting sequence
uuccacucaagauaugagua

SEQ ID NO: 2771 - RNA, 20 nt, Artificial Sequence
  B2M targeting sequence
acucaagauaugaguaguuu

SEQ ID NO: 2772 - RNA, 20 nt, Artificial Sequence
  B2M targeting sequence
agauaugaguaguuuacaua

SEQ ID NO: 2773 - RNA, 20 nt, Artificial Sequence
  B2M targeting sequence
ugaguggaaagaccaaaagc

SEQ ID NO: 2774 - RNA, 20 nt, Artificial Sequence
  B2M targeting sequence
uaucuugaguggaaagacca

SEQ ID NO: 2775 - RNA, 20 nt, Artificial Sequence
  B2M targeting sequence
ugguauguaaacuacucaua

SEQ ID NO: 2776 - RNA, 20 nt, Artificial Sequence
  B2M targeting sequence
guuuuuuuucuguguacuuc

SEQ ID NO: 2777 - RNA, 20 nt, Artificial Sequence
  B2M targeting sequence
guguacuuccaauuaccagu

SEQ ID NO: 2778 - RNA, 20 nt, Artificial Sequence
  B2M targeting sequence
aauuaccagugaguuuuaca

SEQ ID NO: 2779 - RNA, 20 nt, Artificial Sequence
  B2M targeting sequence
cugguaauuggaaguacaca

SEQ ID NO: 2780 - RNA, 20 nt, Artificial Sequence
  B2M targeting sequence
aauuauuuuucauugcucau

SEQ ID NO: 2781 - RNA, 20 nt, Artificial Sequence
  B2M targeting sequence
uugcucauuaauguccuuuu

SEQ ID NO: 2782 - RNA, 20 nt, Artificial Sequence
  B2M targeting sequence
uuaauguccuuuucuuucug

SEQ ID NO: 2783 - RNA, 20 nt, Artificial Sequence
  B2M targeting sequence
uuuucuuucugauuaaagaa

SEQ ID NO: 2784 - RNA, 20 nt, Artificial Sequence
  B2M targeting sequence
uucugauuaaagaacucccu

SEQ ID NO: 2785 - RNA, 20 nt, Artificial Sequence
  B2M targeting sequence
gauuaaagaacucccuucag

SEQ ID NO: 2786 - RNA, 20 nt, Artificial Sequence
  B2M targeting sequence
gaaagaaaaggacauuaaug

SEQ ID NO: 2787 - RNA, 20 nt, Artificial Sequence
  B2M targeting sequence
uuaaucagaaagaaaaggac

SEQ ID NO: 2788 - RNA, 20 nt, Artificial Sequence
  B2M targeting sequence
cuucagcauuucuuguagga

SEQ ID NO: 2789 - RNA, 20 nt, Artificial Sequence
  B2M targeting sequence
gcauuucuuguaggacaggu

SEQ ID NO: 2790 - RNA, 20 nt, Artificial Sequence
  B2M targeting sequence
uguaggacaggucugguguu

SEQ ID NO: 2791 - RNA, 20 nt, Artificial Sequence
  B2M targeting sequence
uacaagaaaugcugaaggga

SEQ ID NO: 2792 - RNA, 20 nt, Artificial Sequence
  B2M targeting sequence
gguguugaugaaaucccuca

SEQ ID NO: 2793 - RNA, 20 nt, Artificial Sequence
  B2M targeting sequence
acaccagaccuguccuacaa

SEQ ID NO: 2794 - RNA, 20 nt, Artificial Sequence
  B2M targeting sequence
ucaacaccagaccuguccua

SEQ ID NO: 2795 - RNA, 20 nt, Artificial Sequence
  B2M targeting sequence
cucaacuuuuguuugucuag

SEQ ID NO: 2796 - RNA, 20 nt, Artificial Sequence
  B2M targeting sequence
acuuuuguuugucuaggaaa

SEQ ID NO: 2797 - RNA, 20 nt, Artificial Sequence
  B2M targeting sequence
aggaaagucuuuauuucucc

SEQ ID NO: 2798 - RNA, 20 nt, Artificial Sequence
  B2M targeting sequence
uagacaaacaaaaguugagg

SEQ ID NO: 2799 - RNA, 20 nt, Artificial Sequence
  B2M targeting sequence
uuauuucuccuucauauuuu

SEQ ID NO: 2800 - RNA, 20 nt, Artificial Sequence
  B2M targeting sequence
ccuucauauuuucaaggaua

SEQ ID NO: 2801 - RNA, 20 nt, Artificial Sequence
  B2M targeting sequence
uucauauuuucaaggauauu

SEQ ID NO: 2802 - RNA, 20 nt, Artificial Sequence
  B2M targeting sequence
uauuuucaaggauauuuauu

SEQ ID NO: 2803 - RNA, 20 nt, Artificial Sequence
  B2M targeting sequence
aggauauuuauuucuccuuc

SEQ ID NO: 2804 - RNA, 20 nt, Artificial Sequence
  B2M targeting sequence
uugaaaauaugaaggagaaa

SEQ ID NO: 2805 - RNA, 20 nt, Artificial Sequence
  B2M targeting sequence
ccuucauauuucaaggauau

SEQ ID NO: 2806 - RNA, 20 nt, Artificial Sequence
  B2M targeting sequence
uucauauuucaaggauauuu

SEQ ID NO: 2807 - RNA, 20 nt, Artificial Sequence
  B2M targeting sequence
uauuucaaggauauuuccac

SEQ ID NO: 2808 - RNA, 20 nt, Artificial Sequence
  B2M targeting sequence
aggauauuuccacuggaaag

SEQ ID NO: 2809 - RNA, 20 nt, Artificial Sequence
  B2M targeting sequence
uugaaauaugaaggagaaau

SEQ ID NO: 2810 - RNA, 20 nt, Artificial Sequence
  B2M targeting sequence
acuggaaagucugcugccag

SEQ ID NO: 2811 - RNA, 20 nt, Artificial Sequence
  B2M targeting sequence
aguggaaauauccuugaaau

SEQ ID NO: 2812 - RNA, 20 nt, Artificial Sequence
  B2M targeting sequence
gcugccagacauaucagagc

SEQ ID NO: 2813 - RNA, 20 nt, Artificial Sequence
  B2M targeting sequence
ggcagcagacuuuccagugg

SEQ ID NO: 2814 - RNA, 20 nt, Artificial Sequence
  B2M targeting sequence
gagcuccaugguauguuauu

SEQ ID NO: 2815 - RNA, 20 nt, Artificial Sequence
  B2M targeting sequence
gauaugucuggcagcagacu

SEQ ID NO: 2816 - RNA, 20 nt, Artificial Sequence
  B2M targeting sequence
augguauguuauuuguuuau

SEQ ID NO: 2817 - RNA, 20 nt, Artificial Sequence
  B2M targeting sequence
guugcugcuuuuaggauccu

SEQ ID NO: 2818 - RNA, 20 nt, Artificial Sequence
  B2M targeting sequence
uaaaagcagcaacagaaaau

SEQ ID NO: 2819 - RNA, 20 nt, Artificial Sequence
  B2M targeting sequence
uuucuguauucuugaccuug

SEQ ID NO: 2820 - RNA, 20 nt, Artificial Sequence
  B2M targeting sequence
guauucuugaccuugggagu

SEQ ID NO: 2821 - RNA, 20 nt, Artificial Sequence
  B2M targeting sequence
ugaccuugggaguuuguuua

SEQ ID NO: 2822 - RNA, 20 nt, Artificial Sequence
  B2M targeting sequence
agaauacagaaaggauccua

SEQ ID NO: 2823 - RNA, 20 nt, Artificial Sequence
  B2M targeting sequence
caaggucaagaauacagaaa

SEQ ID NO: 2824 - RNA, 20 nt, Artificial Sequence
  B2M targeting sequence
aaacauuuaauaaacaaacu

SEQ ID NO: 2825 - RNA, 20 nt, Artificial Sequence
  B2M targeting sequence
ucuucuuuggguugaauuug

SEQ ID NO: 2826 - RNA, 20 nt, Artificial Sequence
  B2M targeting sequence
ucuuuggguugaauuuguuu

SEQ ID NO: 2827 - RNA, 20 nt, Artificial Sequence
  B2M targeting sequence
uuggguugaauuuguuuggu

SEQ ID NO: 2828 - RNA, 20 nt, Artificial Sequence
  B2M targeting sequence
acccaaagaagaugaccuca

SEQ ID NO: 2829 - RNA, 20 nt, Artificial Sequence
  B2M targeting sequence
auaaccuucauauacuugaa

SEQ ID NO: 2830 - RNA, 20 nt, Artificial Sequence
  B2M targeting sequence
uauacuugaauauugauauc

SEQ ID NO: 2831 - RNA, 20 nt, Artificial Sequence
  B2M targeting sequence
aguauaugaagguuauagaa

SEQ ID NO: 2832 - RNA, 20 nt, Artificial Sequence
  B2M targeting sequence
auauucaaguauaugaaggu

SEQ ID NO: 2833 - RNA, 20 nt, Artificial Sequence
  B2M targeting sequence
uucccuagguuugggaaggu

SEQ ID NO: 2834 - RNA, 20 nt, Artificial Sequence
  B2M targeting sequence
cuagguuugggaaggucuuu

SEQ ID NO: 2835 - RNA, 20 nt, Artificial Sequence
  B2M targeting sequence
caaaccuagggaaagauauc

SEQ ID NO: 2836 - RNA, 20 nt, Artificial Sequence
  B2M targeting sequence
uuguuacuaucacuuugaau

SEQ ID NO: 2837 - RNA, 20 nt, Artificial Sequence
  B2M targeting sequence
cuuugaauaaacuuucuacc

SEQ ID NO: 2838 - RNA, 20 nt, Artificial Sequence
  B2M targeting sequence
aagugauaguaacaaagacc

SEQ ID NO: 2839 - RNA, 20 nt, Artificial Sequence
  B2M targeting sequence
accccaucucucucucuacc

SEQ ID NO: 2840 - RNA, 20 nt, Artificial Sequence
  B2M targeting sequence
cucucucuaccuccucuuua

SEQ ID NO: 2841 - RNA, 20 nt, Artificial Sequence
  B2M targeting sequence
cucucuaccuccucuuuaag

SEQ ID NO: 2842 - RNA, 20 nt, Artificial Sequence
  B2M targeting sequence
cucuaccuccucuuuaaggc

SEQ ID NO: 2843 - RNA, 20 nt, Artificial Sequence
  B2M targeting sequence
cuaccuccucuuuaaggcca

SEQ ID NO: 2844 - RNA, 20 nt, Artificial Sequence
  B2M targeting sequence
accuccucuuuaaggccaau

SEQ ID NO: 2845 - RNA, 20 nt, Artificial Sequence
  B2M targeting sequence
ucuuuaaggccaauaacucu

SEQ ID NO: 2846 - RNA, 20 nt, Artificial Sequence
  B2M targeting sequence
uuaaggccaauaacucuuuu

SEQ ID NO: 2847 - RNA, 20 nt, Artificial Sequence
  B2M targeting sequence
uuuuuuuuucuuuuugagac

SEQ ID NO: 2848 - RNA, 20 nt, Artificial Sequence
  B2M targeting sequence
uuuugagacagagucucacu

SEQ ID NO: 2849 - RNA, 20 nt, Artificial Sequence
  B2M targeting sequence
aaaagaaaaaaaaaagaguu

SEQ ID NO: 2850 - RNA, 20 nt, Artificial Sequence
  B2M targeting sequence
caaaaagaaaaaaaaaagag

SEQ ID NO: 2851 - RNA, 20 nt, Artificial Sequence
  B2M targeting sequence
gucucaaaaagaaaaaaaaa

SEQ ID NO: 2852 - RNA, 20 nt, Artificial Sequence
  B2M targeting sequence
cacuuuguuguccaggcugg

SEQ ID NO: 2853 - RNA, 20 nt, Artificial Sequence
  B2M targeting sequence
cuuuguuguccaggcuggag

SEQ ID NO: 2854 - RNA, 20 nt, Artificial Sequence
  B2M targeting sequence
aggcuggagugcagugcugu

SEQ ID NO: 2855 - RNA, 20 nt, Artificial Sequence
  B2M targeting sequence
agccuggacaacaaagugag

SEQ ID NO: 2856 - RNA, 20 nt, Artificial Sequence
  B2M targeting sequence
cagcacugcacuccagccug

SEQ ID NO: 2857 - RNA, 20 nt, Artificial Sequence
  B2M targeting sequence
ugguucacuacagccuccac

SEQ ID NO: 2858 - RNA, 20 nt, Artificial Sequence
  B2M targeting sequence
cuacagccuccacuucccag

SEQ ID NO: 2859 - RNA, 20 nt, Artificial Sequence
  B2M targeting sequence
acuucccagguucaagcaau

SEQ ID NO: 2860 - RNA, 20 nt, Artificial Sequence
  B2M targeting sequence
cagguucaagcaauucuccu

SEQ ID NO: 2861 - RNA, 20 nt, Artificial Sequence
  B2M targeting sequence
agcaauucuccugccucagc

SEQ ID NO: 2862 - RNA, 20 nt, Artificial Sequence
  B2M targeting sequence
ccugccucagccuccagagu

SEQ ID NO: 2863 - RNA, 20 nt, Artificial Sequence
  B2M targeting sequence
ugccucagccuccagaguag

SEQ ID NO: 2864 - RNA, 20 nt, Artificial Sequence
  B2M targeting sequence
gccuccagaguagccgggau

SEQ ID NO: 2865 - RNA, 20 nt, Artificial Sequence
  B2M targeting sequence
agaguagccgggauuaaagg

SEQ ID NO: 2866 - RNA, 20 nt, Artificial Sequence
  B2M targeting sequence
ggaggcugaggcaggagaau

SEQ ID NO: 2867 - RNA, 20 nt, Artificial Sequence
  B2M targeting sequence
cggcuacucuggaggcugag

SEQ ID NO: 2868 - RNA, 20 nt, Artificial Sequence
  B2M targeting sequence
agcuaauuuuuguauuuuag

SEQ ID NO: 2869 - RNA, 20 nt, Artificial Sequence
  B2M targeting sequence
acuaaaauacaaaaauuagc

SEQ ID NO: 2870 - RNA, 20 nt, Artificial Sequence
  B2M targeting sequence
caacuaaaauacaaaaauua

SEQ ID NO: 2871 - RNA, 20 nt, Artificial Sequence
  B2M targeting sequence
cgauguuggcgaggcugcuc

SEQ ID NO: 2872 - RNA, 20 nt, Artificial Sequence
  B2M targeting sequence
ugaaaccccgucucaacuaa

SEQ ID NO: 2873 - RNA, 20 nt, Artificial Sequence
  B2M targeting sequence
ccaacaucgugaaaccccgu

SEQ ID NO: 2874 - RNA, 20 nt, Artificial Sequence
  B2M targeting sequence
cgaacuccugaccucaugau

SEQ ID NO: 2875 - RNA, 20 nt, Artificial Sequence
  B2M targeting sequence
aacuccugaccucaugaucu

SEQ ID NO: 2876 - RNA, 20 nt, Artificial Sequence
  B2M targeting sequence
agagcagccucgccaacauc

SEQ ID NO: 2877 - RNA, 20 nt, Artificial Sequence
  B2M targeting sequence
ugaccucaugaucugcccac

SEQ ID NO: 2878 - RNA, 20 nt, Artificial Sequence
  B2M targeting sequence
ggaguucgagagcagccucg

SEQ ID NO: 2879 - RNA, 20 nt, Artificial Sequence
  B2M targeting sequence
ugaucugcccaccuuggccu

SEQ ID NO: 2880 - RNA, 20 nt, Artificial Sequence
  B2M targeting sequence
ugaggucaggaguucgagag

SEQ ID NO: 2881 - RNA, 20 nt, Artificial Sequence
  B2M targeting sequence
gcccaccuuggccucccaaa

SEQ ID NO: 2882 - RNA, 20 nt, Artificial Sequence
  B2M targeting sequence
caaagugcugggauuacagg

SEQ ID NO: 2883 - RNA, 20 nt, Artificial Sequence
  B2M targeting sequence
cagcacuuugggaggccaag

SEQ ID NO: 2884 - RNA, 20 nt, Artificial Sequence
  B2M targeting sequence
uguaaucccagcacuuuggg

SEQ ID NO: 2885 - RNA, 20 nt, Artificial Sequence
  B2M targeting sequence
cuccuguaaucccagcacuu

SEQ ID NO: 2886 - RNA, 20 nt, Artificial Sequence
  B2M targeting sequence
uaaauuugccguuuugaggc

SEQ ID NO: 2887 - RNA, 20 nt, Artificial Sequence
  B2M targeting sequence
aaacggcaaauuuaagaguu

SEQ ID NO: 2888 - RNA, 20 nt, Artificial Sequence
  B2M targeting sequence
agaucuuguaggcaugcuuc

SEQ ID NO: 2889 - RNA, 20 nt, Artificial Sequence
  B2M targeting sequence
agaaaauagccucaaaacgg

SEQ ID NO: 2890 - RNA, 20 nt, Artificial Sequence
  B2M targeting sequence
uguaggcaugcuucauucuu

SEQ ID NO: 2891 - RNA, 20 nt, Artificial Sequence
  B2M targeting sequence
uucuuuuuuauucuuuuuuc

SEQ ID NO: 2892 - RNA, 20 nt, Artificial Sequence
  B2M targeting sequence
uuuuuauucuuuuuucuuuu

SEQ ID NO: 2893 - RNA, 20 nt, Artificial Sequence
  B2M targeting sequence
uuuuucuuuugucucuucug

SEQ ID NO: 2894 - RNA, 20 nt, Artificial Sequence
  B2M targeting sequence
uuugucucuucugauuauau

SEQ ID NO: 2895 - RNA, 20 nt, Artificial Sequence
  B2M targeting sequence
gguuguugguaaaaugugac

SEQ ID NO: 2896 - RNA, 20 nt, Artificial Sequence
  B2M targeting sequence
cucaagaaugcacucacuau

SEQ ID NO: 2897 - RNA, 20 nt, Artificial Sequence
  B2M targeting sequence
caagaaugcacucacuauug

SEQ ID NO: 2898 - RNA, 20 nt, Artificial Sequence
  B2M targeting sequence
agaaugcacucacuauugug

SEQ ID NO: 2899 - RNA, 20 nt, Artificial Sequence
  B2M targeting sequence
ugagagaucugguuguuggu

SEQ ID NO: 2900 - RNA, 20 nt, Artificial Sequence
  B2M targeting sequence
cuauugugaggacagcacca

SEQ ID NO: 2901 - RNA, 20 nt, Artificial Sequence
  B2M targeting sequence
caauagugagugcauucuug

SEQ ID NO: 2902 - RNA, 20 nt, Artificial Sequence
  B2M targeting sequence
ucacaauagugagugcauuc

SEQ ID NO: 2903 - RNA, 20 nt, Artificial Sequence
  B2M targeting sequence
uggcuuggugcuguccucac

SEQ ID NO: 2904 - RNA, 20 nt, Artificial Sequence
  B2M targeting sequence
cucauggcuuggugcugucc

SEQ ID NO: 2905 - RNA, 20 nt, Artificial Sequence
  B2M targeting sequence
gcccccaugauccaaacacc

SEQ ID NO: 2906 - RNA, 20 nt, Artificial Sequence
  B2M targeting sequence
ugggggcagaucccucaugg

SEQ ID NO: 2907 - RNA, 20 nt, Artificial Sequence
  B2M targeting sequence
aaacaccuaucaccaggccc

SEQ ID NO: 2908 - RNA, 20 nt, Artificial Sequence
  B2M targeting sequence
ccaggccccaccuccaauac

SEQ ID NO: 2909 - RNA, 20 nt, Artificial Sequence
  B2M targeting sequence
aauacuagggauuacaauuc

SEQ ID NO: 2910 - RNA, 20 nt, Artificial Sequence
  B2M targeting sequence
cuaguauuggagguggggcc

SEQ ID NO: 2911 - RNA, 20 nt, Artificial Sequence
  B2M targeting sequence
acaugagauuuggguaggga

SEQ ID NO: 2912 - RNA, 20 nt, Artificial Sequence
  B2M targeting sequence
uguugaauuguaaucccuag

SEQ ID NO: 2913 - RNA, 20 nt, Artificial Sequence
  B2M targeting sequence
cauguugaauuguaaucccu

SEQ ID NO: 2914 - RNA, 20 nt, Artificial Sequence
  B2M targeting sequence
cuacccaaaucucauguuga

SEQ ID NO: 2915 - RNA, 20 nt, Artificial Sequence
  B2M targeting sequence
auauuugucccuacccaaau

SEQ ID NO: 2916 - RNA, 20 nt, Artificial Sequence
  B2M targeting sequence
guugguauuaguucuucuuc

SEQ ID NO: 2917 - RNA, 20 nt, Artificial Sequence
  B2M targeting sequence
ucuucauauguuuaguaaca

SEQ ID NO: 2918 - RNA, 20 nt, Artificial Sequence
  B2M targeting sequence
ucauauguuuaguaacauuu

SEQ ID NO: 2919 - RNA, 20 nt, Artificial Sequence
  B2M targeting sequence
uauguuuaguaacauuuagc

SEQ ID NO: 2920 - RNA, 20 nt, Artificial Sequence
  B2M targeting sequence
cugcuaaauguuacuaaaca

SEQ ID NO: 2921 - RNA, 20 nt, Artificial Sequence
  B2M targeting sequence
ucacugcuaaauguuacuaa

SEQ ID NO: 2922 - RNA, 20 nt, Artificial Sequence
  B2M targeting sequence
augucuucacugcuaaaugu

SEQ ID NO: 2923 - RNA, 20 nt, Artificial Sequence
  B2M targeting sequence
ugggcuuucauuuguuacuu

SEQ ID NO: 2924 - RNA, 20 nt, Artificial Sequence
  B2M targeting sequence
uuuguuacuuguuauugguc

SEQ ID NO: 2925 - RNA, 20 nt, Artificial Sequence
  B2M targeting sequence
guucugguuuuggauuucuu

SEQ ID NO: 2926 - RNA, 20 nt, Artificial Sequence
  B2M targeting sequence
gguuuuggauuucuucaagg

SEQ ID NO: 2927 - RNA, 20 nt, Artificial Sequence
  B2M targeting sequence
aaaaccagaacagaccaaua

SEQ ID NO: 2928 - RNA, 20 nt, Artificial Sequence
  B2M targeting sequence
ucaagguucgaucuuggcag

SEQ ID NO: 2929 - RNA, 20 nt, Artificial Sequence
  B2M targeting sequence
agguucgaucuuggcagguu

SEQ ID NO: 2930 - RNA, 20 nt, Artificial Sequence
  B2M targeting sequence
aucuuggcagguuguaugug

SEQ ID NO: 2931 - RNA, 20 nt, Artificial Sequence
  B2M targeting sequence
aaccuugaagaaauccaaaa

SEQ ID NO: 2932 - RNA, 20 nt, Artificial Sequence
  B2M targeting sequence
uggcagguuguaugugucua

SEQ ID NO: 2933 - RNA, 20 nt, Artificial Sequence
  B2M targeting sequence
aggaauguauccauuucuuc

SEQ ID NO: 2934 - RNA, 20 nt, Artificial Sequence
  B2M targeting sequence
uagacacauacaaccugcca

SEQ ID NO: 2935 - RNA, 20 nt, Artificial Sequence
  B2M targeting sequence
auuucuucuagguuuuccaa

SEQ ID NO: 2936 - RNA, 20 nt, Artificial Sequence
  B2M targeting sequence
ucuagguuuuccaauuuauu

SEQ ID NO: 2937 - RNA, 20 nt, Artificial Sequence
  B2M targeting sequence
agguuuuccaauuuauuggc

SEQ ID NO: 2938 - RNA, 20 nt, Artificial Sequence
  B2M targeting sequence
aauuuauuggcauguaguug

SEQ ID NO: 2939 - RNA, 20 nt, Artificial Sequence
  B2M targeting sequence
uaguagccucuaaugaucgu

SEQ ID NO: 2940 - RNA, 20 nt, Artificial Sequence
  B2M targeting sequence
aaugaucguuugaauuucuu

SEQ ID NO: 2941 - RNA, 20 nt, Artificial Sequence
  B2M targeting sequence
uuagaggcuacuaugagcaa

SEQ ID NO: 2942 - RNA, 20 nt, Artificial Sequence
  B2M targeting sequence
uuugaauuucuuugauauug

SEQ ID NO: 2943 - RNA, 20 nt, Artificial Sequence
  B2M targeting sequence
aacgaucauuagaggcuacu

SEQ ID NO: 2944 - RNA, 20 nt, Artificial Sequence
  B2M targeting sequence
uugauauugguuguaauguu

SEQ ID NO: 2945 - RNA, 20 nt, Artificial Sequence
  B2M targeting sequence
aagaaauucaaacgaucauu

SEQ ID NO: 2946 - RNA, 20 nt, Artificial Sequence
  B2M targeting sequence
uuuuucaucucugauuuuau

SEQ ID NO: 2947 - RNA, 20 nt, Artificial Sequence
  B2M targeting sequence
ucucugauuuuauuuauaug

SEQ ID NO: 2948 - RNA, 20 nt, Artificial Sequence
  B2M targeting sequence
cugauuuuauuuauaugagu

SEQ ID NO: 2949 - RNA, 20 nt, Artificial Sequence
  B2M targeting sequence
gauuuuauuuauaugagucu

SEQ ID NO: 2950 - RNA, 20 nt, Artificial Sequence
  B2M targeting sequence
gagaugaaaaaggaaacauu

SEQ ID NO: 2951 - RNA, 20 nt, Artificial Sequence
  B2M targeting sequence
uauaaauaaaaucagagaug

SEQ ID NO: 2952 - RNA, 20 nt, Artificial Sequence
  B2M targeting sequence
ucucuccuuuuuuucuuagc

SEQ ID NO: 2953 - RNA, 20 nt, Artificial Sequence
  B2M targeting sequence
cuccuuuuuuucuuagcgag

SEQ ID NO: 2954 - RNA, 20 nt, Artificial Sequence
  B2M targeting sequence
ccuuuuuuucuuagcgaguc

SEQ ID NO: 2955 - RNA, 20 nt, Artificial Sequence
  B2M targeting sequence
uuuuuuucuuagcgagucug

SEQ ID NO: 2956 - RNA, 20 nt, Artificial Sequence
  B2M targeting sequence
uagcgagucuggcuaaggaa

SEQ ID NO: 2957 - RNA, 20 nt, Artificial Sequence
  B2M targeting sequence
cuaagaaaaaaaggagagaa

SEQ ID NO: 2958 - RNA, 20 nt, Artificial Sequence
  B2M targeting sequence
ggcuaaggaauuguugauuu

SEQ ID NO: 2959 - RNA, 20 nt, Artificial Sequence
  B2M targeting sequence
uuagccagacucgcuaagaa

SEQ ID NO: 2960 - RNA, 20 nt, Artificial Sequence
  B2M targeting sequence
acaauuccuuagccagacuc

SEQ ID NO: 2961 - RNA, 20 nt, Artificial Sequence
  B2M targeting sequence
uuaaaaaaacaacuuuucuu

SEQ ID NO: 2962 - RNA, 20 nt, Artificial Sequence
  B2M targeting sequence
uuuuguugaucuuuucuauu

SEQ ID NO: 2963 - RNA, 20 nt, Artificial Sequence
  B2M targeting sequence
acaaaaagaaaaguuguuuu

SEQ ID NO: 2964 - RNA, 20 nt, Artificial Sequence
  B2M targeting sequence
uuucuauuguuuccuucauu

SEQ ID NO: 2965 - RNA, 20 nt, Artificial Sequence
  B2M targeting sequence
auuguuuccuucauuucaau

SEQ ID NO: 2966 - RNA, 20 nt, Artificial Sequence
  B2M targeting sequence
uucauuucaauuucauuuau

SEQ ID NO: 2967 - RNA, 20 nt, Artificial Sequence
  B2M targeting sequence
uuucaauuucauuuauuuuu

SEQ ID NO: 2968 - RNA, 20 nt, Artificial Sequence
  B2M targeting sequence
auuucauuuauuuuugcucu

SEQ ID NO: 2969 - RNA, 20 nt, Artificial Sequence
  B2M targeting sequence
uuuauuuuugcucucaucuu

SEQ ID NO: 2970 - RNA, 20 nt, Artificial Sequence
  B2M targeting sequence
caucuuuauuauuucuuucc

SEQ ID NO: 2971 - RNA, 20 nt, Artificial Sequence
  B2M targeting sequence
ucuuuauuauuucuuuccuu

SEQ ID NO: 2972 - RNA, 20 nt, Artificial Sequence
  B2M targeting sequence
uuauuauuucuuuccuucua

SEQ ID NO: 2973 - RNA, 20 nt, Artificial Sequence
  B2M targeting sequence
uuccuucuaauaauuuuggg

SEQ ID NO: 2974 - RNA, 20 nt, Artificial Sequence
  B2M targeting sequence
uucuaauaauuuuggguuug

SEQ ID NO: 2975 - RNA, 20 nt, Artificial Sequence
  B2M targeting sequence
aauaauuuuggguuuggcuu

SEQ ID NO: 2976 - RNA, 20 nt, Artificial Sequence
  B2M targeting sequence
ugcuuuucuaguucuuugaa

SEQ ID NO: 2977 - RNA, 20 nt, Artificial Sequence
  B2M targeting sequence
aguucuuugaaaugcaucau

SEQ ID NO: 2978 - RNA, 20 nt, Artificial Sequence
  B2M targeting sequence
uugaaaugcaucauuauguu

SEQ ID NO: 2979 - RNA, 20 nt, Artificial Sequence
  B2M targeting sequence
aagaacuagaaaagcaagag

SEQ ID NO: 2980 - RNA, 20 nt, Artificial Sequence
  B2M targeting sequence
uuauguuguuuauuugaagu

SEQ ID NO: 2981 - RNA, 20 nt, Artificial Sequence
  B2M targeting sequence
aauaaacaacauaaugaugc

SEQ ID NO: 2982 - RNA, 20 nt, Artificial Sequence
  B2M targeting sequence
guuuuucuuuuuuaauguag

SEQ ID NO: 2983 - RNA, 20 nt, Artificial Sequence
  B2M targeting sequence
uuuuuaauguaggugcuuau

SEQ ID NO: 2984 - RNA, 20 nt, Artificial Sequence
  B2M targeting sequence
ucuuauuacugccuucucug

SEQ ID NO: 2985 - RNA, 20 nt, Artificial Sequence
  B2M targeting sequence
uauuacugccuucucuguau

SEQ ID NO: 2986 - RNA, 20 nt, Artificial Sequence
  B2M targeting sequence
cuguaucccauagguuuugg

SEQ ID NO: 2987 - RNA, 20 nt, Artificial Sequence
  B2M targeting sequence
guaucccauagguuuuggua

SEQ ID NO: 2988 - RNA, 20 nt, Artificial Sequence
  B2M targeting sequence
cauagguuuugguauauugu

SEQ ID NO: 2989 - RNA, 20 nt, Artificial Sequence
  B2M targeting sequence
auuaucauuuguuuccagaa

SEQ ID NO: 2990 - RNA, 20 nt, Artificial Sequence
  B2M targeting sequence
uuuguuuccagaauuuaaaa

SEQ ID NO: 2991 - RNA, 20 nt, Artificial Sequence
  B2M targeting sequence
agaauuuaaaaaauuuccuu

SEQ ID NO: 2992 - RNA, 20 nt, Artificial Sequence
  B2M targeting sequence
ggaaacaaaugauaauggaa

SEQ ID NO: 2993 - RNA, 20 nt, Artificial Sequence
  B2M targeting sequence
uucuuaauuucuuuguugac

SEQ ID NO: 2994 - RNA, 20 nt, Artificial Sequence
  B2M targeting sequence
uaauuucuuuguugacccac

SEQ ID NO: 2995 - RNA, 20 nt, Artificial Sequence
  B2M targeting sequence
uuguugacccacagucacuu

SEQ ID NO: 2996 - RNA, 20 nt, Artificial Sequence
  B2M targeting sequence
acaaagaaauuaagaaggaa

SEQ ID NO: 2997 - RNA, 20 nt, Artificial Sequence
  B2M targeting sequence
cuuaggagcauauuuuaauu

SEQ ID NO: 2998 - RNA, 20 nt, Artificial Sequence
  B2M targeting sequence
uaagugacugugggucaaca

SEQ ID NO: 2999 - RNA, 20 nt, Artificial Sequence
  B2M targeting sequence
auauauuuguaugguuucaa

SEQ ID NO: 3000 - RNA, 20 nt, Artificial Sequence
  B2M targeting sequence
aacauuccucuuguuauuga

SEQ ID NO: 3001 - RNA, 20 nt, Artificial Sequence
  B2M targeting sequence
ucuuguuauugauuucuagu

SEQ ID NO: 3002 - RNA, 20 nt, Artificial Sequence
  B2M targeting sequence
uguuauugauuucuaguuuu

SEQ ID NO: 3003 - RNA, 20 nt, Artificial Sequence
  B2M targeting sequence
auaacaagaggaauguuuga

SEQ ID NO: 3004 - RNA, 20 nt, Artificial Sequence
  B2M targeting sequence
aguuuuuuuccauugugguc

SEQ ID NO: 3005 - RNA, 20 nt, Artificial Sequence
  B2M targeting sequence
auuguggucagagaagauau

SEQ ID NO: 3006 - RNA, 20 nt, Artificial Sequence
  B2M targeting sequence
gagaagauauuugauauaau

SEQ ID NO: 3007 - RNA, 20 nt, Artificial Sequence
  B2M targeting sequence
gaccacaauggaaaaaaacu

SEQ ID NO: 3008 - RNA, 20 nt, Artificial Sequence
  B2M targeting sequence
cugaccacaauggaaaaaaa

SEQ ID NO: 3009 - RNA, 20 nt, Artificial Sequence
  B2M targeting sequence
ucucugaccacaauggaaaa

SEQ ID NO: 3010 - RNA, 20 nt, Artificial Sequence
  B2M targeting sequence
aauaucuucucugaccacaa

SEQ ID NO: 3011 - RNA, 20 nt, Artificial Sequence
  B2M targeting sequence
aauuuuuuaagacuuauuuu

SEQ ID NO: 3012 - RNA, 20 nt, Artificial Sequence
  B2M targeting sequence
uaaaaaauuggaauuauauc

SEQ ID NO: 3013 - RNA, 20 nt, Artificial Sequence
  B2M targeting sequence
aacauauggucuauccuuga

SEQ ID NO: 3014 - RNA, 20 nt, Artificial Sequence
  B2M targeting sequence
auccuugagaaugauccaug

SEQ ID NO: 3015 - RNA, 20 nt, Artificial Sequence
  B2M targeting sequence
uugagaaugauccaugugcu

SEQ ID NO: 3016 - RNA, 20 nt, Artificial Sequence
  B2M targeting sequence
aggauagaccauauguuaga

SEQ ID NO: 3017 - RNA, 20 nt, Artificial Sequence
  B2M targeting sequence
caaggauagaccauauguua

SEQ ID NO: 3018 - RNA, 20 nt, Artificial Sequence
  B2M targeting sequence
uucucaaggauagaccauau

SEQ ID NO: 3019 - RNA, 20 nt, Artificial Sequence
  B2M targeting sequence
augugcugaggagaagaaug

SEQ ID NO: 3020 - RNA, 20 nt, Artificial Sequence
  B2M targeting sequence
gcacauggaucauucucaag

SEQ ID NO: 3021 - RNA, 20 nt, Artificial Sequence
  B2M targeting sequence
ucagcacauggaucauucuc

SEQ ID NO: 3022 - RNA, 20 nt, Artificial Sequence
  B2M targeting sequence
ccucagcacauggaucauuc

SEQ ID NO: 3023 - RNA, 20 nt, Artificial Sequence
  B2M targeting sequence
ucuccucagcacauggauca

SEQ ID NO: 3024 - RNA, 20 nt, Artificial Sequence
  B2M targeting sequence
guagccauuggauaaaaugu

SEQ ID NO: 3025 - RNA, 20 nt, Artificial Sequence
  B2M targeting sequence
aauggcuacagaauacccau

SEQ ID NO: 3026 - RNA, 20 nt, Artificial Sequence
  B2M targeting sequence
guaaauaucuauuagaucug

SEQ ID NO: 3027 - RNA, 20 nt, Artificial Sequence
  B2M targeting sequence
auuagaucuggccaggcacg

SEQ ID NO: 3028 - RNA, 20 nt, Artificial Sequence
  B2M targeting sequence
aauagauauuuacagaacau

SEQ ID NO: 3029 - RNA, 20 nt, Artificial Sequence
  B2M targeting sequence
ggccaggcacgguggcucau

SEQ ID NO: 3030 - RNA, 20 nt, Artificial Sequence
  B2M targeting sequence
ugccuguaacuccagcacuu

SEQ ID NO: 3031 - RNA, 20 nt, Artificial Sequence
  B2M targeting sequence
agcacuuugggaggccaagg

SEQ ID NO: 3032 - RNA, 20 nt, Artificial Sequence
  B2M targeting sequence
caaagugcuggaguuacagg

SEQ ID NO: 3033 - RNA, 20 nt, Artificial Sequence
  B2M targeting sequence
accugccuuggccucccaaa

SEQ ID NO: 3034 - RNA, 20 nt, Artificial Sequence
  B2M targeting sequence
caaggucaggagaucaagac

SEQ ID NO: 3035 - RNA, 20 nt, Artificial Sequence
  B2M targeting sequence
ggagaucaagaccauccuga

SEQ ID NO: 3036 - RNA, 20 nt, Artificial Sequence
  B2M targeting sequence
ugaccuugugauccaccugc

SEQ ID NO: 3037 - RNA, 20 nt, Artificial Sequence
  B2M targeting sequence
ccugaccuugugauccaccu

SEQ ID NO: 3038 - RNA, 20 nt, Artificial Sequence
  B2M targeting sequence
agaccauccugacuaacgug

SEQ ID NO: 3039 - RNA, 20 nt, Artificial Sequence
  B2M targeting sequence
ugaucuccugaccuugugau

SEQ ID NO: 3040 - RNA, 20 nt, Artificial Sequence
  B2M targeting sequence
ugacuaacguggagaaaccc

SEQ ID NO: 3041 - RNA, 20 nt, Artificial Sequence
  B2M targeting sequence
ggauggucuugaucuccuga

SEQ ID NO: 3042 - RNA, 20 nt, Artificial Sequence
  B2M targeting sequence
acguuagucaggauggucuu

SEQ ID NO: 3043 - RNA, 20 nt, Artificial Sequence
  B2M targeting sequence
ccacguuagucaggaugguc

SEQ ID NO: 3044 - RNA, 20 nt, Artificial Sequence
  B2M targeting sequence
guacuaaaaauacaaaaaaa

SEQ ID NO: 3045 - RNA, 20 nt, Artificial Sequence
  B2M targeting sequence
ccaccaugcccagcuaauuu

SEQ ID NO: 3046 - RNA, 20 nt, Artificial Sequence
  B2M targeting sequence
cagcuacucaggaggcugag

SEQ ID NO: 3047 - RNA, 20 nt, Artificial Sequence
  B2M targeting sequence
ggaggcugaggcaggagaau

SEQ ID NO: 3048 - RNA, 20 nt, Artificial Sequence
  B2M targeting sequence
ugaguagcugggacuacggg

SEQ ID NO: 3049 - RNA, 20 nt, Artificial Sequence
  B2M targeting sequence
gccuccugaguagcugggac

SEQ ID NO: 3050 - RNA, 20 nt, Artificial Sequence
  B2M targeting sequence
ugccucagccuccugaguag

SEQ ID NO: 3051 - RNA, 20 nt, Artificial Sequence
  B2M targeting sequence
ccugccucagccuccugagu

SEQ ID NO: 3052 - RNA, 20 nt, Artificial Sequence
  B2M targeting sequence
caccauucuccugccucagc

SEQ ID NO: 3053 - RNA, 20 nt, Artificial Sequence
  B2M targeting sequence
cagguucacaccauucuccu

SEQ ID NO: 3054 - RNA, 20 nt, Artificial Sequence
  B2M targeting sequence
accucccagguucacaccau

SEQ ID NO: 3055 - RNA, 20 nt, Artificial Sequence
  B2M targeting sequence
gcuuacugcaagcuccaccu

SEQ ID NO: 3056 - RNA, 20 nt, Artificial Sequence
  B2M targeting sequence
cagcuuacugcaagcuccac

SEQ ID NO: 3057 - RNA, 20 nt, Artificial Sequence
  B2M targeting sequence
caccacugcacuccagccug

SEQ ID NO: 3058 - RNA, 20 nt, Artificial Sequence
  B2M targeting sequence
agccugggcaacagagcaag

SEQ ID NO: 3059 - RNA, 20 nt, Artificial Sequence
  B2M targeting sequence
guugcccaggcuggagugca

SEQ ID NO: 3060 - RNA, 20 nt, Artificial Sequence
  B2M targeting sequence
ugcucuguugcccaggcugg

SEQ ID NO: 3061 - RNA, 20 nt, Artificial Sequence
  B2M targeting sequence
caaaaaagaaaaaaucuauu

SEQ ID NO: 3062 - RNA, 20 nt, Artificial Sequence
  B2M targeting sequence
aaaaagaaaaaaucuauuag

SEQ ID NO: 3063 - RNA, 20 nt, Artificial Sequence
  B2M targeting sequence
uuuuugagaugcagucuugc

SEQ ID NO: 3064 - RNA, 20 nt, Artificial Sequence
  B2M targeting sequence
auuagagccauuugaucuau

SEQ ID NO: 3065 - RNA, 20 nt, Artificial Sequence
  B2M targeting sequence
aauagauuuuuucuuuuuug

SEQ ID NO: 3066 - RNA, 20 nt, Artificial Sequence
  B2M targeting sequence
aauggcucuaauagauuuuu

SEQ ID NO: 3067 - RNA, 20 nt, Artificial Sequence
  B2M targeting sequence
auagugcagauuaagucuga

SEQ ID NO: 3068 - RNA, 20 nt, Artificial Sequence
  B2M targeting sequence
gcacuauagaucaaauggcu

SEQ ID NO: 3069 - RNA, 20 nt, Artificial Sequence
  B2M targeting sequence
gauguuucuuuguugauuuu

SEQ ID NO: 3070 - RNA, 20 nt, Artificial Sequence
  B2M targeting sequence
gacuuaaucugcacuauaga

SEQ ID NO: 3071 - RNA, 20 nt, Artificial Sequence
  B2M targeting sequence
uuguugauuuucagucugga

SEQ ID NO: 3072 - RNA, 20 nt, Artificial Sequence
  B2M targeting sequence
acaaagaaacaucagacuua

SEQ ID NO: 3073 - RNA, 20 nt, Artificial Sequence
  B2M targeting sequence
gucuggaugaucuguccaau

SEQ ID NO: 3074 - RNA, 20 nt, Artificial Sequence
  B2M targeting sequence
ggaugaucuguccaaugcug

SEQ ID NO: 3075 - RNA, 20 nt, Artificial Sequence
  B2M targeting sequence
agacugaaaaucaacaaaga

SEQ ID NO: 3076 - RNA, 20 nt, Artificial Sequence
  B2M targeting sequence
uccagacugaaaaucaacaa

SEQ ID NO: 3077 - RNA, 20 nt, Artificial Sequence
  B2M targeting sequence
guccaaugcugaaagugggg

SEQ ID NO: 3078 - RNA, 20 nt, Artificial Sequence
  B2M targeting sequence
aaugcugaaagugggguguu

SEQ ID NO: 3079 - RNA, 20 nt, Artificial Sequence
  B2M targeting sequence
gcauuggacagaucauccag

SEQ ID NO: 3080 - RNA, 20 nt, Artificial Sequence
  B2M targeting sequence
acaccccacuuucagcauug

SEQ ID NO: 3081 - RNA, 20 nt, Artificial Sequence
  B2M targeting sequence
ccagcuauuauuguauuggg

SEQ ID NO: 3082 - RNA, 20 nt, Artificial Sequence
  B2M targeting sequence
agcuauuauuguauuggggu

SEQ ID NO: 3083 - RNA, 20 nt, Artificial Sequence
  B2M targeting sequence
aucucucucuuuagcucuaa

SEQ ID NO: 3084 - RNA, 20 nt, Artificial Sequence
  B2M targeting sequence
cucucuuuagcucuaauaau

SEQ ID NO: 3085 - RNA, 20 nt, Artificial Sequence
  B2M targeting sequence
cucuuuagcucuaauaauau

SEQ ID NO: 3086 - RNA, 20 nt, Artificial Sequence
  B2M targeting sequence
cuuuagcucuaauaauauuu

SEQ ID NO: 3087 - RNA, 20 nt, Artificial Sequence
  B2M targeting sequence
uuagcucuaauaauauuuac

SEQ ID NO: 3088 - RNA, 20 nt, Artificial Sequence
  B2M targeting sequence
aauaauauuuacuuuauaua

SEQ ID NO: 3089 - RNA, 20 nt, Artificial Sequence
  B2M targeting sequence
aguuggaaugcauauauuuu

SEQ ID NO: 3090 - RNA, 20 nt, Artificial Sequence
  B2M targeting sequence
aacuggagcacccagcuaua

SEQ ID NO: 3091 - RNA, 20 nt, Artificial Sequence
  B2M targeting sequence
ggccgaauuaaccucuuuuc

SEQ ID NO: 3092 - RNA, 20 nt, Artificial Sequence
  B2M targeting sequence
gccagaguauauaacaauug

SEQ ID NO: 3093 - RNA, 20 nt, Artificial Sequence
  B2M targeting sequence
uuucauuauauaaugaccuu

SEQ ID NO: 3094 - RNA, 20 nt, Artificial Sequence
  B2M targeting sequence
uuauauaaugaccuucuuug

SEQ ID NO: 3095 - RNA, 20 nt, Artificial Sequence
  B2M targeting sequence
uuauauaaugaaaagagguu

SEQ ID NO: 3096 - RNA, 20 nt, Artificial Sequence
  B2M targeting sequence
uugucucuuuuuauaguuuu

SEQ ID NO: 3097 - RNA, 20 nt, Artificial Sequence
  B2M targeting sequence
cuuuuuauaguuuuugucuu

SEQ ID NO: 3098 - RNA, 20 nt, Artificial Sequence
  B2M targeting sequence
uuuuauaguuuuugucuuga

SEQ ID NO: 3099 - RNA, 20 nt, Artificial Sequence
  B2M targeting sequence
ugaaaucuauuuugucugau

SEQ ID NO: 3100 - RNA, 20 nt, Artificial Sequence
  B2M targeting sequence
agacaaaaacuauaaaaaga

SEQ ID NO: 3101 - RNA, 20 nt, Artificial Sequence
  B2M targeting sequence
auuuugucugauguaagcau

SEQ ID NO: 3102 - RNA, 20 nt, Artificial Sequence
  B2M targeting sequence
gauguaagcauagcuauuca

SEQ ID NO: 3103 - RNA, 20 nt, Artificial Sequence
  B2M targeting sequence
gacaaaauagauuucaagac

SEQ ID NO: 3104 - RNA, 20 nt, Artificial Sequence
  B2M targeting sequence
ugauccuuuuugguuuccau

SEQ ID NO: 3105 - RNA, 20 nt, Artificial Sequence
  B2M targeting sequence
ugaauagcuaugcuuacauc

SEQ ID NO: 3106 - RNA, 20 nt, Artificial Sequence
  B2M targeting sequence
uuuuugguuuccauuggaau

SEQ ID NO: 3107 - RNA, 20 nt, Artificial Sequence
  B2M targeting sequence
auuggaauggaauauauuuu

SEQ ID NO: 3108 - RNA, 20 nt, Artificial Sequence
  B2M targeting sequence
aauggaaaccaaaaaggauc

SEQ ID NO: 3109 - RNA, 20 nt, Artificial Sequence
  B2M targeting sequence
auuccaauggaaaccaaaaa

SEQ ID NO: 3110 - RNA, 20 nt, Artificial Sequence
  B2M targeting sequence
aucccuuuguuuuagucuau

SEQ ID NO: 3111 - RNA, 20 nt, Artificial Sequence
  B2M targeting sequence
cuuuguuuuagucuaugugu

SEQ ID NO: 3112 - RNA, 20 nt, Artificial Sequence
  B2M targeting sequence
augugugucuuuauggguga

SEQ ID NO: 3113 - RNA, 20 nt, Artificial Sequence
  B2M targeting sequence
uuaugggugaagugugcucc

SEQ ID NO: 3114 - RNA, 20 nt, Artificial Sequence
  B2M targeting sequence
cccauaaagacacacauaga

SEQ ID NO: 3115 - RNA, 20 nt, Artificial Sequence
  B2M targeting sequence
uuguaggcaacaaaucaccg

SEQ ID NO: 3116 - RNA, 20 nt, Artificial Sequence
  B2M targeting sequence
ccgggucuugcuuuuuuuuu

SEQ ID NO: 3117 - RNA, 20 nt, Artificial Sequence
  B2M targeting sequence
ugcuuuuuuuuuuuuuuuuu

SEQ ID NO: 3118 - RNA, 20 nt, Artificial Sequence
  B2M targeting sequence
auucagccacucuaugucuu

SEQ ID NO: 3119 - RNA, 20 nt, Artificial Sequence
  B2M targeting sequence
gccacucuaugucuuuugaa

SEQ ID NO: 3120 - RNA, 20 nt, Artificial Sequence
  B2M targeting sequence
augucuuuugaauggagagu

SEQ ID NO: 3121 - RNA, 20 nt, Artificial Sequence
  B2M targeting sequence
uuugaauggagaguuuaguc

SEQ ID NO: 3122 - RNA, 20 nt, Artificial Sequence
  B2M targeting sequence
aaagacauagaguggcugaa

SEQ ID NO: 3123 - RNA, 20 nt, Artificial Sequence
  B2M targeting sequence
auucaaaagacauagagugg

SEQ ID NO: 3124 - RNA, 20 nt, Artificial Sequence
  B2M targeting sequence
ccauucaaaagacauagagu

SEQ ID NO: 3125 - RNA, 20 nt, Artificial Sequence
  B2M targeting sequence
auuuagauucaauguuauua

SEQ ID NO: 3126 - RNA, 20 nt, Artificial Sequence
  B2M targeting sequence
aaauggacuaaacucuccau

SEQ ID NO: 3127 - RNA, 20 nt, Artificial Sequence
  B2M targeting sequence
auguuauuauugauaaguaa

SEQ ID NO: 3128 - RNA, 20 nt, Artificial Sequence
  B2M targeting sequence
auaauaacauugaaucuaaa

SEQ ID NO: 3129 - RNA, 20 nt, Artificial Sequence
  B2M targeting sequence
uuacuuaucaauaauaacau

SEQ ID NO: 3130 - RNA, 20 nt, Artificial Sequence
  B2M targeting sequence
ugccauuuuguuauuuguuu

SEQ ID NO: 3131 - RNA, 20 nt, Artificial Sequence
  B2M targeting sequence
aguuguuuugugguccucug

SEQ ID NO: 3132 - RNA, 20 nt, Artificial Sequence
  B2M targeting sequence
ucuguuccuuccuucuuuug

SEQ ID NO: 3133 - RNA, 20 nt, Artificial Sequence
  B2M targeting sequence
guuccuuccuucuuuuguuc

SEQ ID NO: 3134 - RNA, 20 nt, Artificial Sequence
  B2M targeting sequence
uuccuucuuuuguuccuguc

SEQ ID NO: 3135 - RNA, 20 nt, Artificial Sequence
  B2M targeting sequence
uucuuuuguuccugucuucc

SEQ ID NO: 3136 - RNA, 20 nt, Artificial Sequence
  B2M targeting sequence
uuuguuccugucuuccuuuc

SEQ ID NO: 3137 - RNA, 20 nt, Artificial Sequence
  B2M targeting sequence
ugucuuccuuucugugaagg

SEQ ID NO: 3138 - RNA, 20 nt, Artificial Sequence
  B2M targeting sequence
uccuuucugugaaggugauu

SEQ ID NO: 3139 - RNA, 20 nt, Artificial Sequence
  B2M targeting sequence
uuucugugaaggugauuuuc

SEQ ID NO: 3140 - RNA, 20 nt, Artificial Sequence
  B2M targeting sequence
gugaaggugauuuucucugg

SEQ ID NO: 3141 - RNA, 20 nt, Artificial Sequence
  B2M targeting sequence
cagaaaggaagacaggaaca

SEQ ID NO: 3142 - RNA, 20 nt, Artificial Sequence
  B2M targeting sequence
ccuucacagaaaggaagaca

SEQ ID NO: 3143 - RNA, 20 nt, Artificial Sequence
  B2M targeting sequence
cugguaguauuuaaaaauuu

SEQ ID NO: 3144 - RNA, 20 nt, Artificial Sequence
  B2M targeting sequence
gguaguauuuaaaaauuucu

SEQ ID NO: 3145 - RNA, 20 nt, Artificial Sequence
  B2M targeting sequence
ugcuuuuuauuuuuugugua

SEQ ID NO: 3146 - RNA, 20 nt, Artificial Sequence
  B2M targeting sequence
guuguauguuguuuugggga

SEQ ID NO: 3147 - RNA, 20 nt, Artificial Sequence
  B2M targeting sequence
ccaaaacaacauacaacaga

SEQ ID NO: 3148 - RNA, 20 nt, Artificial Sequence
  B2M targeting sequence
aaaaaaguccccaaaacaac

SEQ ID NO: 3149 - RNA, 20 nt, Artificial Sequence
  B2M targeting sequence
caaaaaaaguccccaaaaca

SEQ ID NO: 3150 - RNA, 20 nt, Artificial Sequence
  B2M targeting sequence
ccaucucaaaaaaagucccc

SEQ ID NO: 3151 - RNA, 20 nt, Artificial Sequence
  B2M targeting sequence
cgcuuugucacccaggcugg

SEQ ID NO: 3152 - RNA, 20 nt, Artificial Sequence
  B2M targeting sequence
cuuugucacccaggcuggag

SEQ ID NO: 3153 - RNA, 20 nt, Artificial Sequence
  B2M targeting sequence
cccaggcuggagugcagugg

SEQ ID NO: 3154 - RNA, 20 nt, Artificial Sequence
  B2M targeting sequence
agccugggugacaaagcgag

SEQ ID NO: 3155 - RNA, 20 nt, Artificial Sequence
  B2M targeting sequence
caccacugcacuccagccug

SEQ ID NO: 3156 - RNA, 20 nt, Artificial Sequence
  B2M targeting sequence
uggcucacugcaaccucugc

SEQ ID NO: 3157 - RNA, 20 nt, Artificial Sequence
  B2M targeting sequence
cugcaaccucugccuuucag

SEQ ID NO: 3158 - RNA, 20 nt, Artificial Sequence
  B2M targeting sequence
gccuuucaggcucaagugau

SEQ ID NO: 3159 - RNA, 20 nt, Artificial Sequence
  B2M targeting sequence
ggcucaagugaucugcccau

SEQ ID NO: 3160 - RNA, 20 nt, Artificial Sequence
  B2M targeting sequence
agugaucugcccaucucagc

SEQ ID NO: 3161 - RNA, 20 nt, Artificial Sequence
  B2M targeting sequence
cuugagccugaaaggcagag

SEQ ID NO: 3162 - RNA, 20 nt, Artificial Sequence
  B2M targeting sequence
gcccaucucagccucccaag

SEQ ID NO: 3163 - RNA, 20 nt, Artificial Sequence
  B2M targeting sequence
cagccucccaaguaguuggg

SEQ ID NO: 3164 - RNA, 20 nt, Artificial Sequence
  B2M targeting sequence
gccucccaaguaguugggac

SEQ ID NO: 3165 - RNA, 20 nt, Artificial Sequence
  B2M targeting sequence
caaguaguugggaccacagg

SEQ ID NO: 3166 - RNA, 20 nt, Artificial Sequence
  B2M targeting sequence
caacuacuugggaggcugag

SEQ ID NO: 3167 - RNA, 20 nt, Artificial Sequence
  B2M targeting sequence
ccuguggucccaacuacuug

SEQ ID NO: 3168 - RNA, 20 nt, Artificial Sequence
  B2M targeting sequence
ggcuaauuuuuuuuuuuuuu

SEQ ID NO: 3169 - RNA, 20 nt, Artificial Sequence
  B2M targeting sequence
accaaaaaaaaaaaaaaaaa

SEQ ID NO: 3170 - RNA, 20 nt, Artificial Sequence
  B2M targeting sequence
cuaccaaaaaaaaaaaaaaa

SEQ ID NO: 3171 - RNA, 20 nt, Artificial Sequence
  B2M targeting sequence
acaaaagugcuugucucuac

SEQ ID NO: 3172 - RNA, 20 nt, Artificial Sequence
  B2M targeting sequence
cuacaaaagugcuugucucu

SEQ ID NO: 3173 - RNA, 20 nt, Artificial Sequence
  B2M targeting sequence
ccaccguguuuuccaggcug

SEQ ID NO: 3174 - RNA, 20 nt, Artificial Sequence
  B2M targeting sequence
aggcugguuucaaacuccug

SEQ ID NO: 3175 - RNA, 20 nt, Artificial Sequence
  B2M targeting sequence
aacuccugagcucaagccaa

SEQ ID NO: 3176 - RNA, 20 nt, Artificial Sequence
  B2M targeting sequence
ugagcucaagccaaaggccu

SEQ ID NO: 3177 - RNA, 20 nt, Artificial Sequence
  B2M targeting sequence
ggaguuugaaaccagccugg

SEQ ID NO: 3178 - RNA, 20 nt, Artificial Sequence
  B2M targeting sequence
agccaaaggccugcuuuggc

SEQ ID NO: 3179 - RNA, 20 nt, Artificial Sequence
  B2M targeting sequence
caaagugcuaggauuacaag

SEQ ID NO: 3180 - RNA, 20 nt, Artificial Sequence
  B2M targeting sequence
uagcacuuugggaggccaaa

SEQ ID NO: 3181 - RNA, 20 nt, Artificial Sequence
  B2M targeting sequence
cacuuguaauccuagcacuu

SEQ ID NO: 3182 - RNA, 20 nt, Artificial Sequence
  B2M targeting sequence
uggccccuguuguaugcuuu

SEQ ID NO: 3183 - RNA, 20 nt, Artificial Sequence
  B2M targeting sequence
gguuaccauaaggcuuguau

SEQ ID NO: 3184 - RNA, 20 nt, Artificial Sequence
  B2M targeting sequence
caacauaacccauuauuuua

SEQ ID NO: 3185 - RNA, 20 nt, Artificial Sequence
  B2M targeting sequence
uugguuuaaaauaauggguu

SEQ ID NO: 3186 - RNA, 20 nt, Artificial Sequence
  B2M targeting sequence
gugguaaguuuucauugguu

SEQ ID NO: 3187 - RNA, 20 nt, Artificial Sequence
  B2M targeting sequence
uuauuuauguaaucaguggu

SEQ ID NO: 3188 - RNA, 20 nt, Artificial Sequence
  B2M targeting sequence
uugcuucuuuauuuauguaa

SEQ ID NO: 3189 - RNA, 20 nt, Artificial Sequence
  B2M targeting sequence
acauuuuaacuuuguccucc

SEQ ID NO: 3190 - RNA, 20 nt, Artificial Sequence
  B2M targeting sequence
uccugcuuuuuaauucuuug

SEQ ID NO: 3191 - RNA, 20 nt, Artificial Sequence
  B2M targeting sequence
ugcuuuuuaauucuuuguug

SEQ ID NO: 3192 - RNA, 20 nt, Artificial Sequence
  B2M targeting sequence
uuguuguuuguguuuguguc

SEQ ID NO: 3193 - RNA, 20 nt, Artificial Sequence
  B2M targeting sequence
uauuguacugucuaugucuu

SEQ ID NO: 3194 - RNA, 20 nt, Artificial Sequence
  B2M targeting sequence
augucuugaaaaguuguuau

SEQ ID NO: 3195 - RNA, 20 nt, Artificial Sequence
  B2M targeting sequence
ugaaaaguuguuauaguuau

SEQ ID NO: 3196 - RNA, 20 nt, Artificial Sequence
  B2M targeting sequence
agacauagacaguacaauau

SEQ ID NO: 3197 - RNA, 20 nt, Artificial Sequence
  B2M targeting sequence
aaacuaauaacuauaacaac

SEQ ID NO: 3198 - RNA, 20 nt, Artificial Sequence
  B2M targeting sequence
gcuuuuggucuuuccacuca

SEQ ID NO: 3199 - RNA, 20 nt, Artificial Sequence
  B2M targeting sequence
uuccacucaagauaugagua

SEQ ID NO: 3200 - RNA, 20 nt, Artificial Sequence
  B2M targeting sequence
acucaagauaugaguaguuu

SEQ ID NO: 3201 - RNA, 20 nt, Artificial Sequence
  B2M targeting sequence
agauaugaguaguuuacaua

SEQ ID NO: 3202 - RNA, 20 nt, Artificial Sequence
  B2M targeting sequence
ugaguggaaagaccaaaagc

SEQ ID NO: 3203 - RNA, 20 nt, Artificial Sequence
  B2M targeting sequence
uaucuugaguggaaagacca

SEQ ID NO: 3204 - RNA, 20 nt, Artificial Sequence
  B2M targeting sequence
ugguauguaaacuacucaua

SEQ ID NO: 3205 - RNA, 20 nt, Artificial Sequence
  B2M targeting sequence
guuuuuuuucuguguacuuc

SEQ ID NO: 3206 - RNA, 20 nt, Artificial Sequence
  B2M targeting sequence
guguacuuccaauuaccagu

SEQ ID NO: 3207 - RNA, 20 nt, Artificial Sequence
  B2M targeting sequence
aauuaccagugaguuuuaca

SEQ ID NO: 3208 - RNA, 20 nt, Artificial Sequence
  B2M targeting sequence
cugguaauuggaaguacaca

SEQ ID NO: 3209 - RNA, 20 nt, Artificial Sequence
  B2M targeting sequence
aauuauuuuucauugcucau

SEQ ID NO: 3210 - RNA, 20 nt, Artificial Sequence
  B2M targeting sequence
uugcucauuaauguccuuuu

SEQ ID NO: 3211 - RNA, 20 nt, Artificial Sequence
  B2M targeting sequence
uuaauguccuuuucuuucug

SEQ ID NO: 3212 - RNA, 20 nt, Artificial Sequence
  B2M targeting sequence
uuuucuuucugauuaaagaa

SEQ ID NO: 3213 - RNA, 20 nt, Artificial Sequence
  B2M targeting sequence
uucugauuaaagaacucccu

SEQ ID NO: 3214 - RNA, 20 nt, Artificial Sequence
  B2M targeting sequence
gauuaaagaacucccuucag

SEQ ID NO: 3215 - RNA, 20 nt, Artificial Sequence
  B2M targeting sequence
gaaagaaaaggacauuaaug

SEQ ID NO: 3216 - RNA, 20 nt, Artificial Sequence
  B2M targeting sequence
uuaaucagaaagaaaaggac

SEQ ID NO: 3217 - RNA, 20 nt, Artificial Sequence
  B2M targeting sequence
cuucagcauuucuuguagga

SEQ ID NO: 3218 - RNA, 20 nt, Artificial Sequence
  B2M targeting sequence
gcauuucuuguaggacaggu

SEQ ID NO: 3219 - RNA, 20 nt, Artificial Sequence
  B2M targeting sequence
uguaggacaggucugguguu

SEQ ID NO: 3220 - RNA, 20 nt, Artificial Sequence
  B2M targeting sequence
uacaagaaaugcugaaggga

SEQ ID NO: 3221 - RNA, 20 nt, Artificial Sequence
  B2M targeting sequence
gguguugaugaaaucccuca

SEQ ID NO: 3222 - RNA, 20 nt, Artificial Sequence
  B2M targeting sequence
acaccagaccuguccuacaa

SEQ ID NO: 3223 - RNA, 20 nt, Artificial Sequence
  B2M targeting sequence
ucaacaccagaccuguccua

SEQ ID NO: 3224 - RNA, 20 nt, Artificial Sequence
  B2M targeting sequence
cucaacuuuuguuugucuag

SEQ ID NO: 3225 - RNA, 20 nt, Artificial Sequence
  B2M targeting sequence
acuuuuguuugucuaggaaa

SEQ ID NO: 3226 - RNA, 20 nt, Artificial Sequence
  B2M targeting sequence
aggaaagucuuuauuucucc

SEQ ID NO: 3227 - RNA, 20 nt, Artificial Sequence
  B2M targeting sequence
uagacaaacaaaaguugagg

SEQ ID NO: 3228 - RNA, 20 nt, Artificial Sequence
  B2M targeting sequence
uuauuucuccuucauauuuu

SEQ ID NO: 3229 - RNA, 20 nt, Artificial Sequence
  B2M targeting sequence
ccuucauauuuucaaggaua

SEQ ID NO: 3230 - RNA, 20 nt, Artificial Sequence
  B2M targeting sequence
uucauauuuucaaggauauu

SEQ ID NO: 3231 - RNA, 20 nt, Artificial Sequence
  B2M targeting sequence
uauuuucaaggauauuuauu

SEQ ID NO: 3232 - RNA, 20 nt, Artificial Sequence
  B2M targeting sequence
aggauauuuauuucuccuuc

SEQ ID NO: 3233 - RNA, 20 nt, Artificial Sequence
  B2M targeting sequence
uugaaaauaugaaggagaaa

SEQ ID NO: 3234 - RNA, 20 nt, Artificial Sequence
  B2M targeting sequence
ccuucauauuucaaggauau

SEQ ID NO: 3235 - RNA, 20 nt, Artificial Sequence
  B2M targeting sequence
uucauauuucaaggauauuu

SEQ ID NO: 3236 - RNA, 20 nt, Artificial Sequence
  B2M targeting sequence
uauuucaaggauauuuccac

SEQ ID NO: 3237 - RNA, 20 nt, Artificial Sequence
  B2M targeting sequence
aggauauuuccacuggaaag

SEQ ID NO: 3238 - RNA, 20 nt, Artificial Sequence
  B2M targeting sequence
uugaaauaugaaggagaaau

SEQ ID NO: 3239 - RNA, 20 nt, Artificial Sequence
  B2M targeting sequence
acuggaaagucugcugccag

SEQ ID NO: 3240 - RNA, 20 nt, Artificial Sequence
  B2M targeting sequence
aguggaaauauccuugaaau

SEQ ID NO: 3241 - RNA, 20 nt, Artificial Sequence
  B2M targeting sequence
gcugccagacauaucagagc

SEQ ID NO: 3242 - RNA, 20 nt, Artificial Sequence
  B2M targeting sequence
ggcagcagacuuuccagugg

SEQ ID NO: 3243 - RNA, 20 nt, Artificial Sequence
  B2M targeting sequence
gagcuccaugguauguuauu

SEQ ID NO: 3244 - RNA, 20 nt, Artificial Sequence
  B2M targeting sequence
gauaugucuggcagcagacu

SEQ ID NO: 3245 - RNA, 20 nt, Artificial Sequence
  B2M targeting sequence
augguauguuauuuguuuau

SEQ ID NO: 3246 - RNA, 20 nt, Artificial Sequence
  B2M targeting sequence
guugcugcuuuuaggauccu

SEQ ID NO: 3247 - RNA, 20 nt, Artificial Sequence
  B2M targeting sequence
uaaaagcagcaacagaaaau

SEQ ID NO: 3248 - RNA, 20 nt, Artificial Sequence
  B2M targeting sequence
uuucuguauucuugaccuug

SEQ ID NO: 3249 - RNA, 20 nt, Artificial Sequence
  B2M targeting sequence
guauucuugaccuugggagu

SEQ ID NO: 3250 - RNA, 20 nt, Artificial Sequence
  B2M targeting sequence
ugaccuugggaguuuguuua

SEQ ID NO: 3251 - RNA, 20 nt, Artificial Sequence
  B2M targeting sequence
agaauacagaaaggauccua

SEQ ID NO: 3252 - RNA, 20 nt, Artificial Sequence
  B2M targeting sequence
caaggucaagaauacagaaa

SEQ ID NO: 3253 - RNA, 20 nt, Artificial Sequence
  B2M targeting sequence
aaacauuuaauaaacaaacu

SEQ ID NO: 3254 - RNA, 20 nt, Artificial Sequence
  B2M targeting sequence
ucuucuuuggguugaauuug

SEQ ID NO: 3255 - RNA, 20 nt, Artificial Sequence
  B2M targeting sequence
ucuuuggguugaauuuguuu

SEQ ID NO: 3256 - RNA, 20 nt, Artificial Sequence
  B2M targeting sequence
uuggguugaauuuguuuggu

SEQ ID NO: 3257 - RNA, 20 nt, Artificial Sequence
  B2M targeting sequence
acccaaagaagaugaccuca

SEQ ID NO: 3258 - RNA, 20 nt, Artificial Sequence
  B2M targeting sequence
auaaccuucauauacuugaa

SEQ ID NO: 3259 - RNA, 20 nt, Artificial Sequence
  B2M targeting sequence
uauacuugaauauugauauc

SEQ ID NO: 3260 - RNA, 20 nt, Artificial Sequence
  B2M targeting sequence
aguauaugaagguuauagaa

SEQ ID NO: 3261 - RNA, 20 nt, Artificial Sequence
  B2M targeting sequence
auauucaaguauaugaaggu

SEQ ID NO: 3262 - RNA, 20 nt, Artificial Sequence
  B2M targeting sequence
uucccuagguuugggaaggu

SEQ ID NO: 3263 - RNA, 20 nt, Artificial Sequence
  B2M targeting sequence
cuagguuugggaaggucuuu

SEQ ID NO: 3264 - RNA, 20 nt, Artificial Sequence
  B2M targeting sequence
caaaccuagggaaagauauc

SEQ ID NO: 3265 - RNA, 20 nt, Artificial Sequence
  B2M targeting sequence
uuguuacuaucacuuugaau

SEQ ID NO: 3266 - RNA, 20 nt, Artificial Sequence
  B2M targeting sequence
cuuugaauaaacuuucuacc

SEQ ID NO: 3267 - RNA, 20 nt, Artificial Sequence
  B2M targeting sequence
aagugauaguaacaaagacc

SEQ ID NO: 3268 - RNA, 20 nt, Artificial Sequence
  B2M targeting sequence
accccaucucucucucuacc

SEQ ID NO: 3269 - RNA, 20 nt, Artificial Sequence
  B2M targeting sequence
cucucucuaccuccucuuua

SEQ ID NO: 3270 - RNA, 20 nt, Artificial Sequence
  B2M targeting sequence
cucucuaccuccucuuuaag

SEQ ID NO: 3271 - RNA, 20 nt, Artificial Sequence
  B2M targeting sequence
cucuaccuccucuuuaaggc

SEQ ID NO: 3272 - RNA, 20 nt, Artificial Sequence
  B2M targeting sequence
cuaccuccucuuuaaggcca

SEQ ID NO: 3273 - RNA, 20 nt, Artificial Sequence
  B2M targeting sequence
accuccucuuuaaggccaau

SEQ ID NO: 3274 - RNA, 20 nt, Artificial Sequence
  B2M targeting sequence
ucuuuaaggccaauaacucu

SEQ ID NO: 3275 - RNA, 20 nt, Artificial Sequence
  B2M targeting sequence
uuaaggccaauaacucuuuu

SEQ ID NO: 3276 - RNA, 20 nt, Artificial Sequence
  B2M targeting sequence
uuuuuuuuucuuuuugagac

SEQ ID NO: 3277 - RNA, 20 nt, Artificial Sequence
  B2M targeting sequence
uuuugagacagagucucacu

SEQ ID NO: 3278 - RNA, 20 nt, Artificial Sequence
  B2M targeting sequence
aaaagaaaaaaaaaagaguu

SEQ ID NO: 3279 - RNA, 20 nt, Artificial Sequence
  B2M targeting sequence
caaaaagaaaaaaaaaagag

SEQ ID NO: 3280 - RNA, 20 nt, Artificial Sequence
  B2M targeting sequence
gucucaaaaagaaaaaaaaa

SEQ ID NO: 3281 - RNA, 20 nt, Artificial Sequence
  B2M targeting sequence
cacuuuguuguccaggcugg

SEQ ID NO: 3282 - RNA, 20 nt, Artificial Sequence
  B2M targeting sequence
cuuuguuguccaggcuggag

SEQ ID NO: 3283 - RNA, 20 nt, Artificial Sequence
  B2M targeting sequence
aggcuggagugcagugcugu

SEQ ID NO: 3284 - RNA, 20 nt, Artificial Sequence
  B2M targeting sequence
agccuggacaacaaagugag

SEQ ID NO: 3285 - RNA, 20 nt, Artificial Sequence
  B2M targeting sequence
cagcacugcacuccagccug

SEQ ID NO: 3286 - RNA, 20 nt, Artificial Sequence
  B2M targeting sequence
ugguucacuacagccuccac

SEQ ID NO: 3287 - RNA, 20 nt, Artificial Sequence
  B2M targeting sequence
cuacagccuccacuucccag

SEQ ID NO: 3288 - RNA, 20 nt, Artificial Sequence
  B2M targeting sequence
acuucccagguucaagcaau

SEQ ID NO: 3289 - RNA, 20 nt, Artificial Sequence
  B2M targeting sequence
cagguucaagcaauucuccu

SEQ ID NO: 3290 - RNA, 20 nt, Artificial Sequence
  B2M targeting sequence
agcaauucuccugccucagc

SEQ ID NO: 3291 - RNA, 20 nt, Artificial Sequence
  B2M targeting sequence
ccugccucagccuccagagu

SEQ ID NO: 3292 - RNA, 20 nt, Artificial Sequence
  B2M targeting sequence
ugccucagccuccagaguag

SEQ ID NO: 3293 - RNA, 20 nt, Artificial Sequence
  B2M targeting sequence
gccuccagaguagccgggau

SEQ ID NO: 3294 - RNA, 20 nt, Artificial Sequence
  B2M targeting sequence
agaguagccgggauuaaagg

SEQ ID NO: 3295 - RNA, 20 nt, Artificial Sequence
  B2M targeting sequence
ggaggcugaggcaggagaau

SEQ ID NO: 3296 - RNA, 20 nt, Artificial Sequence
  B2M targeting sequence
cggcuacucuggaggcugag

SEQ ID NO: 3297 - RNA, 20 nt, Artificial Sequence
  B2M targeting sequence
agcuaauuuuuguauuuuag

SEQ ID NO: 3298 - RNA, 20 nt, Artificial Sequence
  B2M targeting sequence
acuaaaauacaaaaauuagc

SEQ ID NO: 3299 - RNA, 20 nt, Artificial Sequence
  B2M targeting sequence
caacuaaaauacaaaaauua

SEQ ID NO: 3300 - RNA, 20 nt, Artificial Sequence
  B2M targeting sequence
cgauguuggcgaggcugcuc

SEQ ID NO: 3301 - RNA, 20 nt, Artificial Sequence
  B2M targeting sequence
ugaaaccccgucucaacuaa

SEQ ID NO: 3302 - RNA, 20 nt, Artificial Sequence
  B2M targeting sequence
ccaacaucgugaaaccccgu

SEQ ID NO: 3303 - RNA, 20 nt, Artificial Sequence
  B2M targeting sequence
cgaacuccugaccucaugau

SEQ ID NO: 3304 - RNA, 20 nt, Artificial Sequence
  B2M targeting sequence
aacuccugaccucaugaucu

SEQ ID NO: 3305 - RNA, 20 nt, Artificial Sequence
  B2M targeting sequence
agagcagccucgccaacauc

SEQ ID NO: 3306 - RNA, 20 nt, Artificial Sequence
  B2M targeting sequence
ugaccucaugaucugcccac

SEQ ID NO: 3307 - RNA, 20 nt, Artificial Sequence
  B2M targeting sequence
ggaguucgagagcagccucg

SEQ ID NO: 3308 - RNA, 20 nt, Artificial Sequence
  B2M targeting sequence
ugaucugcccaccuuggccu

SEQ ID NO: 3309 - RNA, 20 nt, Artificial Sequence
  B2M targeting sequence
ugaggucaggaguucgagag

SEQ ID NO: 3310 - RNA, 20 nt, Artificial Sequence
  B2M targeting sequence
gcccaccuuggccucccaaa

SEQ ID NO: 3311 - RNA, 20 nt, Artificial Sequence
  B2M targeting sequence
caaagugcugggauuacagg

SEQ ID NO: 3312 - RNA, 20 nt, Artificial Sequence
  B2M targeting sequence
cagcacuuugggaggccaag

SEQ ID NO: 3313 - RNA, 20 nt, Artificial Sequence
  B2M targeting sequence
uguaaucccagcacuuuggg

SEQ ID NO: 3314 - RNA, 20 nt, Artificial Sequence
  B2M targeting sequence
cuccuguaaucccagcacuu

SEQ ID NO: 3315 - RNA, 20 nt, Artificial Sequence
  B2M targeting sequence
uaaauuugccguuuugaggc

SEQ ID NO: 3316 - RNA, 20 nt, Artificial Sequence
  B2M targeting sequence
aaacggcaaauuuaagaguu

SEQ ID NO: 3317 - RNA, 20 nt, Artificial Sequence
  B2M targeting sequence
agaucuuguaggcaugcuuc

SEQ ID NO: 3318 - RNA, 20 nt, Artificial Sequence
  B2M targeting sequence
agaaaauagccucaaaacgg

SEQ ID NO: 3319 - RNA, 20 nt, Artificial Sequence
  B2M targeting sequence
uguaggcaugcuucauucuu

SEQ ID NO: 3320 - RNA, 20 nt, Artificial Sequence
  B2M targeting sequence
uucuuuuuuauucuuuuuuc

SEQ ID NO: 3321 - RNA, 20 nt, Artificial Sequence
  B2M targeting sequence
uuuuuauucuuuuuucuuuu

SEQ ID NO: 3322 - RNA, 20 nt, Artificial Sequence
  B2M targeting sequence
uuuuucuuuugucucuucug

SEQ ID NO: 3323 - RNA, 20 nt, Artificial Sequence
  B2M targeting sequence
uuugucucuucugauuauau

SEQ ID NO: 3324 - RNA, 20 nt, Artificial Sequence
  B2M targeting sequence
cuucugauuauauuuucaaa

SEQ ID NO: 3325 - RNA, 20 nt, Artificial Sequence
  B2M targeting sequence
ucugauuauauuuucaaauu

SEQ ID NO: 3326 - RNA, 20 nt, Artificial Sequence
  B2M targeting sequence
gauuauauuuucaaauugcc

SEQ ID NO: 3327 - RNA, 20 nt, Artificial Sequence
  B2M targeting sequence
gaagagacaaaagaaaaaag

SEQ ID NO: 3328 - RNA, 20 nt, Artificial Sequence
  B2M targeting sequence
aauugccugucuucaagcuc

SEQ ID NO: 3329 - RNA, 20 nt, Artificial Sequence
  B2M targeting sequence
ucaagcucacuaauucuuuc

SEQ ID NO: 3330 - RNA, 20 nt, Artificial Sequence
  B2M targeting sequence
agcucacuaauucuuucuuc

SEQ ID NO: 3331 - RNA, 20 nt, Artificial Sequence
  B2M targeting sequence
cuaauucuuucuuccacuug

SEQ ID NO: 3332 - RNA, 20 nt, Artificial Sequence
  B2M targeting sequence
uucuuccacuugaucaguuc

SEQ ID NO: 3333 - RNA, 20 nt, Artificial Sequence
  B2M targeting sequence
uccacuugaucaguucuacu

SEQ ID NO: 3334 - RNA, 20 nt, Artificial Sequence
  B2M targeting sequence
acuugaucaguucuacugau

SEQ ID NO: 3335 - RNA, 20 nt, Artificial Sequence
  B2M targeting sequence
aguggaagaaagaauuagug

SEQ ID NO: 3336 - RNA, 20 nt, Artificial Sequence
  B2M targeting sequence
guucuacugauaagagaguc

SEQ ID NO: 3337 - RNA, 20 nt, Artificial Sequence
  B2M targeting sequence
acugauaagagagucugaug

SEQ ID NO: 3338 - RNA, 20 nt, Artificial Sequence
  B2M targeting sequence
guagaacugaucaaguggaa

SEQ ID NO: 3339 - RNA, 20 nt, Artificial Sequence
  B2M targeting sequence
uaucaguagaacugaucaag

SEQ ID NO: 3340 - RNA, 20 nt, Artificial Sequence
  B2M targeting sequence
cuuaucaguagaacugauca

SEQ ID NO: 3341 - RNA, 20 nt, Artificial Sequence
  B2M targeting sequence
gaugcacccuuauguauguc

SEQ ID NO: 3342 - RNA, 20 nt, Artificial Sequence
  B2M targeting sequence
gacucucuuaucaguagaac

SEQ ID NO: 3343 - RNA, 20 nt, Artificial Sequence
  B2M targeting sequence
guaucauuuuucaacuccau

SEQ ID NO: 3344 - RNA, 20 nt, Artificial Sequence
  B2M targeting sequence
uuuuucaacuccauaauuuu

SEQ ID NO: 3345 - RNA, 20 nt, Artificial Sequence
  B2M targeting sequence
acuccauaauuuuugcuuga

SEQ ID NO: 3346 - RNA, 20 nt, Artificial Sequence
  B2M targeting sequence
auaauuuuugcuugauucuu

SEQ ID NO: 3347 - RNA, 20 nt, Artificial Sequence
  B2M targeting sequence
agcaaaaauuauggaguuga

SEQ ID NO: 3348 - RNA, 20 nt, Artificial Sequence
  B2M targeting sequence
uuuuaguuauuuuaaucucu

SEQ ID NO: 3349 - RNA, 20 nt, Artificial Sequence
  B2M targeting sequence
cuuuguuaaaguuauaugau

SEQ ID NO: 3350 - RNA, 20 nt, Artificial Sequence
  B2M targeting sequence
uuguuaaaguuauaugauag

SEQ ID NO: 3351 - RNA, 20 nt, Artificial Sequence
  B2M targeting sequence
uauaacuuuaacaaagagau

SEQ ID NO: 3352 - RNA, 20 nt, Artificial Sequence
  B2M targeting sequence
uaucauauaacuuuaacaaa

SEQ ID NO: 3353 - RNA, 20 nt, Artificial Sequence
  B2M targeting sequence
gaauuccuucucuguguuag

SEQ ID NO: 3354 - RNA, 20 nt, Artificial Sequence
  B2M targeting sequence
gaauccuaucauauaacuuu

SEQ ID NO: 3355 - RNA, 20 nt, Artificial Sequence
  B2M targeting sequence
uucucuguguuagcuuuaau

SEQ ID NO: 3356 - RNA, 20 nt, Artificial Sequence
  B2M targeting sequence
cuguguuagcuuuaauuucu

SEQ ID NO: 3357 - RNA, 20 nt, Artificial Sequence
  B2M targeting sequence
guguuagcuuuaauuucuuu

SEQ ID NO: 3358 - RNA, 20 nt, Artificial Sequence
  B2M targeting sequence
uugaguuuccucaaaacauu

SEQ ID NO: 3359 - RNA, 20 nt, Artificial Sequence
  B2M targeting sequence
aagaaauuaaagcuaacaca

SEQ ID NO: 3360 - RNA, 20 nt, Artificial Sequence
  B2M targeting sequence
ucaaaacauuguuuuuuuuu

SEQ ID NO: 3361 - RNA, 20 nt, Artificial Sequence
  B2M targeting sequence
aaacauuguuuuuuuuuaga

SEQ ID NO: 3362 - RNA, 20 nt, Artificial Sequence
  B2M targeting sequence
aaaaaaaaacaauguuuuga

SEQ ID NO: 3363 - RNA, 20 nt, Artificial Sequence
  B2M targeting sequence
gucuaaaaaaaaacaauguu

SEQ ID NO: 3364 - RNA, 20 nt, Artificial Sequence
  B2M targeting sequence
ugcucaguugcccaggcugg

SEQ ID NO: 3365 - RNA, 20 nt, Artificial Sequence
  B2M targeting sequence
guugcccaggcuggaguaca

SEQ ID NO: 3366 - RNA, 20 nt, Artificial Sequence
  B2M targeting sequence
agccugggcaacugagcaag

SEQ ID NO: 3367 - RNA, 20 nt, Artificial Sequence
  B2M targeting sequence
uaccacuguacuccagccug

SEQ ID NO: 3368 - RNA, 20 nt, Artificial Sequence
  B2M targeting sequence
uggcucacugaaucuccgcc

SEQ ID NO: 3369 - RNA, 20 nt, Artificial Sequence
  B2M targeting sequence
cugaaucuccgccucccaag

SEQ ID NO: 3370 - RNA, 20 nt, Artificial Sequence
  B2M targeting sequence
gugagccaagaucauaccac

SEQ ID NO: 3371 - RNA, 20 nt, Artificial Sequence
  B2M targeting sequence
ccgccucccaaguuuaagca

SEQ ID NO: 3372 - RNA, 20 nt, Artificial Sequence
  B2M targeting sequence
gccucccaaguuuaagcaau

SEQ ID NO: 3373 - RNA, 20 nt, Artificial Sequence
  B2M targeting sequence
caaguuuaagcaauucuccu

SEQ ID NO: 3374 - RNA, 20 nt, Artificial Sequence
  B2M targeting sequence
ccugccucagccuccugagu

SEQ ID NO: 3375 - RNA, 20 nt, Artificial Sequence
  B2M targeting sequence
ugccucagccuccugaguag

SEQ ID NO: 3376 - RNA, 20 nt, Artificial Sequence
  B2M targeting sequence
gccuccugaguagcugggau

SEQ ID NO: 3377 - RNA, 20 nt, Artificial Sequence
  B2M targeting sequence
ugaguagcugggauuacaag

SEQ ID NO: 3378 - RNA, 20 nt, Artificial Sequence
  B2M targeting sequence
ggaggcugaggcaggagaau

SEQ ID NO: 3379 - RNA, 20 nt, Artificial Sequence
  B2M targeting sequence
cagcuacucaggaggcugag

SEQ ID NO: 3380 - RNA, 20 nt, Artificial Sequence
  B2M targeting sequence
acuaaaaauacaaaaauagc

SEQ ID NO: 3381 - RNA, 20 nt, Artificial Sequence
  B2M targeting sequence
cuacuaaaaauacaaaaaua

SEQ ID NO: 3382 - RNA, 20 nt, Artificial Sequence
  B2M targeting sequence
ccauguuggccaagcugguc

SEQ ID NO: 3383 - RNA, 20 nt, Artificial Sequence
  B2M targeting sequence
ugaacuccugagcucaagug

SEQ ID NO: 3384 - RNA, 20 nt, Artificial Sequence
  B2M targeting sequence
agaccagcuuggccaacaug

SEQ ID NO: 3385 - RNA, 20 nt, Artificial Sequence
  B2M targeting sequence
ugagcucaagugaucuaccc

SEQ ID NO: 3386 - RNA, 20 nt, Artificial Sequence
  B2M targeting sequence
ggaguucaagaccagcuugg

SEQ ID NO: 3387 - RNA, 20 nt, Artificial Sequence
  B2M targeting sequence
agugaucuacccaccuuggc

SEQ ID NO: 3388 - RNA, 20 nt, Artificial Sequence
  B2M targeting sequence
cuugagcucaggaguucaag

SEQ ID NO: 3389 - RNA, 20 nt, Artificial Sequence
  B2M targeting sequence
acccaccuuggccucccaga

SEQ ID NO: 3390 - RNA, 20 nt, Artificial Sequence
  B2M targeting sequence
cagaauguugggauuacagg

SEQ ID NO: 3391 - RNA, 20 nt, Artificial Sequence
  B2M targeting sequence
gggaggccaagguggguaga

SEQ ID NO: 3392 - RNA, 20 nt, Artificial Sequence
  B2M targeting sequence
caacauucugggaggccaag

SEQ ID NO: 3393 - RNA, 20 nt, Artificial Sequence
  B2M targeting sequence
caccuguaaucccaacauuc

SEQ ID NO: 3394 - RNA, 20 nt, Artificial Sequence
  B2M targeting sequence
ggcacgguggcucacaccug

SEQ ID NO: 3395 - RNA, 20 nt, Artificial Sequence
  B2M targeting sequence
aaauagcuguuuuggucagg

SEQ ID NO: 3396 - RNA, 20 nt, Artificial Sequence
  B2M targeting sequence
guuucaaaggucacauaucu

SEQ ID NO: 3397 - RNA, 20 nt, Artificial Sequence
  B2M targeting sequence
aaggucacauaucucuguuu

SEQ ID NO: 3398 - RNA, 20 nt, Artificial Sequence
  B2M targeting sequence
cauaucucuguuucucuggg

SEQ ID NO: 3399 - RNA, 20 nt, Artificial Sequence
  B2M targeting sequence
cuguuucucugggauuggcc

SEQ ID NO: 3400 - RNA, 20 nt, Artificial Sequence
  B2M targeting sequence
guuucucugggauuggccuc

SEQ ID NO: 3401 - RNA, 20 nt, Artificial Sequence
  B2M targeting sequence
cugggauuggccucuggugc

SEQ ID NO: 3402 - RNA, 20 nt, Artificial Sequence
  B2M targeting sequence
gggauuggccucuggugccu

SEQ ID NO: 3403 - RNA, 20 nt, Artificial Sequence
  B2M targeting sequence
cagagaaacagagauaugug

SEQ ID NO: 3404 - RNA, 20 nt, Artificial Sequence
  B2M targeting sequence
ggugccuuauucauuugaug

SEQ ID NO: 3405 - RNA, 20 nt, Artificial Sequence
  B2M targeting sequence
uuugaugaggucauguuuuc

SEQ ID NO: 3406 - RNA, 20 nt, Artificial Sequence
  B2M targeting sequence
aaugaauaaggcaccagagg

SEQ ID NO: 3407 - RNA, 20 nt, Artificial Sequence
  B2M targeting sequence
ucaaaugaauaaggcaccag

SEQ ID NO: 3408 - RNA, 20 nt, Artificial Sequence
  B2M targeting sequence
uguuuuccuggcugguccug

SEQ ID NO: 3409 - RNA, 20 nt, Artificial Sequence
  B2M targeting sequence
uggcugguccugaugcuugu

SEQ ID NO: 3410 - RNA, 20 nt, Artificial Sequence
  B2M targeting sequence
ugaugcuuguggauguucau

SEQ ID NO: 3411 - RNA, 20 nt, Artificial Sequence
  B2M targeting sequence
ggaccagccaggaaaacaug

SEQ ID NO: 3412 - RNA, 20 nt, Artificial Sequence
  B2M targeting sequence
acaagcaucaggaccagcca

SEQ ID NO: 3413 - RNA, 20 nt, Artificial Sequence
  B2M targeting sequence
ucagugucugaguuaaauau

SEQ ID NO: 3414 - RNA, 20 nt, Artificial Sequence
  B2M targeting sequence
gugucugaguuaaauauuua

SEQ ID NO: 3415 - RNA, 20 nt, Artificial Sequence
  B2M targeting sequence
gaguuaaauauuuauuauag

SEQ ID NO: 3416 - RNA, 20 nt, Artificial Sequence
  B2M targeting sequence
gacacugaugaacauccaca

SEQ ID NO: 3417 - RNA, 20 nt, Artificial Sequence
  B2M targeting sequence
uugcagucugggcuguuugu

SEQ ID NO: 3418 - RNA, 20 nt, Artificial Sequence
  B2M targeting sequence
gggcuguuuguaucuguccu

SEQ ID NO: 3419 - RNA, 20 nt, Artificial Sequence
  B2M targeting sequence
guccuucuugggaaggcuuu

SEQ ID NO: 3420 - RNA, 20 nt, Artificial Sequence
  B2M targeting sequence
uucuugggaaggcuuuccag

SEQ ID NO: 3421 - RNA, 20 nt, Artificial Sequence
  B2M targeting sequence
ugggaaggcuuuccaggaau

SEQ ID NO: 3422 - RNA, 20 nt, Artificial Sequence
  B2M targeting sequence
caagaaggacagauacaaac

SEQ ID NO: 3423 - RNA, 20 nt, Artificial Sequence
  B2M targeting sequence
aggaauucaaaggaacuugg

SEQ ID NO: 3424 - RNA, 20 nt, Artificial Sequence
  B2M targeting sequence
uggaaagccuucccaagaag

SEQ ID NO: 3425 - RNA, 20 nt, Artificial Sequence
  B2M targeting sequence
aaggaacuuggguguuguga

SEQ ID NO: 3426 - RNA, 20 nt, Artificial Sequence
  B2M targeting sequence
uuugaauuccuggaaagccu

SEQ ID NO: 3427 - RNA, 20 nt, Artificial Sequence
  B2M targeting sequence
caacacccaaguuccuuuga

SEQ ID NO: 3428 - RNA, 20 nt, Artificial Sequence
  B2M targeting sequence
aaguuuuuggucacugcagc

SEQ ID NO: 3429 - RNA, 20 nt, Artificial Sequence
  B2M targeting sequence
cugcagcuguaucugcauua

SEQ ID NO: 3430 - RNA, 20 nt, Artificial Sequence
  B2M targeting sequence
gcauuagagggcacaccaag

SEQ ID NO: 3431 - RNA, 20 nt, Artificial Sequence
  B2M targeting sequence
aaugcagauacagcugcagu

SEQ ID NO: 3432 - RNA, 20 nt, Artificial Sequence
  B2M targeting sequence
gugcuuggugugcccucuaa

SEQ ID NO: 3433 - RNA, 20 nt, Artificial Sequence
  B2M targeting sequence
uucacagucuguuguaucuu

SEQ ID NO: 3434 - RNA, 20 nt, Artificial Sequence
  B2M targeting sequence
cagucuguuguaucuuuuuu

SEQ ID NO: 3435 - RNA, 20 nt, Artificial Sequence
  B2M targeting sequence
guuguaucuuuuuugauuug

SEQ ID NO: 3436 - RNA, 20 nt, Artificial Sequence
  B2M targeting sequence
uuuuugauuugagguuacca

SEQ ID NO: 3437 - RNA, 20 nt, Artificial Sequence
  B2M targeting sequence
aaaaagauacaacagacugu

SEQ ID NO: 3438 - RNA, 20 nt, Artificial Sequence
  B2M targeting sequence
aaucaaaaaagauacaacag

SEQ ID NO: 3439 - RNA, 20 nt, Artificial Sequence
  B2M targeting sequence
ugguaaccucaaaucaaaaa

SEQ ID NO: 3440 - RNA, 20 nt, Artificial Sequence
  B2M targeting sequence
gcaaaccucaugguaaccuc

SEQ ID NO: 3441 - RNA, 20 nt, Artificial Sequence
  B2M targeting sequence
cucauuauuuuaaacugcug

SEQ ID NO: 3442 - RNA, 20 nt, Artificial Sequence
  B2M targeting sequence
uuauuuuaaacugcugacaa

SEQ ID NO: 3443 - RNA, 20 nt, Artificial Sequence
  B2M targeting sequence
gcaguuuaaaauaaugagug

SEQ ID NO: 3444 - RNA, 20 nt, Artificial Sequence
  B2M targeting sequence
guguuaaguugucagcaguu

SEQ ID NO: 3445 - RNA, 20 nt, Artificial Sequence
  B2M targeting sequence
uagaggcacugccauggugg

SEQ ID NO: 3446 - RNA, 20 nt, Artificial Sequence
  B2M targeting sequence
augaguaaucaguguuaagu

SEQ ID NO: 3447 - RNA, 20 nt, Artificial Sequence
  B2M targeting sequence
uggauaagaucuggaagaau

SEQ ID NO: 3448 - RNA, 20 nt, Artificial Sequence
  B2M targeting sequence
aagaccaccauggcagugcc

SEQ ID NO: 3449 - RNA, 20 nt, Artificial Sequence
  B2M targeting sequence
uauccaagaccaccauggca

SEQ ID NO: 3450 - RNA, 20 nt, Artificial Sequence
  B2M targeting sequence
ggaagaauucucuggauuac

SEQ ID NO: 3451 - RNA, 20 nt, Artificial Sequence
  B2M targeting sequence
agaucuuauccaagaccacc

SEQ ID NO: 3452 - RNA, 20 nt, Artificial Sequence
  B2M targeting sequence
uccagaucuuauccaagacc

SEQ ID NO: 3453 - RNA, 20 nt, Artificial Sequence
  B2M targeting sequence
cuggauuaccaggcagagac

SEQ ID NO: 3454 - RNA, 20 nt, Artificial Sequence
  B2M targeting sequence
ggauuaccaggcagagacuc

SEQ ID NO: 3455 - RNA, 20 nt, Artificial Sequence
  B2M targeting sequence
agagaauucuuccagaucuu

SEQ ID NO: 3456 - RNA, 20 nt, Artificial Sequence
  B2M targeting sequence
gccugguaauccagagaauu

SEQ ID NO: 3457 - RNA, 20 nt, Artificial Sequence
  B2M targeting sequence
cugccugguaauccagagaa

SEQ ID NO: 3458 - RNA, 20 nt, Artificial Sequence
  B2M targeting sequence
uauugucuucccuuauuuuc

SEQ ID NO: 3459 - RNA, 20 nt, Artificial Sequence
  B2M targeting sequence
ucccuuauuuucccccaggc

SEQ ID NO: 3460 - RNA, 20 nt, Artificial Sequence
  B2M targeting sequence
cuuauuuucccccaggcaaa

SEQ ID NO: 3461 - RNA, 20 nt, Artificial Sequence
  B2M targeting sequence
cccaggcaaagucugucuuu

SEQ ID NO: 3462 - RNA, 20 nt, Artificial Sequence
  B2M targeting sequence
gucuuucugugaucagcugc

SEQ ID NO: 3463 - RNA, 20 nt, Artificial Sequence
  B2M targeting sequence
uucugugaucagcugccugg

SEQ ID NO: 3464 - RNA, 20 nt, Artificial Sequence
  B2M targeting sequence
gugaucagcugccuggaguu

SEQ ID NO: 3465 - RNA, 20 nt, Artificial Sequence
  B2M targeting sequence
cagaaagacagacuuugccu

SEQ ID NO: 3466 - RNA, 20 nt, Artificial Sequence
  B2M targeting sequence
gcugccuggaguugggggag

SEQ ID NO: 3467 - RNA, 20 nt, Artificial Sequence
  B2M targeting sequence
aggcagcugaucacagaaag

SEQ ID NO: 3468 - RNA, 20 nt, Artificial Sequence
  B2M targeting sequence
cccaacuccaggcagcugau

SEQ ID NO: 3469 - RNA, 20 nt, Artificial Sequence
  B2M targeting sequence
cccccaacuccaggcagcug

SEQ ID NO: 3470 - RNA, 20 nt, Artificial Sequence
  B2M targeting sequence
cuucucccccaacuccaggc

SEQ ID NO: 3471 - RNA, 20 nt, Artificial Sequence
  B2M targeting sequence
cagggguguuugugucacuu

SEQ ID NO: 3472 - RNA, 20 nt, Artificial Sequence
  B2M targeting sequence
cagugguggucacaggggug

SEQ ID NO: 3473 - RNA, 20 nt, Artificial Sequence
  B2M targeting sequence
gacgugaagccagcauagua

SEQ ID NO: 3474 - RNA, 20 nt, Artificial Sequence
  B2M targeting sequence
gacccugcacagucccagug

SEQ ID NO: 3475 - RNA, 20 nt, Artificial Sequence
  B2M targeting sequence
cgucugacccugcacagucc

SEQ ID NO: 3476 - RNA, 20 nt, Artificial Sequence
  B2M targeting sequence
ugcccaaggccuaugguaac

SEQ ID NO: 3477 - RNA, 20 nt, Artificial Sequence
  B2M targeting sequence
cucaaggcccuauggcucua

SEQ ID NO: 3478 - RNA, 20 nt, Artificial Sequence
  B2M targeting sequence
aggcccuauggcucuaaaau

SEQ ID NO: 3479 - RNA, 20 nt, Artificial Sequence
  B2M targeting sequence
aaaaucagcagguggcaaag

SEQ ID NO: 3480 - RNA, 20 nt, Artificial Sequence
  B2M targeting sequence
gcagguggcaaagccagcca

SEQ ID NO: 3481 - RNA, 20 nt, Artificial Sequence
  B2M targeting sequence
cucucuuuaggguggcaagu

SEQ ID NO: 3482 - RNA, 20 nt, Artificial Sequence
  B2M targeting sequence
cuuuaggguggcaaguuucc

SEQ ID NO: 3483 - RNA, 20 nt, Artificial Sequence
  B2M targeting sequence
uuaggguggcaaguuucccc

SEQ ID NO: 3484 - RNA, 20 nt, Artificial Sequence
  B2M targeting sequence
cccagccuggggugaaucca

SEQ ID NO: 3485 - RNA, 20 nt, Artificial Sequence
  B2M targeting sequence
ccccaggcugggggaaacuu

SEQ ID NO: 3486 - RNA, 20 nt, Artificial Sequence
  B2M targeting sequence
agagaugccuuccaggaacu

SEQ ID NO: 3487 - RNA, 20 nt, Artificial Sequence
  B2M targeting sequence
ggauucaccccaggcugggg

SEQ ID NO: 3488 - RNA, 20 nt, Artificial Sequence
  B2M targeting sequence
cuggauucaccccaggcugg

SEQ ID NO: 3489 - RNA, 20 nt, Artificial Sequence
  B2M targeting sequence
aggaacuggggccuagucag

SEQ ID NO: 3490 - RNA, 20 nt, Artificial Sequence
  B2M targeting sequence
uggaaggcaucucuggauuc

SEQ ID NO: 3491 - RNA, 20 nt, Artificial Sequence
  B2M targeting sequence
gaaaccuuaggaaucuaccu

SEQ ID NO: 3492 - RNA, 20 nt, Artificial Sequence
  B2M targeting sequence
gacuaggccccaguuccugg

SEQ ID NO: 3493 - RNA, 20 nt, Artificial Sequence
  B2M targeting sequence
uaagguuucugacuaggccc

SEQ ID NO: 3494 - RNA, 20 nt, Artificial Sequence
  B2M targeting sequence
accugguacucuauugcacu

SEQ ID NO: 3495 - RNA, 20 nt, Artificial Sequence
  B2M targeting sequence
auugcacugaggcugaacug

SEQ ID NO: 3496 - RNA, 20 nt, Artificial Sequence
  B2M targeting sequence
gugcaauagaguaccaggua

SEQ ID NO: 3497 - RNA, 20 nt, Artificial Sequence
  B2M targeting sequence
gccucagugcaauagaguac

SEQ ID NO: 3498 - RNA, 20 nt, Artificial Sequence
  B2M targeting sequence
uguggcuugggugccaguuc

SEQ ID NO: 3499 - RNA, 20 nt, Artificial Sequence
  B2M targeting sequence
uucccacuuuucccuccccu

SEQ ID NO: 3500 - RNA, 20 nt, Artificial Sequence
  B2M targeting sequence
cacuuuucccuccccuuucc

SEQ ID NO: 3501 - RNA, 20 nt, Artificial Sequence
  B2M targeting sequence
cuccccuuuccacaagcuga

SEQ ID NO: 3502 - RNA, 20 nt, Artificial Sequence
  B2M targeting sequence
ccuuuccacaagcugaggag

SEQ ID NO: 3503 - RNA, 20 nt, Artificial Sequence
  B2M targeting sequence
acaagcugaggagucucuug

SEQ ID NO: 3504 - RNA, 20 nt, Artificial Sequence
  B2M targeting sequence
gcuuguggaaaggggaggga

SEQ ID NO: 3505 - RNA, 20 nt, Artificial Sequence
  B2M targeting sequence
ucagcuuguggaaaggggag

SEQ ID NO: 3506 - RNA, 20 nt, Artificial Sequence
  B2M targeting sequence
cuugccauggccacuuccac

SEQ ID NO: 3507 - RNA, 20 nt, Artificial Sequence
  B2M targeting sequence
ugccauggccacuuccaccc

SEQ ID NO: 3508 - RNA, 20 nt, Artificial Sequence
  B2M targeting sequence
accccaggccuguggugggu

SEQ ID NO: 3509 - RNA, 20 nt, Artificial Sequence
  B2M targeting sequence
ggcuacugcugauguauacu

SEQ ID NO: 3510 - RNA, 20 nt, Artificial Sequence
  B2M targeting sequence
gcaguagccagacaguaccc

SEQ ID NO: 3511 - RNA, 20 nt, Artificial Sequence
  B2M targeting sequence
aggcccaagggcucugcagu

SEQ ID NO: 3512 - RNA, 20 nt, Artificial Sequence
  B2M targeting sequence
gcaguaagcuuguggugaac

SEQ ID NO: 3513 - RNA, 20 nt, Artificial Sequence
  B2M targeting sequence
ccacaagcuuacugcagagc

SEQ ID NO: 3514 - RNA, 20 nt, Artificial Sequence
  B2M targeting sequence
caggcugggcagcguucacc

SEQ ID NO: 3515 - RNA, 20 nt, Artificial Sequence
  B2M targeting sequence
cccuucagggaagcaggcuc

SEQ ID NO: 3516 - RNA, 20 nt, Artificial Sequence
  B2M targeting sequence
gggaagcaggcuccccucug

SEQ ID NO: 3517 - RNA, 20 nt, Artificial Sequence
  B2M targeting sequence
cugaagggugagucccaggc

SEQ ID NO: 3518 - RNA, 20 nt, Artificial Sequence
  B2M targeting sequence
ccucuggcccagagcagguc

SEQ ID NO: 3519 - RNA, 20 nt, Artificial Sequence
  B2M targeting sequence
ggcccagagcagguccagga

SEQ ID NO: 3520 - RNA, 20 nt, Artificial Sequence
  B2M targeting sequence
gggccagaggggagccugcu

SEQ ID NO: 3521 - RNA, 20 nt, Artificial Sequence
  B2M targeting sequence
aggaaugcuaucuaagagcc

SEQ ID NO: 3522 - RNA, 20 nt, Artificial Sequence
  B2M targeting sequence
uggaccugcucugggccaga

SEQ ID NO: 3523 - RNA, 20 nt, Artificial Sequence
  B2M targeting sequence
aagagccaaagccuggaauc

SEQ ID NO: 3524 - RNA, 20 nt, Artificial Sequence
  B2M targeting sequence
uagauagcauuccuggaccu

SEQ ID NO: 3525 - RNA, 20 nt, Artificial Sequence
  B2M targeting sequence
aggcuuuggcucuuagauag

SEQ ID NO: 3526 - RNA, 20 nt, Artificial Sequence
  B2M targeting sequence
gggaccuuaagaggccacuu

SEQ ID NO: 3527 - RNA, 20 nt, Artificial Sequence
  B2M targeting sequence
cugauuccaggcuuuggcuc

SEQ ID NO: 3528 - RNA, 20 nt, Artificial Sequence
  B2M targeting sequence
uaaggucccugauuccaggc

SEQ ID NO: 3529 - RNA, 20 nt, Artificial Sequence
  B2M targeting sequence
aaccccacaguggccaaguc

SEQ ID NO: 3530 - RNA, 20 nt, Artificial Sequence
  B2M targeting sequence
ccuuuacucuuuccacuucu

SEQ ID NO: 3531 - RNA, 20 nt, Artificial Sequence
  B2M targeting sequence
uuccacuucuuuucucaagc

SEQ ID NO: 3532 - RNA, 20 nt, Artificial Sequence
  B2M targeting sequence
acuucuuuucucaagcagaa

SEQ ID NO: 3533 - RNA, 20 nt, Artificial Sequence
  B2M targeting sequence
uuucucaagcagaaggaauu

SEQ ID NO: 3534 - RNA, 20 nt, Artificial Sequence
  B2M targeting sequence
caagcagaaggaauuucucc

SEQ ID NO: 3535 - RNA, 20 nt, Artificial Sequence
  B2M targeting sequence
agcagaaggaauuucucccc

SEQ ID NO: 3536 - RNA, 20 nt, Artificial Sequence
  B2M targeting sequence
gcuugagaaaagaaguggaa

SEQ ID NO: 3537 - RNA, 20 nt, Artificial Sequence
  B2M targeting sequence
uucugcuugagaaaagaagu

SEQ ID NO: 3538 - RNA, 20 nt, Artificial Sequence
  B2M targeting sequence
ccccauagccaccacagcug

SEQ ID NO: 3539 - RNA, 20 nt, Artificial Sequence
  B2M targeting sequence
ccauagccaccacagcugua

SEQ ID NO: 3540 - RNA, 20 nt, Artificial Sequence
  B2M targeting sequence
caccuuaagccugcacgucu

SEQ ID NO: 3541 - RNA, 20 nt, Artificial Sequence
  B2M targeting sequence
cugagucucacccaaagccc

SEQ ID NO: 3542 - RNA, 20 nt, Artificial Sequence
  B2M targeting sequence
gagucucacccaaagcccau

SEQ ID NO: 3543 - RNA, 20 nt, Artificial Sequence
  B2M targeting sequence
gagacgugcaggcuuaaggu

SEQ ID NO: 3544 - RNA, 20 nt, Artificial Sequence
  B2M targeting sequence
cacccaaagcccaugaugag

SEQ ID NO: 3545 - RNA, 20 nt, Artificial Sequence
  B2M targeting sequence
cccaaagcccaugaugagua

SEQ ID NO: 3546 - RNA, 20 nt, Artificial Sequence
  B2M targeting sequence
ugggcuuugggugagacuca

SEQ ID NO: 3547 - RNA, 20 nt, Artificial Sequence
  B2M targeting sequence
ucaugggcuuugggugagac

SEQ ID NO: 3548 - RNA, 20 nt, Artificial Sequence
  B2M targeting sequence
gauuauucagggccaaaggg

SEQ ID NO: 3549 - RNA, 20 nt, Artificial Sequence
  B2M targeting sequence
gaaguagccagguaguacuc

SEQ ID NO: 3550 - RNA, 20 nt, Artificial Sequence
  B2M targeting sequence
gggccaaagggcucuuuagu

SEQ ID NO: 3551 - RNA, 20 nt, Artificial Sequence
  B2M targeting sequence
uuagucagcuggugaggaau

SEQ ID NO: 3552 - RNA, 20 nt, Artificial Sequence
  B2M targeting sequence
gcuggugaggaauccugcca

SEQ ID NO: 3553 - RNA, 20 nt, Artificial Sequence
  B2M targeting sequence
ccagcugacuaaagagcccu

SEQ ID NO: 3554 - RNA, 20 nt, Artificial Sequence
  B2M targeting sequence
ucaccagcugacuaaagagc

SEQ ID NO: 3555 - RNA, 20 nt, Artificial Sequence
  B2M targeting sequence
ugccaggacugguccuuccc

SEQ ID NO: 3556 - RNA, 20 nt, Artificial Sequence
  B2M targeting sequence
uggcaggauuccucaccagc

SEQ ID NO: 3557 - RNA, 20 nt, Artificial Sequence
  B2M targeting sequence
uucccuucaaggcagcaggu

SEQ ID NO: 3558 - RNA, 20 nt, Artificial Sequence
  B2M targeting sequence
cuucaaggcagcagguuccc

SEQ ID NO: 3559 - RNA, 20 nt, Artificial Sequence
  B2M targeting sequence
aggcagcagguucccuucug

SEQ ID NO: 3560 - RNA, 20 nt, Artificial Sequence
  B2M targeting sequence
cuucuggcccaggguguggc

SEQ ID NO: 3561 - RNA, 20 nt, Artificial Sequence
  B2M targeting sequence
ggcccaggguguggcuagaa

SEQ ID NO: 3562 - RNA, 20 nt, Artificial Sequence
  B2M targeting sequence
agccacacccugggccagaa

SEQ ID NO: 3563 - RNA, 20 nt, Artificial Sequence
  B2M targeting sequence
gcuuggagcuauggccugga

SEQ ID NO: 3564 - RNA, 20 nt, Artificial Sequence
  B2M targeting sequence
aagcugacauuucuagccac

SEQ ID NO: 3565 - RNA, 20 nt, Artificial Sequence
  B2M targeting sequence
aggccauagcuccaagcuga

SEQ ID NO: 3566 - RNA, 20 nt, Artificial Sequence
  B2M targeting sequence
ggacuuugccuggugcccua

SEQ ID NO: 3567 - RNA, 20 nt, Artificial Sequence
  B2M targeting sequence
ugaggcccacauuccaggcc

SEQ ID NO: 3568 - RNA, 20 nt, Artificial Sequence
  B2M targeting sequence
uacugcagcugagcugguau

SEQ ID NO: 3569 - RNA, 20 nt, Artificial Sequence
  B2M targeting sequence
gcugcaguaggauagggcac

SEQ ID NO: 3570 - RNA, 20 nt, Artificial Sequence
  B2M targeting sequence
aaugcaagacaaacucaucu

SEQ ID NO: 3571 - RNA, 20 nt, Artificial Sequence
  B2M targeting sequence
ugcauuggauaccagcucag

SEQ ID NO: 3572 - RNA, 20 nt, Artificial Sequence
  B2M targeting sequence
ucuuuguucuucccucuccu

SEQ ID NO: 3573 - RNA, 20 nt, Artificial Sequence
  B2M targeting sequence
uuguucuucccucuccucuu

SEQ ID NO: 3574 - RNA, 20 nt, Artificial Sequence
  B2M targeting sequence
ucccucuccucuucucaagc

SEQ ID NO: 3575 - RNA, 20 nt, Artificial Sequence
  B2M targeting sequence
cucuccucuucucaagcaga

SEQ ID NO: 3576 - RNA, 20 nt, Artificial Sequence
  B2M targeting sequence
ccucuucucaagcagaggaa

SEQ ID NO: 3577 - RNA, 20 nt, Artificial Sequence
  B2M targeting sequence
ucuucucaagcagaggaaag

SEQ ID NO: 3578 - RNA, 20 nt, Artificial Sequence
  B2M targeting sequence
ucucaagcagaggaaagaag

SEQ ID NO: 3579 - RNA, 20 nt, Artificial Sequence
  B2M targeting sequence
caagcagaggaaagaagucu

SEQ ID NO: 3580 - RNA, 20 nt, Artificial Sequence
  B2M targeting sequence
agcagaggaaagaagucucu

SEQ ID NO: 3581 - RNA, 20 nt, Artificial Sequence
  B2M targeting sequence
gcuugagaagaggagaggga

SEQ ID NO: 3582 - RNA, 20 nt, Artificial Sequence
  B2M targeting sequence
ucugcuugagaagaggagag

SEQ ID NO: 3583 - RNA, 20 nt, Artificial Sequence
  B2M targeting sequence
uuccucugcuugagaagagg

SEQ ID NO: 3584 - RNA, 20 nt, Artificial Sequence
  B2M targeting sequence
cucucugagcuuugagcugc

SEQ ID NO: 3585 - RNA, 20 nt, Artificial Sequence
  B2M targeting sequence
cucugagcuuugagcugccc

SEQ ID NO: 3586 - RNA, 20 nt, Artificial Sequence
  B2M targeting sequence
cugagcuuugagcugcccug

SEQ ID NO: 3587 - RNA, 20 nt, Artificial Sequence
  B2M targeting sequence
gagcuuugagcugcccugcc

SEQ ID NO: 3588 - RNA, 20 nt, Artificial Sequence
  B2M targeting sequence
gagagagacuucuuuccucu

SEQ ID NO: 3589 - RNA, 20 nt, Artificial Sequence
  B2M targeting sequence
aagcucagagagagacuucu

SEQ ID NO: 3590 - RNA, 20 nt, Artificial Sequence
  B2M targeting sequence
caaccccaggcagggcagcu

SEQ ID NO: 3591 - RNA, 20 nt, Artificial Sequence
  B2M targeting sequence
cccaaccccaggcagggcag

SEQ ID NO: 3592 - RNA, 20 nt, Artificial Sequence
  B2M targeting sequence
cuuggccaucccagcuagug

SEQ ID NO: 3593 - RNA, 20 nt, Artificial Sequence
  B2M targeting sequence
cagcuagugucucacuaggu

SEQ ID NO: 3594 - RNA, 20 nt, Artificial Sequence
  B2M targeting sequence
cacuagguugugugcccccc

SEQ ID NO: 3595 - RNA, 20 nt, Artificial Sequence
  B2M targeting sequence
cuagguugugugccccccac

SEQ ID NO: 3596 - RNA, 20 nt, Artificial Sequence
  B2M targeting sequence
cuggcucugagcccagcaca

SEQ ID NO: 3597 - RNA, 20 nt, Artificial Sequence
  B2M targeting sequence
gagcccagcacagcaccagg

SEQ ID NO: 3598 - RNA, 20 nt, Artificial Sequence
  B2M targeting sequence
gagccagugaaugugggggg

SEQ ID NO: 3599 - RNA, 20 nt, Artificial Sequence
  B2M targeting sequence
uggugcugugcugggcucag

SEQ ID NO: 3600 - RNA, 20 nt, Artificial Sequence
  B2M targeting sequence
uggguaaguccuggugcugu

SEQ ID NO: 3601 - RNA, 20 nt, Artificial Sequence
  B2M targeting sequence
uuguggccuagacugccuuu

SEQ ID NO: 3602 - RNA, 20 nt, Artificial Sequence
  B2M targeting sequence
aggccacaaggauggcaauu

SEQ ID NO: 3603 - RNA, 20 nt, Artificial Sequence
  B2M targeting sequence
aguuuauguagaaccucaga

SEQ ID NO: 3604 - RNA, 20 nt, Artificial Sequence
  B2M targeting sequence
acauaaacuugaaaggcagu

SEQ ID NO: 3605 - RNA, 20 nt, Artificial Sequence
  B2M targeting sequence
gagcacuucagcccauggug

SEQ ID NO: 3606 - RNA, 20 nt, Artificial Sequence
  B2M targeting sequence
gagguucuacauaaacuuga

SEQ ID NO: 3607 - RNA, 20 nt, Artificial Sequence
  B2M targeting sequence
gcccaugguggggaggcuua

SEQ ID NO: 3608 - RNA, 20 nt, Artificial Sequence
  B2M targeting sequence
ccaccaugggcugaagugcu

SEQ ID NO: 3609 - RNA, 20 nt, Artificial Sequence
  B2M targeting sequence
aguaagccuccccaccaugg

SEQ ID NO: 3610 - RNA, 20 nt, Artificial Sequence
  B2M targeting sequence
gguucccacugcugggaugg

SEQ ID NO: 3611 - RNA, 20 nt, Artificial Sequence
  B2M targeting sequence
cacugcugggaugggugauu

SEQ ID NO: 3612 - RNA, 20 nt, Artificial Sequence
  B2M targeting sequence
cagcagugggaaccugaguu

SEQ ID NO: 3613 - RNA, 20 nt, Artificial Sequence
  B2M targeting sequence
cccaucccagcagugggaac

SEQ ID NO: 3614 - RNA, 20 nt, Artificial Sequence
  B2M targeting sequence
agcuagggcuggucuaaaug

SEQ ID NO: 3615 - RNA, 20 nt, Artificial Sequence
  B2M targeting sequence
aaaugaucccuccaugggac

SEQ ID NO: 3616 - RNA, 20 nt, Artificial Sequence
  B2M targeting sequence
uuuagaccagcccuagcuag

SEQ ID NO: 3617 - RNA, 20 nt, Artificial Sequence
  B2M targeting sequence
cuccaugggaccugggugag

SEQ ID NO: 3618 - RNA, 20 nt, Artificial Sequence
  B2M targeting sequence
augggaccugggugaguucu

SEQ ID NO: 3619 - RNA, 20 nt, Artificial Sequence
  B2M targeting sequence
cauggagggaucauuuagac

SEQ ID NO: 3620 - RNA, 20 nt, Artificial Sequence
  B2M targeting sequence
cccaggucccauggagggau

SEQ ID NO: 3621 - RNA, 20 nt, Artificial Sequence
  B2M targeting sequence
ucccaguguugcuuugugcu

SEQ ID NO: 3622 - RNA, 20 nt, Artificial Sequence
  B2M targeting sequence
caguguugcuuugugcuaug

SEQ ID NO: 3623 - RNA, 20 nt, Artificial Sequence
  B2M targeting sequence
uagcacaaagcaacacuggg

SEQ ID NO: 3624 - RNA, 20 nt, Artificial Sequence
  B2M targeting sequence
gugcugcccagucauagcac

SEQ ID NO: 3625 - RNA, 20 nt, Artificial Sequence
  B2M targeting sequence
aaugcaaagucugaaaauca

SEQ ID NO: 3626 - RNA, 20 nt, Artificial Sequence
  B2M targeting sequence
gaaaaucacugcacucuucc

SEQ ID NO: 3627 - RNA, 20 nt, Artificial Sequence
  B2M targeting sequence
gacuuugcauuggaacucag

SEQ ID NO: 3628 - RNA, 20 nt, Artificial Sequence
  B2M targeting sequence
cugcacucuuccucucccag

SEQ ID NO: 3629 - RNA, 20 nt, Artificial Sequence
  B2M targeting sequence
uccucucccagaagcacaca

SEQ ID NO: 3630 - RNA, 20 nt, Artificial Sequence
  B2M targeting sequence
ucucccagaagcacacauuc

SEQ ID NO: 3631 - RNA, 20 nt, Artificial Sequence
  B2M targeting sequence
cccagaagcacacauucucu

SEQ ID NO: 3632 - RNA, 20 nt, Artificial Sequence
  B2M targeting sequence
cagaagcacacauucucucu

SEQ ID NO: 3633 - RNA, 20 nt, Artificial Sequence
  B2M targeting sequence
gggagaggaagagugcagug

SEQ ID NO: 3634 - RNA, 20 nt, Artificial Sequence
  B2M targeting sequence
cucuccaugccagguggccg

SEQ ID NO: 3635 - RNA, 20 nt, Artificial Sequence
  B2M targeting sequence
cuccaugccagguggccgcu

SEQ ID NO: 3636 - RNA, 20 nt, Artificial Sequence
  B2M targeting sequence
ccaugccagguggccgcugc

SEQ ID NO: 3637 - RNA, 20 nt, Artificial Sequence
  B2M targeting sequence
augccagguggccgcugccg

SEQ ID NO: 3638 - RNA, 20 nt, Artificial Sequence
  B2M targeting sequence
ccggcagcggccaccuggca

SEQ ID NO: 3639 - RNA, 20 nt, Artificial Sequence
  B2M targeting sequence
cccauucgccggcagcggcc

SEQ ID NO: 3640 - RNA, 20 nt, Artificial Sequence
  B2M targeting sequence
cccccauucgccggcagcgg

SEQ ID NO: 3641 - RNA, 20 nt, Artificial Sequence
  B2M targeting sequence
cucccccauucgccggcagc

SEQ ID NO: 3642 - RNA, 20 nt, Artificial Sequence
  B2M targeting sequence
agacugucuuacccucuuca

SEQ ID NO: 3643 - RNA, 20 nt, Artificial Sequence
  B2M targeting sequence
ugaauugcuaaaugcuaucu

SEQ ID NO: 3644 - RNA, 20 nt, Artificial Sequence
  B2M targeting sequence
uacccucuucaguuacucuu

SEQ ID NO: 3645 - RNA, 20 nt, Artificial Sequence
  B2M targeting sequence
ucaguuacucuuucagugau

SEQ ID NO: 3646 - RNA, 20 nt, Artificial Sequence
  B2M targeting sequence
guuacucuuucagugauacg

SEQ ID NO: 3647 - RNA, 20 nt, Artificial Sequence
  B2M targeting sequence
uucagugauacgaaguuaaa

SEQ ID NO: 3648 - RNA, 20 nt, Artificial Sequence
  B2M targeting sequence
gugauacgaaguuaaaacca

SEQ ID NO: 3649 - RNA, 20 nt, Artificial Sequence
  B2M targeting sequence
cugaaagaguaacugaagag

SEQ ID NO: 3650 - RNA, 20 nt, Artificial Sequence
  B2M targeting sequence
uaucacugaaagaguaacug

SEQ ID NO: 3651 - RNA, 20 nt, Artificial Sequence
  B2M targeting sequence
caguaccugguuuuaacuuc

SEQ ID NO: 3652 - RNA, 20 nt, Artificial Sequence
  B2M targeting sequence
cucaccugauuuuugguucu

SEQ ID NO: 3653 - RNA, 20 nt, Artificial Sequence
  B2M targeting sequence
ccugauuuuugguucuuaug

SEQ ID NO: 3654 - RNA, 20 nt, Artificial Sequence
  B2M targeting sequence
ggugagugaucacaguaccu

SEQ ID NO: 3655 - RNA, 20 nt, Artificial Sequence
  B2M targeting sequence
uaugaaggugcuuuuuuuug

SEQ ID NO: 3656 - RNA, 20 nt, Artificial Sequence
  B2M targeting sequence
uaagaaccaaaaaucaggug

SEQ ID NO: 3657 - RNA, 20 nt, Artificial Sequence
  B2M targeting sequence
acacaaaaaaaagcaccuuc

SEQ ID NO: 3658 - RNA, 20 nt, Artificial Sequence
  B2M targeting sequence
uuauucaauuugguguuccu

SEQ ID NO: 3659 - RNA, 20 nt, Artificial Sequence
  B2M targeting sequence
auuugguguuccugcaggga

SEQ ID NO: 3660 - RNA, 20 nt, Artificial Sequence
  B2M targeting sequence
ugcagggagcaggauuagug

SEQ ID NO: 3661 - RNA, 20 nt, Artificial Sequence
  B2M targeting sequence
cugcaggaacaccaaauuga

SEQ ID NO: 3662 - RNA, 20 nt, Artificial Sequence
  B2M targeting sequence
ugcucccugcaggaacacca

SEQ ID NO: 3663 - RNA, 20 nt, Artificial Sequence
  B2M targeting sequence
acuaauccugcucccugcag

SEQ ID NO: 3664 - RNA, 20 nt, Artificial Sequence
  B2M targeting sequence
auucagccaucuugcuccac

SEQ ID NO: 3665 - RNA, 20 nt, Artificial Sequence
  B2M targeting sequence
gccaucuugcuccaccuccc

SEQ ID NO: 3666 - RNA, 20 nt, Artificial Sequence
  B2M targeting sequence
ugcuccaccuccccuagcua

SEQ ID NO: 3667 - RNA, 20 nt, Artificial Sequence
  B2M targeting sequence
accuccccuagcuauguccu

SEQ ID NO: 3668 - RNA, 20 nt, Artificial Sequence
  B2M targeting sequence
ccuagcuauguccuuuuaaa

SEQ ID NO: 3669 - RNA, 20 nt, Artificial Sequence
  B2M targeting sequence
uuuuaaauauuuauaaucga

SEQ ID NO: 3670 - RNA, 20 nt, Artificial Sequence
  B2M targeting sequence
acauacaauauauuacacuu

SEQ ID NO: 3671 - RNA, 20 nt, Artificial Sequence
  B2M targeting sequence
auuauaaauauuuaaaagga

SEQ ID NO: 3672 - RNA, 20 nt, Artificial Sequence
  B2M targeting sequence
aaaauauaacugaaaucauc

SEQ ID NO: 3673 - RNA, 20 nt, Artificial Sequence
  B2M targeting sequence
guuauauuuuagaacuuauu

SEQ ID NO: 3674 - RNA, 20 nt, Artificial Sequence
  B2M targeting sequence
ucaucgaacucuagauaauu

SEQ ID NO: 3675 - RNA, 20 nt, Artificial Sequence
  B2M targeting sequence
ucgaacucuagauaauuaac

SEQ ID NO: 3676 - RNA, 20 nt, Artificial Sequence
  B2M targeting sequence
aacucuagauaauuaacaua

SEQ ID NO: 3677 - RNA, 20 nt, Artificial Sequence
  B2M targeting sequence
augaugauuucaguuauauu

SEQ ID NO: 3678 - RNA, 20 nt, Artificial Sequence
  B2M targeting sequence
agauaauuaacauauccauc

SEQ ID NO: 3679 - RNA, 20 nt, Artificial Sequence
  B2M targeting sequence
agaguucgaugaugauuuca

SEQ ID NO: 3680 - RNA, 20 nt, Artificial Sequence
  B2M targeting sequence
aucaacccuaaaguuuccuc

SEQ ID NO: 3681 - RNA, 20 nt, Artificial Sequence
  B2M targeting sequence
acccuaaaguuuccucaugu

SEQ ID NO: 3682 - RNA, 20 nt, Artificial Sequence
  B2M targeting sequence
ucauguuuagaugaucuccu

SEQ ID NO: 3683 - RNA, 20 nt, Artificial Sequence
  B2M targeting sequence
uguuuagaugaucuccuuuc

SEQ ID NO: 3684 - RNA, 20 nt, Artificial Sequence
  B2M targeting sequence
aaacaugaggaaacuuuagg

SEQ ID NO: 3685 - RNA, 20 nt, Artificial Sequence
  B2M targeting sequence
ucuaaacaugaggaaacuuu

SEQ ID NO: 3686 - RNA, 20 nt, Artificial Sequence
  B2M targeting sequence
ccuuucccucuagaaaccac

SEQ ID NO: 3687 - RNA, 20 nt, Artificial Sequence
  B2M targeting sequence
uuucccucuagaaaccacuc

SEQ ID NO: 3688 - RNA, 20 nt, Artificial Sequence
  B2M targeting sequence
cucuagaaaccacucaucua

SEQ ID NO: 3689 - RNA, 20 nt, Artificial Sequence
  B2M targeting sequence
agaaaccacucaucuacuuu

SEQ ID NO: 3690 - RNA, 20 nt, Artificial Sequence
  B2M targeting sequence
agagggaaaggagaucaucu

SEQ ID NO: 3691 - RNA, 20 nt, Artificial Sequence
  B2M targeting sequence
ucuacuuucugucauauaga

SEQ ID NO: 3692 - RNA, 20 nt, Artificial Sequence
  B2M targeting sequence
acuuucugucauauagauua

SEQ ID NO: 3693 - RNA, 20 nt, Artificial Sequence
  B2M targeting sequence
gucauauagauuauaguuug

SEQ ID NO: 3694 - RNA, 20 nt, Artificial Sequence
  B2M targeting sequence
uauagauuauaguuugccuu

SEQ ID NO: 3695 - RNA, 20 nt, Artificial Sequence
  B2M targeting sequence
auaugacagaaaguagauga

SEQ ID NO: 3696 - RNA, 20 nt, Artificial Sequence
  B2M targeting sequence
ggaguuuuauauaaacagaa

SEQ ID NO: 3697 - RNA, 20 nt, Artificial Sequence
  B2M targeting sequence
agaaaaggcaaacuauaauc

SEQ ID NO: 3698 - RNA, 20 nt, Artificial Sequence
  B2M targeting sequence
guuuauauaaaacuccagaa

SEQ ID NO: 3699 - RNA, 20 nt, Artificial Sequence
  B2M targeting sequence
uauaguauauguucuuuucu

SEQ ID NO: 3700 - RNA, 20 nt, Artificial Sequence
  B2M targeting sequence
uuucugucugacuucuuuua

SEQ ID NO: 3701 - RNA, 20 nt, Artificial Sequence
  B2M targeting sequence
gucugacuucuuuuauuuac

SEQ ID NO: 3702 - RNA, 20 nt, Artificial Sequence
  B2M targeting sequence
gacuucuuuuauuuaccaug

SEQ ID NO: 3703 - RNA, 20 nt, Artificial Sequence
  B2M targeting sequence
gacagaaaagaacauauacu

SEQ ID NO: 3704 - RNA, 20 nt, Artificial Sequence
  B2M targeting sequence
uuuauuuaccaugauuauuu

SEQ ID NO: 3705 - RNA, 20 nt, Artificial Sequence
  B2M targeting sequence
ugguaaauaaaagaagucag

SEQ ID NO: 3706 - RNA, 20 nt, Artificial Sequence
  B2M targeting sequence
uccauguuacauguaucaac

SEQ ID NO: 3707 - RNA, 20 nt, Artificial Sequence
  B2M targeting sequence
auguuacauguaucaacagu

SEQ ID NO: 3708 - RNA, 20 nt, Artificial Sequence
  B2M targeting sequence
acaguuuauuccuuguuugu

SEQ ID NO: 3709 - RNA, 20 nt, Artificial Sequence
  B2M targeting sequence
uuguuuguugaugauaguau

SEQ ID NO: 3710 - RNA, 20 nt, Artificial Sequence
  B2M targeting sequence
acaaacaaggaauaaacugu

SEQ ID NO: 3711 - RNA, 20 nt, Artificial Sequence
  B2M targeting sequence
ucaacaaacaaggaauaaac

SEQ ID NO: 3712 - RNA, 20 nt, Artificial Sequence
  B2M targeting sequence
uuguauggauauauacucca

SEQ ID NO: 3713 - RNA, 20 nt, Artificial Sequence
  B2M targeting sequence
auacaaugaaauacuaucau

SEQ ID NO: 3714 - RNA, 20 nt, Artificial Sequence
  B2M targeting sequence
aauggguuuauucauuuacc

SEQ ID NO: 3715 - RNA, 20 nt, Artificial Sequence
  B2M targeting sequence
uuuaccuguugauguauguu

SEQ ID NO: 3716 - RNA, 20 nt, Artificial Sequence
  B2M targeting sequence
acagguaaaugaauaaaccc

SEQ ID NO: 3717 - RNA, 20 nt, Artificial Sequence
  B2M targeting sequence
aacauacaucaacagguaaa

SEQ ID NO: 3718 - RNA, 20 nt, Artificial Sequence
  B2M targeting sequence
uuucuaguuuucagcuauca

SEQ ID NO: 3719 - RNA, 20 nt, Artificial Sequence
  B2M targeting sequence
aguuuucagcuaucacaaau

SEQ ID NO: 3720 - RNA, 20 nt, Artificial Sequence
  B2M targeting sequence
gcuaucacaaauaaaacugc

SEQ ID NO: 3721 - RNA, 20 nt, Artificial Sequence
  B2M targeting sequence
caaauaaaacugcuauaaac

SEQ ID NO: 3722 - RNA, 20 nt, Artificial Sequence
  B2M targeting sequence
aagucuuuguauagacauau

SEQ ID NO: 3723 - RNA, 20 nt, Artificial Sequence
  B2M targeting sequence
uuguauagacauaugcuuuc

SEQ ID NO: 3724 - RNA, 20 nt, Artificial Sequence
  B2M targeting sequence
auacaaagacuuggacauua

SEQ ID NO: 3725 - RNA, 20 nt, Artificial Sequence
  B2M targeting sequence
uuuucucuugggcaaauacc

SEQ ID NO: 3726 - RNA, 20 nt, Artificial Sequence
  B2M targeting sequence
cuugggcaaauaccuugggu

SEQ ID NO: 3727 - RNA, 20 nt, Artificial Sequence
  B2M targeting sequence
ugggcaaauaccuugggugg

SEQ ID NO: 3728 - RNA, 20 nt, Artificial Sequence
  B2M targeting sequence
acccaagguauuugcccaag

SEQ ID NO: 3729 - RNA, 20 nt, Artificial Sequence
  B2M targeting sequence
agccacuccacccaagguau

SEQ ID NO: 3730 - RNA, 20 nt, Artificial Sequence
  B2M targeting sequence
uuauaaaguuaaacauacac

SEQ ID NO: 3731 - RNA, 20 nt, Artificial Sequence
  B2M targeting sequence
aaguguuuuccuuuuucuuu

SEQ ID NO: 3732 - RNA, 20 nt, Artificial Sequence
  B2M targeting sequence
acagcucuuuauaaaguuaa

SEQ ID NO: 3733 - RNA, 20 nt, Artificial Sequence
  B2M targeting sequence
uuuuucuuuuuucuuuuuga

SEQ ID NO: 3734 - RNA, 20 nt, Artificial Sequence
  B2M targeting sequence
uuuuucuuuuugagaugaag

SEQ ID NO: 3735 - RNA, 20 nt, Artificial Sequence
  B2M targeting sequence
uuuugagaugaagucuugcu

SEQ ID NO: 3736 - RNA, 20 nt, Artificial Sequence
  B2M targeting sequence
aaaagaaaaaagaaaaagga

SEQ ID NO: 3737 - RNA, 20 nt, Artificial Sequence
  B2M targeting sequence
caaaaagaaaaaagaaaaag

SEQ ID NO: 3738 - RNA, 20 nt, Artificial Sequence
  B2M targeting sequence
ucucaaaaagaaaaaagaaa

SEQ ID NO: 3739 - RNA, 20 nt, Artificial Sequence
  B2M targeting sequence
ugcucuguugcccaggcugg

SEQ ID NO: 3740 - RNA, 20 nt, Artificial Sequence
  B2M targeting sequence
guugcccaggcuggagugca

SEQ ID NO: 3741 - RNA, 20 nt, Artificial Sequence
  B2M targeting sequence
agccugggcaacagagcaag

SEQ ID NO: 3742 - RNA, 20 nt, Artificial Sequence
  B2M targeting sequence
cggcucauugcaaccucugc

SEQ ID NO: 3743 - RNA, 20 nt, Artificial Sequence
  B2M targeting sequence
gcucauugcaaccucugccu

SEQ ID NO: 3744 - RNA, 20 nt, Artificial Sequence
  B2M targeting sequence
uugcaaccucugccucccag

SEQ ID NO: 3745 - RNA, 20 nt, Artificial Sequence
  B2M targeting sequence
gccucccagguucaagcaau

SEQ ID NO: 3746 - RNA, 20 nt, Artificial Sequence
  B2M targeting sequence
cagguucaagcaauucuccu

SEQ ID NO: 3747 - RNA, 20 nt, Artificial Sequence
  B2M targeting sequence
agcaauucuccugccucagc

SEQ ID NO: 3748 - RNA, 20 nt, Artificial Sequence
  B2M targeting sequence
ccugccucagccuccugagu

SEQ ID NO: 3749 - RNA, 20 nt, Artificial Sequence
  B2M targeting sequence
ugccucagccuccugaguag

SEQ ID NO: 3750 - RNA, 20 nt, Artificial Sequence
  B2M targeting sequence
gccuccugaguaguuggggu

SEQ ID NO: 3751 - RNA, 20 nt, Artificial Sequence
  B2M targeting sequence
ugaguaguugggguuacaga

SEQ ID NO: 3752 - RNA, 20 nt, Artificial Sequence
  B2M targeting sequence
ggaggcugaggcaggagaau

SEQ ID NO: 3753 - RNA, 20 nt, Artificial Sequence
  B2M targeting sequence
guaaccccaacuacucagga

SEQ ID NO: 3754 - RNA, 20 nt, Artificial Sequence
  B2M targeting sequence
acuaaaaauacaaaaauuag

SEQ ID NO: 3755 - RNA, 20 nt, Artificial Sequence
  B2M targeting sequence
cuacuaaaaauacaaaaauu

SEQ ID NO: 3756 - RNA, 20 nt, Artificial Sequence
  B2M targeting sequence
ccauguuggccaggcugguc

SEQ ID NO: 3757 - RNA, 20 nt, Artificial Sequence
  B2M targeting sequence
caaacuccugaucucaagug

SEQ ID NO: 3758 - RNA, 20 nt, Artificial Sequence
  B2M targeting sequence
aacuccugaucucaagugau

SEQ ID NO: 3759 - RNA, 20 nt, Artificial Sequence
  B2M targeting sequence
ugaucucaagugaucugccc

SEQ ID NO: 3760 - RNA, 20 nt, Artificial Sequence
  B2M targeting sequence
ggaguuugagaccagccugg

SEQ ID NO: 3761 - RNA, 20 nt, Artificial Sequence
  B2M targeting sequence
caagugaucugcccgccuug

SEQ ID NO: 3762 - RNA, 20 nt, Artificial Sequence
  B2M targeting sequence
agugaucugcccgccuugac

SEQ ID NO: 3763 - RNA, 20 nt, Artificial Sequence
  B2M targeting sequence
cuugagaucaggaguuugag

SEQ ID NO: 3764 - RNA, 20 nt, Artificial Sequence
  B2M targeting sequence
gcccgccuugaccucccaaa

SEQ ID NO: 3765 - RNA, 20 nt, Artificial Sequence
  B2M targeting sequence
aggcgggcagaucacuugag

SEQ ID NO: 3766 - RNA, 20 nt, Artificial Sequence
  B2M targeting sequence
caaagugcucagauuacagg

SEQ ID NO: 3767 - RNA, 20 nt, Artificial Sequence
  B2M targeting sequence
gauuacaggugugagccacc

SEQ ID NO: 3768 - RNA, 20 nt, Artificial Sequence
  B2M targeting sequence
gagcacuuugggaggucaag

SEQ ID NO: 3769 - RNA, 20 nt, Artificial Sequence
  B2M targeting sequence
caccuguaaucugagcacuu

SEQ ID NO: 3770 - RNA, 20 nt, Artificial Sequence
  B2M targeting sequence
agccccaaauuguuuauacc

SEQ ID NO: 3771 - RNA, 20 nt, Artificial Sequence
  B2M targeting sequence
uaccaggauuguaugagagu

SEQ ID NO: 3772 - RNA, 20 nt, Artificial Sequence
  B2M targeting sequence
ugguaggaauauaaaauggu

SEQ ID NO: 3773 - RNA, 20 nt, Artificial Sequence
  B2M targeting sequence
uacaauccugguaggaauau

SEQ ID NO: 3774 - RNA, 20 nt, Artificial Sequence
  B2M targeting sequence
cauacaauccugguaggaau

SEQ ID NO: 3775 - RNA, 20 nt, Artificial Sequence
  B2M targeting sequence
aguucuucuaaauucuugcc

SEQ ID NO: 3776 - RNA, 20 nt, Artificial Sequence
  B2M targeting sequence
ucuaaauucuugccaacauu

SEQ ID NO: 3777 - RNA, 20 nt, Artificial Sequence
  B2M targeting sequence
aaauucuugccaacauuuac

SEQ ID NO: 3778 - RNA, 20 nt, Artificial Sequence
  B2M targeting sequence
ugccaacauuuacuacuuug

SEQ ID NO: 3779 - RNA, 20 nt, Artificial Sequence
  B2M targeting sequence
aaguaguaaauguuggcaag

SEQ ID NO: 3780 - RNA, 20 nt, Artificial Sequence
  B2M targeting sequence
uuguaaaaaaauuuuaagag

SEQ ID NO: 3781 - RNA, 20 nt, Artificial Sequence
  B2M targeting sequence
uaaaauuuuuuuacaaugaa

SEQ ID NO: 3782 - RNA, 20 nt, Artificial Sequence
  B2M targeting sequence
ccuauauaacccucuuaaaa

SEQ ID NO: 3783 - RNA, 20 nt, Artificial Sequence
  B2M targeting sequence
guuaauugcacuacugggag

SEQ ID NO: 3784 - RNA, 20 nt, Artificial Sequence
  B2M targeting sequence
caguagugcaauuaacagau

SEQ ID NO: 3785 - RNA, 20 nt, Artificial Sequence
  B2M targeting sequence
cccaguagugcaauuaacag

SEQ ID NO: 3786 - RNA, 20 nt, Artificial Sequence
  B2M targeting sequence
uauuuguggcugggcguggu

SEQ ID NO: 3787 - RNA, 20 nt, Artificial Sequence
  B2M targeting sequence
caagcauguguuaccacgcc

SEQ ID NO: 3788 - RNA, 20 nt, Artificial Sequence
  B2M targeting sequence
uagcacuuuaggaggcuggg

SEQ ID NO: 3789 - RNA, 20 nt, Artificial Sequence
  B2M targeting sequence
uaaagugcuaggaucacaag

SEQ ID NO: 3790 - RNA, 20 nt, Artificial Sequence
  B2M targeting sequence
ccagccuccuaaagugcuag

SEQ ID NO: 3791 - RNA, 20 nt, Artificial Sequence
  B2M targeting sequence
uuccccagccuccuaaagug

SEQ ID NO: 3792 - RNA, 20 nt, Artificial Sequence
  B2M targeting sequence
uccuuccccagccuccuaaa

SEQ ID NO: 3793 - RNA, 20 nt, Artificial Sequence
  B2M targeting sequence
cuugagaccaggaguucgag

SEQ ID NO: 3794 - RNA, 20 nt, Artificial Sequence
  B2M targeting sequence
agugauccuccuuccccagc

SEQ ID NO: 3795 - RNA, 20 nt, Artificial Sequence
  B2M targeting sequence
caagugauccuccuucccca

SEQ ID NO: 3796 - RNA, 20 nt, Artificial Sequence
  B2M targeting sequence
uggucucaagugauccuccu

SEQ ID NO: 3797 - RNA, 20 nt, Artificial Sequence
  B2M targeting sequence
agaccagccugggcaacaca

SEQ ID NO: 3798 - RNA, 20 nt, Artificial Sequence
  B2M targeting sequence
aacuccuggucucaagugau

SEQ ID NO: 3799 - RNA, 20 nt, Artificial Sequence
  B2M targeting sequence
cgaacuccuggucucaagug

SEQ ID NO: 3800 - RNA, 20 nt, Artificial Sequence
  B2M targeting sequence
ugcuguguugcccaggcugg

SEQ ID NO: 3801 - RNA, 20 nt, Artificial Sequence
  B2M targeting sequence
gucuccacaaaaauauuaaa

SEQ ID NO: 3802 - RNA, 20 nt, Artificial Sequence
  B2M targeting sequence
ccacaaaaauauuaaaaauu

SEQ ID NO: 3803 - RNA, 20 nt, Artificial Sequence
  B2M targeting sequence
acaaaaauauuaaaaauuaa

SEQ ID NO: 3804 - RNA, 20 nt, Artificial Sequence
  B2M targeting sequence
uuuuuuuuuaauuuuuaaua

SEQ ID NO: 3805 - RNA, 20 nt, Artificial Sequence
  B2M targeting sequence
uguuuguagacuucccaaau

SEQ ID NO: 3806 - RNA, 20 nt, Artificial Sequence
  B2M targeting sequence
acaaacaugacaauuucuuu

SEQ ID NO: 3807 - RNA, 20 nt, Artificial Sequence
  B2M targeting sequence
caaauuugccauccuaggca

SEQ ID NO: 3808 - RNA, 20 nt, Artificial Sequence
  B2M targeting sequence
uaggcaaacagugcucuugu

SEQ ID NO: 3809 - RNA, 20 nt, Artificial Sequence
  B2M targeting sequence
uguuuuuaaacaaauaguug

SEQ ID NO: 3810 - RNA, 20 nt, Artificial Sequence
  B2M targeting sequence
cccucacuauucaaaacaug

SEQ ID NO: 3811 - RNA, 20 nt, Artificial Sequence
  B2M targeting sequence
cuauucaaaacaugucauaa

SEQ ID NO: 3812 - RNA, 20 nt, Artificial Sequence
  B2M targeting sequence
aaacaugucauaaaugguaa

SEQ ID NO: 3813 - RNA, 20 nt, Artificial Sequence
  B2M targeting sequence
uaaaugguaaguccaagaaa

SEQ ID NO: 3814 - RNA, 20 nt, Artificial Sequence
  B2M targeting sequence
aagaaaaauacagguauucc

SEQ ID NO: 3815 - RNA, 20 nt, Artificial Sequence
  B2M targeting sequence
uggacuuaccauuuaugaca

SEQ ID NO: 3816 - RNA, 20 nt, Artificial Sequence
  B2M targeting sequence
cccccaaagaaaacuguaaa

SEQ ID NO: 3817 - RNA, 20 nt, Artificial Sequence
  B2M targeting sequence
uugggggggaauaccuguau

SEQ ID NO: 3818 - RNA, 20 nt, Artificial Sequence
  B2M targeting sequence
acuuuuuucuaucuguacug

SEQ ID NO: 3819 - RNA, 20 nt, Artificial Sequence
  B2M targeting sequence
auuuuacaguuuucuuuggg

SEQ ID NO: 3820 - RNA, 20 nt, Artificial Sequence
  B2M targeting sequence
aucuguacuguuuuuuauug

SEQ ID NO: 3821 - RNA, 20 nt, Artificial Sequence
  B2M targeting sequence
guacuguuuuuuauugguuu

SEQ ID NO: 3822 - RNA, 20 nt, Artificial Sequence
  B2M targeting sequence
aagugaguaaaucagaaucu

SEQ ID NO: 3823 - RNA, 20 nt, Artificial Sequence
  B2M targeting sequence
cuuggaaaaccaauuuaaaa

SEQ ID NO: 3824 - RNA, 20 nt, Artificial Sequence
  B2M targeting sequence
gaaucuaucuguaauggauu

SEQ ID NO: 3825 - RNA, 20 nt, Artificial Sequence
  B2M targeting sequence
gauuuacucacuuggaaaac

SEQ ID NO: 3826 - RNA, 20 nt, Artificial Sequence
  B2M targeting sequence
aucuguaauggauuuuaaau

SEQ ID NO: 3827 - RNA, 20 nt, Artificial Sequence
  B2M targeting sequence
guaauggauuuuaaauuuag

SEQ ID NO: 3828 - RNA, 20 nt, Artificial Sequence
  B2M targeting sequence
auuacagauagauucugauu

SEQ ID NO: 3829 - RNA, 20 nt, Artificial Sequence
  B2M targeting sequence
cugugauguaguaaacaaga

SEQ ID NO: 3830 - RNA, 20 nt, Artificial Sequence
  B2M targeting sequence
gugauguaguaaacaagaaa

SEQ ID NO: 3831 - RNA, 20 nt, Artificial Sequence
  B2M targeting sequence
cagagaaacacuaaauuuaa

SEQ ID NO: 3832 - RNA, 20 nt, Artificial Sequence
  B2M targeting sequence
uguuuacuacaucacagaga

SEQ ID NO: 3833 - RNA, 20 nt, Artificial Sequence
  B2M targeting sequence
aguuucuuguuuacuacauc

SEQ ID NO: 3834 - RNA, 20 nt, Artificial Sequence
  B2M targeting sequence
cuugcuaaacuucuaaggca

SEQ ID NO: 3835 - RNA, 20 nt, Artificial Sequence
  B2M targeting sequence
aaggcacuuuucuaguacaa

SEQ ID NO: 3836 - RNA, 20 nt, Artificial Sequence
  B2M targeting sequence
aguacaacucaacacuaaca

SEQ ID NO: 3837 - RNA, 20 nt, Artificial Sequence
  B2M targeting sequence
acacuaacauuucaggccuu

SEQ ID NO: 3838 - RNA, 20 nt, Artificial Sequence
  B2M targeting sequence
ggccuuuagugccuuauaug

SEQ ID NO: 3839 - RNA, 20 nt, Artificial Sequence
  B2M targeting sequence
uauaaggcacuaaaggccug

SEQ ID NO: 3840 - RNA, 20 nt, Artificial Sequence
  B2M targeting sequence
cccuuuuaaaaacucauaua

SEQ ID NO: 3841 - RNA, 20 nt, Artificial Sequence
  B2M targeting sequence
cuuuucccccuuuuaaaaac

SEQ ID NO: 3842 - RNA, 20 nt, Artificial Sequence
  B2M targeting sequence
cucccuuuucccccuuuuaa

SEQ ID NO: 3843 - RNA, 20 nt, Artificial Sequence
  B2M targeting sequence
ugcucccucccuuuuccccc

SEQ ID NO: 3844 - RNA, 20 nt, Artificial Sequence
  B2M targeting sequence
uaacucauacauuuaggcau

SEQ ID NO: 3845 - RNA, 20 nt, Artificial Sequence
  B2M targeting sequence
uacauuuaggcauaacaauu

SEQ ID NO: 3846 - RNA, 20 nt, Artificial Sequence
  B2M targeting sequence
cauauuuuaguuauugagag

SEQ ID NO: 3847 - RNA, 20 nt, Artificial Sequence
  B2M targeting sequence
uauuuuaguuauugagaggg

SEQ ID NO: 3848 - RNA, 20 nt, Artificial Sequence
  B2M targeting sequence
auaacuaaaauaugagaaua

SEQ ID NO: 3849 - RNA, 20 nt, Artificial Sequence
  B2M targeting sequence
caauaacuaaaauaugagaa

SEQ ID NO: 3850 - RNA, 20 nt, Artificial Sequence
  B2M targeting sequence
accagcccucucaauaacua

SEQ ID NO: 3851 - RNA, 20 nt, Artificial Sequence
  B2M targeting sequence
guaguguuuaauaagcgcua

SEQ ID NO: 3852 - RNA, 20 nt, Artificial Sequence
  B2M targeting sequence
cacaaugccugguacauagu

SEQ ID NO: 3853 - RNA, 20 nt, Artificial Sequence
  B2M targeting sequence
cucuugugcauuaucucauu

SEQ ID NO: 3854 - RNA, 20 nt, Artificial Sequence
  B2M targeting sequence
cuugugcauuaucucauuuc

SEQ ID NO: 3855 - RNA, 20 nt, Artificial Sequence
  B2M targeting sequence
ugugcauuaucucauuucau

SEQ ID NO: 3856 - RNA, 20 nt, Artificial Sequence
  B2M targeting sequence
cauuucauuagguccaugga

SEQ ID NO: 3857 - RNA, 20 nt, Artificial Sequence
  B2M targeting sequence
uuucauuagguccauggaga

SEQ ID NO: 3858 - RNA, 20 nt, Artificial Sequence
  B2M targeting sequence
uuagguccauggagaguauu

SEQ ID NO: 3859 - RNA, 20 nt, Artificial Sequence
  B2M targeting sequence
auggagaguauugcauuuuc

SEQ ID NO: 3860 - RNA, 20 nt, Artificial Sequence
  B2M targeting sequence
auggaccuaaugaaaugaga

SEQ ID NO: 3861 - RNA, 20 nt, Artificial Sequence
  B2M targeting sequence
ccauggaccuaaugaaauga

SEQ ID NO: 3862 - RNA, 20 nt, Artificial Sequence
  B2M targeting sequence
uaguuuaggcauggccucca

SEQ ID NO: 3863 - RNA, 20 nt, Artificial Sequence
  B2M targeting sequence
acaauaaagauuaucaaaag

SEQ ID NO: 3864 - RNA, 20 nt, Artificial Sequence
  B2M targeting sequence
uuauuguggaggccaugccu

SEQ ID NO: 3865 - RNA, 20 nt, Artificial Sequence
  B2M targeting sequence
aaagccuaaaaauauguaaa

SEQ ID NO: 3866 - RNA, 20 nt, Artificial Sequence
  B2M targeting sequence
uuuacauauuuuuaggcuuu

SEQ ID NO: 3867 - RNA, 20 nt, Artificial Sequence
  B2M targeting sequence
agguuucuuuuacauauuuu

SEQ ID NO: 3868 - RNA, 20 nt, Artificial Sequence
  B2M targeting sequence
uuggggaagcuaggcaaauc

SEQ ID NO: 3869 - RNA, 20 nt, Artificial Sequence
  B2M targeting sequence
ccaaggagcacaacaaauaa

SEQ ID NO: 3870 - RNA, 20 nt, Artificial Sequence
  B2M targeting sequence
uuucaacugaaaaccauggu

SEQ ID NO: 3871 - RNA, 20 nt, Artificial Sequence
  B2M targeting sequence
acugaaaaccauggugacuu

SEQ ID NO: 3872 - RNA, 20 nt, Artificial Sequence
  B2M targeting sequence
guugaaaggauuugccuagc

SEQ ID NO: 3873 - RNA, 20 nt, Artificial Sequence
  B2M targeting sequence
ccaugguuuucaguugaaag

SEQ ID NO: 3874 - RNA, 20 nt, Artificial Sequence
  B2M targeting sequence
aagaucucugccccucccca

SEQ ID NO: 3875 - RNA, 20 nt, Artificial Sequence
  B2M targeting sequence
uggaagucaccaugguuuuc

SEQ ID NO: 3876 - RNA, 20 nt, Artificial Sequence
  B2M targeting sequence
cugccccuccccaucgccau

SEQ ID NO: 3877 - RNA, 20 nt, Artificial Sequence
  B2M targeting sequence
gccccuccccaucgccaugg

SEQ ID NO: 3878 - RNA, 20 nt, Artificial Sequence
  B2M targeting sequence
ccaucgccaugguccacuuc

SEQ ID NO: 3879 - RNA, 20 nt, Artificial Sequence
  B2M targeting sequence
ccaugguccacuuccucuuc

SEQ ID NO: 3880 - RNA, 20 nt, Artificial Sequence
  B2M targeting sequence
acuuccucuucucacuguuc

SEQ ID NO: 3881 - RNA, 20 nt, Artificial Sequence
  B2M targeting sequence
ucuucucacuguuccucuua

SEQ ID NO: 3882 - RNA, 20 nt, Artificial Sequence
  B2M targeting sequence
ucucacuguuccucuuagaa

SEQ ID NO: 3883 - RNA, 20 nt, Artificial Sequence
  B2M targeting sequence
cacuguuccucuuagaaaag

SEQ ID NO: 3884 - RNA, 20 nt, Artificial Sequence
  B2M targeting sequence
cuguuccucuuagaaaagau

SEQ ID NO: 3885 - RNA, 20 nt, Artificial Sequence
  B2M targeting sequence
ucuuagaaaagaucugugga

SEQ ID NO: 3886 - RNA, 20 nt, Artificial Sequence
  B2M targeting sequence
uagaaaagaucuguggacuc

SEQ ID NO: 3887 - RNA, 20 nt, Artificial Sequence
  B2M targeting sequence
aagaggaacagugagaagag

SEQ ID NO: 3888 - RNA, 20 nt, Artificial Sequence
  B2M targeting sequence
uuucuaagaggaacagugag

SEQ ID NO: 3889 - RNA, 20 nt, Artificial Sequence
  B2M targeting sequence
guggacuccaccaccacgaa

SEQ ID NO: 3890 - RNA, 20 nt, Artificial Sequence
  B2M targeting sequence
acagaucuuuucuaagagga

SEQ ID NO: 3891 - RNA, 20 nt, Artificial Sequence
  B2M targeting sequence
accaccacgaaauggcggca

SEQ ID NO: 3892 - RNA, 20 nt, Artificial Sequence
  B2M targeting sequence
uggugguggaguccacagau

SEQ ID NO: 3893 - RNA, 20 nt, Artificial Sequence
  B2M targeting sequence
cuuuagaggguagguuuucu

SEQ ID NO: 3894 - RNA, 20 nt, Artificial Sequence
  B2M targeting sequence
aaagugaccauaaauaaggu

SEQ ID NO: 3895 - RNA, 20 nt, Artificial Sequence
  B2M targeting sequence
uaaugggucugccugucaug

SEQ ID NO: 3896 - RNA, 20 nt, Artificial Sequence
  B2M targeting sequence
gccugucauguuuaacgucc

SEQ ID NO: 3897 - RNA, 20 nt, Artificial Sequence
  B2M targeting sequence
uguuuaacguccuuggcugg

SEQ ID NO: 3898 - RNA, 20 nt, Artificial Sequence
  B2M targeting sequence
uuggcuggguccaaggcaga

SEQ ID NO: 3899 - RNA, 20 nt, Artificial Sequence
  B2M targeting sequence
aaggcagaugcaguccaaac

SEQ ID NO: 3900 - RNA, 20 nt, Artificial Sequence
  B2M targeting sequence
gccuuggacccagccaagga

SEQ ID NO: 3901 - RNA, 20 nt, Artificial Sequence
  B2M targeting sequence
aaacucucacuaaaauugcc

SEQ ID NO: 3902 - RNA, 20 nt, Artificial Sequence
  B2M targeting sequence
cacuaaaauugccgagcccu

SEQ ID NO: 3903 - RNA, 20 nt, Artificial Sequence
  B2M targeting sequence
cuaaaauugccgagcccuuu

SEQ ID NO: 3904 - RNA, 20 nt, Artificial Sequence
  B2M targeting sequence
gcaauuuuagugagaguuug

SEQ ID NO: 3905 - RNA, 20 nt, Artificial Sequence
  B2M targeting sequence
uccagugucuaaaauauuaa

SEQ ID NO: 3906 - RNA, 20 nt, Artificial Sequence
  B2M targeting sequence
agugucuaaaauauuaaugu

SEQ ID NO: 3907 - RNA, 20 nt, Artificial Sequence
  B2M targeting sequence
aaaauauuaaugucaaugga

SEQ ID NO: 3908 - RNA, 20 nt, Artificial Sequence
  B2M targeting sequence
auggaaucaggccagaguuu

SEQ ID NO: 3909 - RNA, 20 nt, Artificial Sequence
  B2M targeting sequence
auugacauuaauauuuuaga

SEQ ID NO: 3910 - RNA, 20 nt, Artificial Sequence
  B2M targeting sequence
ggccagaguuugaauucuag

SEQ ID NO: 3911 - RNA, 20 nt, Artificial Sequence
  B2M targeting sequence
ggccugauuccauugacauu

SEQ ID NO: 3912 - RNA, 20 nt, Artificial Sequence
  B2M targeting sequence
aacucuggccugauuccauu

SEQ ID NO: 3913 - RNA, 20 nt, Artificial Sequence
  B2M targeting sequence
agucucuuagccuuuguuuc

SEQ ID NO: 3914 - RNA, 20 nt, Artificial Sequence
  B2M targeting sequence
cuuagccuuuguuuccccug

SEQ ID NO: 3915 - RNA, 20 nt, Artificial Sequence
  B2M targeting sequence
uagccuuuguuuccccuguc

SEQ ID NO: 3916 - RNA, 20 nt, Artificial Sequence
  B2M targeting sequence
ccuguccauaaaaugaaugg

SEQ ID NO: 3917 - RNA, 20 nt, Artificial Sequence
  B2M targeting sequence
auaaaaugaauggggguaau

SEQ ID NO: 3918 - RNA, 20 nt, Artificial Sequence
  B2M targeting sequence
uuuuauggacaggggaaaca

SEQ ID NO: 3919 - RNA, 20 nt, Artificial Sequence
  B2M targeting sequence
uuccuccuacaguuuauuua

SEQ ID NO: 3920 - RNA, 20 nt, Artificial Sequence
  B2M targeting sequence
uccuacaguuuauuuauaua

SEQ ID NO: 3921 - RNA, 20 nt, Artificial Sequence
  B2M targeting sequence
uacaguuuauuuauauauuc

SEQ ID NO: 3922 - RNA, 20 nt, Artificial Sequence
  B2M targeting sequence
cuaauucauucauucaucca

SEQ ID NO: 3923 - RNA, 20 nt, Artificial Sequence
  B2M targeting sequence
uucauucauccauccauucg

SEQ ID NO: 3924 - RNA, 20 nt, Artificial Sequence
  B2M targeting sequence
uucauccauccauucguuca

SEQ ID NO: 3925 - RNA, 20 nt, Artificial Sequence
  B2M targeting sequence
uccauccauucguucauucg

SEQ ID NO: 3926 - RNA, 20 nt, Artificial Sequence
  B2M targeting sequence
auccauucguucauucgguu

SEQ ID NO: 3927 - RNA, 20 nt, Artificial Sequence
  B2M targeting sequence
auucguucauucgguuuacu

SEQ ID NO: 3928 - RNA, 20 nt, Artificial Sequence
  B2M targeting sequence
uucauucgguuuacugagua

SEQ ID NO: 3929 - RNA, 20 nt, Artificial Sequence
  B2M targeting sequence
uucgguuuacugaguaccua

SEQ ID NO: 3930 - RNA, 20 nt, Artificial Sequence
  B2M targeting sequence
guuuacugaguaccuacuau

SEQ ID NO: 3931 - RNA, 20 nt, Artificial Sequence
  B2M targeting sequence
guaaaccgaaugaacgaaug

SEQ ID NO: 3932 - RNA, 20 nt, Artificial Sequence
  B2M targeting sequence
aggguggaaacuaagagaau

SEQ ID NO: 3933 - RNA, 20 nt, Artificial Sequence
  B2M targeting sequence
acccuagaacaggggcuggc

SEQ ID NO: 3934 - RNA, 20 nt, Artificial Sequence
  B2M targeting sequence
uaguuuccacccuagaacag

SEQ ID NO: 3935 - RNA, 20 nt, Artificial Sequence
  B2M targeting sequence
cuuaguuuccacccuagaac

SEQ ID NO: 3936 - RNA, 20 nt, Artificial Sequence
  B2M targeting sequence
uucucuuaguuuccacccua

SEQ ID NO: 3937 - RNA, 20 nt, Artificial Sequence
  B2M targeting sequence
agguacaucauucucuuagu

SEQ ID NO: 3938 - RNA, 20 nt, Artificial Sequence
  B2M targeting sequence
agcgcccucuagguacauca

SEQ ID NO: 3939 - RNA, 20 nt, Artificial Sequence
  B2M targeting sequence
aaagcccuagcaguuacugc

SEQ ID NO: 3940 - RNA, 20 nt, Artificial Sequence
  B2M targeting sequence
uuuuuuucucccccccgccc

SEQ ID NO: 3941 - RNA, 20 nt, Artificial Sequence
  B2M targeting sequence
cccccccgccccccgacaaa

SEQ ID NO: 3942 - RNA, 20 nt, Artificial Sequence
  B2M targeting sequence
cccccgccccccgacaaauc

SEQ ID NO: 3943 - RNA, 20 nt, Artificial Sequence
  B2M targeting sequence
gggggcgggggggagaaaaa

SEQ ID NO: 3944 - RNA, 20 nt, Artificial Sequence
  B2M targeting sequence
acagaacaaagaaaauuacc

SEQ ID NO: 3945 - RNA, 20 nt, Artificial Sequence
  B2M targeting sequence
guugauuugucggggggcgg

SEQ ID NO: 3946 - RNA, 20 nt, Artificial Sequence
  B2M targeting sequence
uuguucuguugauuugucgg

SEQ ID NO: 3947 - RNA, 20 nt, Artificial Sequence
  B2M targeting sequence
uugcuguuuagguaauuuuc

SEQ ID NO: 3948 - RNA, 20 nt, Artificial Sequence
  B2M targeting sequence
cuauguccuugcuguuuagg

SEQ ID NO: 3949 - RNA, 20 nt, Artificial Sequence
  B2M targeting sequence
ucccuauguccuugcuguuu

SEQ ID NO: 3950 - RNA, 20 nt, Artificial Sequence
  B2M targeting sequence
uggcacagaacuuuccaaac

SEQ ID NO: 3951 - RNA, 20 nt, Artificial Sequence
  B2M targeting sequence
gugccaagaaguuccucccu

SEQ ID NO: 3952 - RNA, 20 nt, Artificial Sequence
  B2M targeting sequence
aaacacuuuuuccugaaggg

SEQ ID NO: 3953 - RNA, 20 nt, Artificial Sequence
  B2M targeting sequence
ugaagggauacaagaagcaa

SEQ ID NO: 3954 - RNA, 20 nt, Artificial Sequence
  B2M targeting sequence
ggaaaaaguguuuggaaagu

SEQ ID NO: 3955 - RNA, 20 nt, Artificial Sequence
  B2M targeting sequence
cuucaggaaaaaguguuugg

SEQ ID NO: 3956 - RNA, 20 nt, Artificial Sequence
  B2M targeting sequence
uguaucccuucaggaaaaag

SEQ ID NO: 3957 - RNA, 20 nt, Artificial Sequence
  B2M targeting sequence
ugcuucuuguaucccuucag

SEQ ID NO: 3958 - RNA, 20 nt, Artificial Sequence
  B2M targeting sequence
uucacuaggaccuucucuga

SEQ ID NO: 3959 - RNA, 20 nt, Artificial Sequence
  B2M targeting sequence
cuaggaccuucucugagcug

SEQ ID NO: 3960 - RNA, 20 nt, Artificial Sequence
  B2M targeting sequence
uagugaaagaguaccuuucu

SEQ ID NO: 3961 - RNA, 20 nt, Artificial Sequence
  B2M targeting sequence
cugagcuguccucaggaugc

SEQ ID NO: 3962 - RNA, 20 nt, Artificial Sequence
  B2M targeting sequence
gagcuguccucaggaugcuu

SEQ ID NO: 3963 - RNA, 20 nt, Artificial Sequence
  B2M targeting sequence
gagaagguccuagugaaaga

SEQ ID NO: 3964 - RNA, 20 nt, Artificial Sequence
  B2M targeting sequence
ucaggaugcuuuugggacua

SEQ ID NO: 3965 - RNA, 20 nt, Artificial Sequence
  B2M targeting sequence
ggaugcuuuugggacuauuu

SEQ ID NO: 3966 - RNA, 20 nt, Artificial Sequence
  B2M targeting sequence
ugaggacagcucagagaagg

SEQ ID NO: 3967 - RNA, 20 nt, Artificial Sequence
  B2M targeting sequence
caaaagcauccugaggacag

SEQ ID NO: 3968 - RNA, 20 nt, Artificial Sequence
  B2M targeting sequence
uacccagagaauggagaaac

SEQ ID NO: 3969 - RNA, 20 nt, Artificial Sequence
  B2M targeting sequence
ggguaagaaaaauaguccca

SEQ ID NO: 3970 - RNA, 20 nt, Artificial Sequence
  B2M targeting sequence
cuggguaagaaaaauagucc

SEQ ID NO: 3971 - RNA, 20 nt, Artificial Sequence
  B2M targeting sequence
auucucuggguaagaaaaau

SEQ ID NO: 3972 - RNA, 20 nt, Artificial Sequence
  B2M targeting sequence
ccauucucuggguaagaaaa

SEQ ID NO: 3973 - RNA, 20 nt, Artificial Sequence
  B2M targeting sequence
cugcaggguuucuccauucu

SEQ ID NO: 3974 - RNA, 20 nt, Artificial Sequence
  B2M targeting sequence
caagcuguaguuauaaacag

SEQ ID NO: 3975 - RNA, 20 nt, Artificial Sequence
  B2M targeting sequence
guuuauaacuacagcuuggg

SEQ ID NO: 3976 - RNA, 20 nt, Artificial Sequence
  B2M targeting sequence
ccuucugcuagguagcauuc

SEQ ID NO: 3977 - RNA, 20 nt, Artificial Sequence
  B2M targeting sequence
uucugcuagguagcauucaa

SEQ ID NO: 3978 - RNA, 20 nt, Artificial Sequence
  B2M targeting sequence
gcuagguagcauucaaagau

SEQ ID NO: 3979 - RNA, 20 nt, Artificial Sequence
  B2M targeting sequence
aagaucuuaaucuucugggu

SEQ ID NO: 3980 - RNA, 20 nt, Artificial Sequence
  B2M targeting sequence
uugaaugcuaccuagcagaa

SEQ ID NO: 3981 - RNA, 20 nt, Artificial Sequence
  B2M targeting sequence
uaaucuucuggguuuccguu

SEQ ID NO: 3982 - RNA, 20 nt, Artificial Sequence
  B2M targeting sequence
ucuggguuuccguuuucucg

SEQ ID NO: 3983 - RNA, 20 nt, Artificial Sequence
  B2M targeting sequence
ggguuuccguuuucucgaau

SEQ ID NO: 3984 - RNA, 20 nt, Artificial Sequence
  B2M targeting sequence
guuuucucgaaugaaaaaug

SEQ ID NO: 3985 - RNA, 20 nt, Artificial Sequence
  B2M targeting sequence
cgaaugaaaaaugcaggucc

SEQ ID NO: 3986 - RNA, 20 nt, Artificial Sequence
  B2M targeting sequence
aaugaaaaaugcagguccga

SEQ ID NO: 3987 - RNA, 20 nt, Artificial Sequence
  B2M targeting sequence
agaaaacggaaacccagaag

SEQ ID NO: 3988 - RNA, 20 nt, Artificial Sequence
  B2M targeting sequence
uucgagaaaacggaaaccca

SEQ ID NO: 3989 - RNA, 20 nt, Artificial Sequence
  B2M targeting sequence
gagcaguuaacuggcugggg

SEQ ID NO: 3990 - RNA, 20 nt, Artificial Sequence
  B2M targeting sequence
gaccugcauuuuucauucga

SEQ ID NO: 3991 - RNA, 20 nt, Artificial Sequence
  B2M targeting sequence
cuuagcaucucuggggccag

SEQ ID NO: 3992 - RNA, 20 nt, Artificial Sequence
  B2M targeting sequence
cuggggccagucugcaaagc

SEQ ID NO: 3993 - RNA, 20 nt, Artificial Sequence
  B2M targeting sequence
ggggccagucugcaaagcga

SEQ ID NO: 3994 - RNA, 20 nt, Artificial Sequence
  B2M targeting sequence
gcaaagcgagggggcagccu

SEQ ID NO: 3995 - RNA, 20 nt, Artificial Sequence
  B2M targeting sequence
cuuugcagacuggccccaga

SEQ ID NO: 3996 - DNA, 20 bp, Artificial Sequence
  B2M targeting sequence
agcctgaagtcctagaatga

SEQ ID NO: 3997 - DNA, 20 bp, Artificial Sequence
  B2M targeting sequence
ggctggaggcacattaaggc

SEQ ID NO: 3998 - DNA, 20 bp, Artificial Sequence
  B2M targeting sequence
tagaatgagcgcccggtgtc

SEQ ID NO: 3999 - DNA, 20 bp, Artificial Sequence
  B2M targeting sequence
aggacttcaggctggaggca

SEQ ID NO: 4000 - DNA, 20 bp, Artificial Sequence
  B2M targeting sequence
ttctaggacttcaggctgga

SEQ ID NO: 4001 - DNA, 20 bp, Artificial Sequence
  B2M targeting sequence
caagctggggcgcgcacccc

SEQ ID NO: 4002 - DNA, 20 bp, Artificial Sequence
  B2M targeting sequence
ggggtgcgcgccccagcttg

SEQ ID NO: 4003 - DNA, 20 bp, Artificial Sequence
  B2M targeting sequence
gagggcgccgatgtacagac

SEQ ID NO: 4004 - DNA, 20 bp, Artificial Sequence
  B2M targeting sequence
gatctggggtgcgcgcccca

SEQ ID NO: 4005 - DNA, 20 bp, Artificial Sequence
  B2M targeting sequence
gcgccctccgatctggggtg

SEQ ID NO: 4006 - DNA, 20 bp, Artificial Sequence
  B2M targeting sequence
gtacatcggcgccctccgat

SEQ ID NO: 4007 - DNA, 20 bp, Artificial Sequence
  B2M targeting sequence
cccagtctagtgcatgcctt

SEQ ID NO: 4008 - DNA, 20 bp, Artificial Sequence
  B2M targeting sequence
agtgcatgccttcttaaaca

SEQ ID NO: 4009 - DNA, 20 bp, Artificial Sequence
  B2M targeting sequence
taaacatcacgagactctaa

SEQ ID NO: 4010 - DNA, 20 bp, Artificial Sequence
  B2M targeting sequence
cgagactctaagaaaaggaa

SEQ ID NO: 4011 - DNA, 20 bp, Artificial Sequence
  B2M targeting sequence
tgatgtttaagaaggcatgc

SEQ ID NO: 4012 - DNA, 20 bp, Artificial Sequence
  B2M targeting sequence
cgtgatgtttaagaaggcat

SEQ ID NO: 4013 - DNA, 20 bp, Artificial Sequence
  B2M targeting sequence
aagaaaaggaaactgaaaac

SEQ ID NO: 4014 - DNA, 20 bp, Artificial Sequence
  B2M targeting sequence
tagagtctcgtgatgtttaa

SEQ ID NO: 4015 - DNA, 20 bp, Artificial Sequence
  B2M targeting sequence
ttttcttagagtctcgtgat

SEQ ID NO: 4016 - DNA, 20 bp, Artificial Sequence
  B2M targeting sequence
gtttccttttcttagagtct

SEQ ID NO: 4017 - DNA, 20 bp, Artificial Sequence
  B2M targeting sequence
cgttttcagtttccttttct

SEQ ID NO: 4018 - DNA, 20 bp, Artificial Sequence
  B2M targeting sequence
ctctctctaacctggcactg

SEQ ID NO: 4019 - DNA, 20 bp, Artificial Sequence
  B2M targeting sequence
ctctaacctggcactgcgtc

SEQ ID NO: 4020 - DNA, 20 bp, Artificial Sequence
  B2M targeting sequence
ctaacctggcactgcgtcgc

SEQ ID NO: 4021 - DNA, 20 bp, Artificial Sequence
  B2M targeting sequence
aacctggcactgcgtcgctg

SEQ ID NO: 4022 - DNA, 20 bp, Artificial Sequence
  B2M targeting sequence
ctggcttggagacaggtgac

SEQ ID NO: 4023 - DNA, 20 bp, Artificial Sequence
  B2M targeting sequence
aagccagcgacgcagtgcca

SEQ ID NO: 4024 - DNA, 20 bp, Artificial Sequence
  B2M targeting sequence
ccaagccagcgacgcagtgc

SEQ ID NO: 4025 - DNA, 20 bp, Artificial Sequence
  B2M targeting sequence
cctgtctccaagccagcgac

SEQ ID NO: 4026 - DNA, 20 bp, Artificial Sequence
  B2M targeting sequence
ctgcgggccttgtcctgatt

SEQ ID NO: 4027 - DNA, 20 bp, Artificial Sequence
  B2M targeting sequence
tgattggctgggcacgcgtt

SEQ ID NO: 4028 - DNA, 20 bp, Artificial Sequence
  B2M targeting sequence
ggacaaggcccgcagggacc

SEQ ID NO: 4029 - DNA, 20 bp, Artificial Sequence
  B2M targeting sequence
acttatattaaacgcgtgcc

SEQ ID NO: 4030 - DNA, 20 bp, Artificial Sequence
  B2M targeting sequence
cgctggcgggcattcctgaa

SEQ ID NO: 4031 - DNA, 20 bp, Artificial Sequence
  B2M targeting sequence
tgaagctgacagcattcggg

SEQ ID NO: 4032 - DNA, 20 bp, Artificial Sequence
  B2M targeting sequence
ggaatgcccgccagcgcgac

SEQ ID NO: 4033 - DNA, 20 bp, Artificial Sequence
  B2M targeting sequence
gcttcaggaatgcccgccag

SEQ ID NO: 4034 - DNA, 20 bp, Artificial Sequence
  B2M targeting sequence
ggccgagatgtctcgctccg

SEQ ID NO: 4035 - DNA, 20 bp, Artificial Sequence
  B2M targeting sequence
gcccgaatgctgtcagcttc

SEQ ID NO: 4036 - DNA, 20 bp, Artificial Sequence
  B2M targeting sequence
cggcccgaatgctgtcagct

SEQ ID NO: 4037 - DNA, 20 bp, Artificial Sequence
  B2M targeting sequence
cgctccgtggccttagctgt

SEQ ID NO: 4038 - DNA, 20 bp, Artificial Sequence
  B2M targeting sequence
ctccgtggccttagctgtgc

SEQ ID NO: 4039 - DNA, 20 bp, Artificial Sequence
  B2M targeting sequence
gtggccttagctgtgctcgc

SEQ ID NO: 4040 - DNA, 20 bp, Artificial Sequence
  B2M targeting sequence
cgctactctctctttctggc

SEQ ID NO: 4041 - DNA, 20 bp, Artificial Sequence
  B2M targeting sequence
ctctttctggcctggaggct

SEQ ID NO: 4042 - DNA, 20 bp, Artificial Sequence
  B2M targeting sequence
ctttctggcctggaggctat

SEQ ID NO: 4043 - DNA, 20 bp, Artificial Sequence
  B2M targeting sequence
ttctggcctggaggctatcc

SEQ ID NO: 4044 - DNA, 20 bp, Artificial Sequence
  B2M targeting sequence
ggcctggaggctatccagcg

SEQ ID NO: 4045 - DNA, 20 bp, Artificial Sequence
  B2M targeting sequence
aggccagaaagagagagtag

SEQ ID NO: 4046 - DNA, 20 bp, Artificial Sequence
  B2M targeting sequence
agcgtgagtctctcctaccc

SEQ ID NO: 4047 - DNA, 20 bp, Artificial Sequence
  B2M targeting sequence
cgctggatagcctccaggcc

SEQ ID NO: 4048 - DNA, 20 bp, Artificial Sequence
  B2M targeting sequence
ctcctaccctcccgctctgg

SEQ ID NO: 4049 - DNA, 20 bp, Artificial Sequence
  B2M targeting sequence
cctaccctcccgctctggtc

SEQ ID NO: 4050 - DNA, 20 bp, Artificial Sequence
  B2M targeting sequence
taccctcccgctctggtcct

SEQ ID NO: 4051 - DNA, 20 bp, Artificial Sequence
  B2M targeting sequence
cgctctggtccttcctctcc

SEQ ID NO: 4052 - DNA, 20 bp, Artificial Sequence
  B2M targeting sequence
ggtccttcctctcccgctct

SEQ ID NO: 4053 - DNA, 20 bp, Artificial Sequence
  B2M targeting sequence
ttcctctcccgctctgcacc

SEQ ID NO: 4054 - DNA, 20 bp, Artificial Sequence
  B2M targeting sequence
tctcccgctctgcaccctct

SEQ ID NO: 4055 - DNA, 20 bp, Artificial Sequence
  B2M targeting sequence
cccgctctgcaccctctgtg

SEQ ID NO: 4056 - DNA, 20 bp, Artificial Sequence
  B2M targeting sequence
cgctctgcaccctctgtggc

SEQ ID NO: 4057 - DNA, 20 bp, Artificial Sequence
  B2M targeting sequence
gcaccctctgtggccctcgc

SEQ ID NO: 4058 - DNA, 20 bp, Artificial Sequence
  B2M targeting sequence
gtggccctcgctgtgctctc

SEQ ID NO: 4059 - DNA, 20 bp, Artificial Sequence
  B2M targeting sequence
ctgtgctctctcgctccgtg

SEQ ID NO: 4060 - DNA, 20 bp, Artificial Sequence
  B2M targeting sequence
ctcgctccgtgacttccctt

SEQ ID NO: 4061 - DNA, 20 bp, Artificial Sequence
  B2M targeting sequence
cgctccgtgacttcccttct

SEQ ID NO: 4062 - DNA, 20 bp, Artificial Sequence
  B2M targeting sequence
ctccgtgacttcccttctcc

SEQ ID NO: 4063 - DNA, 20 bp, Artificial Sequence
  B2M targeting sequence
gtgacttcccttctccaagt

SEQ ID NO: 4064 - DNA, 20 bp, Artificial Sequence
  B2M targeting sequence
cggagcgagagagcacagcg

SEQ ID NO: 4065 - DNA, 20 bp, Artificial Sequence
  B2M targeting sequence
cttctccaagttctccttgg

SEQ ID NO: 4066 - DNA, 20 bp, Artificial Sequence
  B2M targeting sequence
ccaagttctccttggtggcc

SEQ ID NO: 4067 - DNA, 20 bp, Artificial Sequence
  B2M targeting sequence
aagttctccttggtggcccg

SEQ ID NO: 4068 - DNA, 20 bp, Artificial Sequence
  B2M targeting sequence
ccttggtggcccgccgtggg

SEQ ID NO: 4069 - DNA, 20 bp, Artificial Sequence
  B2M targeting sequence
ttggtggcccgccgtggggc

SEQ ID NO: 4070 - DNA, 20 bp, Artificial Sequence
  B2M targeting sequence
agggctggatctcggggaag

SEQ ID NO: 4071 - DNA, 20 bp, Artificial Sequence
  B2M targeting sequence
agccctggactagccccacg

SEQ ID NO: 4072 - DNA, 20 bp, Artificial Sequence
  B2M targeting sequence
cggggaagcggcggggtggc

SEQ ID NO: 4073 - DNA, 20 bp, Artificial Sequence
  B2M targeting sequence
gggaagcggcggggtggcct

SEQ ID NO: 4074 - DNA, 20 bp, Artificial Sequence
  B2M targeting sequence
ccgagatccagccctggact

SEQ ID NO: 4075 - DNA, 20 bp, Artificial Sequence
  B2M targeting sequence
caggccaccccgccgcttcc

SEQ ID NO: 4076 - DNA, 20 bp, Artificial Sequence
  B2M targeting sequence
ccactcccaggccaccccgc

SEQ ID NO: 4077 - DNA, 20 bp, Artificial Sequence
  B2M targeting sequence
cgggtgcgcacccccttccc

SEQ ID NO: 4078 - DNA, 20 bp, Artificial Sequence
  B2M targeting sequence
gcggggagcaggggagacct

SEQ ID NO: 4079 - DNA, 20 bp, Artificial Sequence
  B2M targeting sequence
ccgccgaaaggggcaagtag

SEQ ID NO: 4080 - DNA, 20 bp, Artificial Sequence
  B2M targeting sequence
cctgctccccgccgaaaggg

SEQ ID NO: 4081 - DNA, 20 bp, Artificial Sequence
  B2M targeting sequence
cccctgctccccgccgaaag

SEQ ID NO: 4082 - DNA, 20 bp, Artificial Sequence
  B2M targeting sequence
ccgtaggccaaaggtctccc

SEQ ID NO: 4083 - DNA, 20 bp, Artificial Sequence
  B2M targeting sequence
cgtcgccgtaggccaaaggt

SEQ ID NO: 4084 - DNA, 20 bp, Artificial Sequence
  B2M targeting sequence
ggacaaagtttagggcgtcg

SEQ ID NO: 4085 - DNA, 20 bp, Artificial Sequence
  B2M targeting sequence
cgaccctcccgtcgccgtag

SEQ ID NO: 4086 - DNA, 20 bp, Artificial Sequence
  B2M targeting sequence
ataagcgtcagagcgccgag

SEQ ID NO: 4087 - DNA, 20 bp, Artificial Sequence
  B2M targeting sequence
acgccctaaactttgtcccg

SEQ ID NO: 4088 - DNA, 20 bp, Artificial Sequence
  B2M targeting sequence
gagcgccgaggttgggggag

SEQ ID NO: 4089 - DNA, 20 bp, Artificial Sequence
  B2M targeting sequence
gacgcttatcgacgccctaa

SEQ ID NO: 4090 - DNA, 20 bp, Artificial Sequence
  B2M targeting sequence
gcgctctgacgcttatcgac

SEQ ID NO: 4091 - DNA, 20 bp, Artificial Sequence
  B2M targeting sequence
cccaacctcggcgctctgac

SEQ ID NO: 4092 - DNA, 20 bp, Artificial Sequence
  B2M targeting sequence
cttccgctctttcgcggggc

SEQ ID NO: 4093 - DNA, 20 bp, Artificial Sequence
  B2M targeting sequence
tccgctctttcgcggggcct

SEQ ID NO: 4094 - DNA, 20 bp, Artificial Sequence
  B2M targeting sequence
gctctttcgcggggcctctg

SEQ ID NO: 4095 - DNA, 20 bp, Artificial Sequence
  B2M targeting sequence
ttcgcggggcctctggctcc

SEQ ID NO: 4096 - DNA, 20 bp, Artificial Sequence
  B2M targeting sequence
cggggcctctggctccccca

SEQ ID NO: 4097 - DNA, 20 bp, Artificial Sequence
  B2M targeting sequence
ggctcccccagcgcagctgg

SEQ ID NO: 4098 - DNA, 20 bp, Artificial Sequence
  B2M targeting sequence
cccagcgcagctggagtggg

SEQ ID NO: 4099 - DNA, 20 bp, Artificial Sequence
  B2M targeting sequence
agctgcgctgggggagccag

SEQ ID NO: 4100 - DNA, 20 bp, Artificial Sequence
  B2M targeting sequence
cccactccagctgcgctggg

SEQ ID NO: 4101 - DNA, 20 bp, Artificial Sequence
  B2M targeting sequence
tcccaaaggcgcggcgctga

SEQ ID NO: 4102 - DNA, 20 bp, Artificial Sequence
  B2M targeting sequence
caaaggcgcggcgctgaggt

SEQ ID NO: 4103 - DNA, 20 bp, Artificial Sequence
  B2M targeting sequence
gcgccgcgcctttgggacga

SEQ ID NO: 4104 - DNA, 20 bp, Artificial Sequence
  B2M targeting sequence
caaacctcagcgccgcgcct

SEQ ID NO: 4105 - DNA, 20 bp, Artificial Sequence
  B2M targeting sequence
acgcgttcacaaacctcagc

SEQ ID NO: 4106 - DNA, 20 bp, Artificial Sequence
  B2M targeting sequence
gggggaggcgtcgcccgggt

SEQ ID NO: 4107 - DNA, 20 bp, Artificial Sequence
  B2M targeting sequence
cccagaccccaagcgcccct

SEQ ID NO: 4108 - DNA, 20 bp, Artificial Sequence
  B2M targeting sequence
cccgggtaagcctgtctgct

SEQ ID NO: 4109 - DNA, 20 bp, Artificial Sequence
  B2M targeting sequence
gctgcggctctgcttccctt

SEQ ID NO: 4110 - DNA, 20 bp, Artificial Sequence
  B2M targeting sequence
gcttcccttagactggagag

SEQ ID NO: 4111 - DNA, 20 bp, Artificial Sequence
  B2M targeting sequence
cttagactggagagctgtgg

SEQ ID NO: 4112 - DNA, 20 bp, Artificial Sequence
  B2M targeting sequence
aagggaagcagagccgcagc

SEQ ID NO: 4113 - DNA, 20 bp, Artificial Sequence
  B2M targeting sequence
agtctaagggaagcagagcc

SEQ ID NO: 4114 - DNA, 20 bp, Artificial Sequence
  B2M targeting sequence
ccagtctaagggaagcagag

SEQ ID NO: 4115 - DNA, 20 bp, Artificial Sequence
  B2M targeting sequence
acagctctccagtctaaggg

SEQ ID NO: 4116 - DNA, 20 bp, Artificial Sequence
  B2M targeting sequence
tctaggcgcccgctaagttc

SEQ ID NO: 4117 - DNA, 20 bp, Artificial Sequence
  B2M targeting sequence
aggcgcccgctaagttcgca

SEQ ID NO: 4118 - DNA, 20 bp, Artificial Sequence
  B2M targeting sequence
catgtcctagcacctctggg

SEQ ID NO: 4119 - DNA, 20 bp, Artificial Sequence
  B2M targeting sequence
tagcacctctgggtctatgt

SEQ ID NO: 4120 - DNA, 20 bp, Artificial Sequence
  B2M targeting sequence
gggtctatgtggggccacac

SEQ ID NO: 4121 - DNA, 20 bp, Artificial Sequence
  B2M targeting sequence
atgtggggccacaccgtggg

SEQ ID NO: 4122 - DNA, 20 bp, Artificial Sequence
  B2M targeting sequence
ccacggtgtggccccacata

SEQ ID NO: 4123 - DNA, 20 bp, Artificial Sequence
  B2M targeting sequence
tccccacggtgtggccccac

SEQ ID NO: 4124 - DNA, 20 bp, Artificial Sequence
  B2M targeting sequence
cgtgctgtttcctccccacg

SEQ ID NO: 4125 - DNA, 20 bp, Artificial Sequence
  B2M targeting sequence
acaaacgtcgcgtgctgttt

SEQ ID NO: 4126 - DNA, 20 bp, Artificial Sequence
  B2M targeting sequence
cagccaagcattctacaaac

SEQ ID NO: 4127 - DNA, 20 bp, Artificial Sequence
  B2M targeting sequence
aataattaacttatttgttc

SEQ ID NO: 4128 - DNA, 20 bp, Artificial Sequence
  B2M targeting sequence
aaaccgctttgtatcacagc

SEQ ID NO: 4129 - DNA, 20 bp, Artificial Sequence
  B2M targeting sequence
catcacatgtcacttttaaa

SEQ ID NO: 4130 - DNA, 20 bp, Artificial Sequence
  B2M targeting sequence
catgtcacttttaaaaaatt

SEQ ID NO: 4131 - DNA, 20 bp, Artificial Sequence
  B2M targeting sequence
cttttaaaaaattataagaa

SEQ ID NO: 4132 - DNA, 20 bp, Artificial Sequence
  B2M targeting sequence
tataattttttaaaagtgac

SEQ ID NO: 4133 - DNA, 20 bp, Artificial Sequence
  B2M targeting sequence
ataacgggtagttcttataa

SEQ ID NO: 4134 - DNA, 20 bp, Artificial Sequence
  B2M targeting sequence
ttctgtgtgccaaggacttt

SEQ ID NO: 4135 - DNA, 20 bp, Artificial Sequence
  B2M targeting sequence
gtgtgccaaggactttatgt

SEQ ID NO: 4136 - DNA, 20 bp, Artificial Sequence
  B2M targeting sequence
ttggcacacagaaagatgtc

SEQ ID NO: 4137 - DNA, 20 bp, Artificial Sequence
  B2M targeting sequence
tttaattttgaaaacagtta

SEQ ID NO: 4138 - DNA, 20 bp, Artificial Sequence
  B2M targeting sequence
aaattaaatgacgcaaagca

SEQ ID NO: 4139 - DNA, 20 bp, Artificial Sequence
  B2M targeting sequence
tccgccatagataactacta

SEQ ID NO: 4140 - DNA, 20 bp, Artificial Sequence
  B2M targeting sequence
gccatagataactactatgg

SEQ ID NO: 4141 - DNA, 20 bp, Artificial Sequence
  B2M targeting sequence
atggcggaagataactgttt

SEQ ID NO: 4142 - DNA, 20 bp, Artificial Sequence
  B2M targeting sequence
tctgcctctcacagatgaag

SEQ ID NO: 4143 - DNA, 20 bp, Artificial Sequence
  B2M targeting sequence
gcctctcacagatgaagaaa

SEQ ID NO: 4144 - DNA, 20 bp, Artificial Sequence
  B2M targeting sequence
cacagatgaagaaactaagg

SEQ ID NO: 4145 - DNA, 20 bp, Artificial Sequence
  B2M targeting sequence
cagatgaagaaactaaggca

SEQ ID NO: 4146 - DNA, 20 bp, Artificial Sequence
  B2M targeting sequence
gtgagaggcagaagataacc

SEQ ID NO: 4147 - DNA, 20 bp, Artificial Sequence
  B2M targeting sequence
tctgtgagaggcagaagata

SEQ ID NO: 4148 - DNA, 20 bp, Artificial Sequence
  B2M targeting sequence
tcatctgtgagaggcagaag

SEQ ID NO: 4149 - DNA, 20 bp, Artificial Sequence
  B2M targeting sequence
gtgccttagtttcttcatct

SEQ ID NO: 4150 - DNA, 20 bp, Artificial Sequence
  B2M targeting sequence
cggtgccttagtttcttcat

SEQ ID NO: 4151 - DNA, 20 bp, Artificial Sequence
  B2M targeting sequence
taaaatctcggtgccttagt

SEQ ID NO: 4152 - DNA, 20 bp, Artificial Sequence
  B2M targeting sequence
cctgtgtaattaagtttctt

SEQ ID NO: 4153 - DNA, 20 bp, Artificial Sequence
  B2M targeting sequence
agattgaagtcaagcctaac

SEQ ID NO: 4154 - DNA, 20 bp, Artificial Sequence
  B2M targeting sequence
attgctgccatttatcccct

SEQ ID NO: 4155 - DNA, 20 bp, Artificial Sequence
  B2M targeting sequence
cgattgctgccatttatccc

SEQ ID NO: 4156 - DNA, 20 bp, Artificial Sequence
  B2M targeting sequence
atctcgattgctgccattta

SEQ ID NO: 4157 - DNA, 20 bp, Artificial Sequence
  B2M targeting sequence
agcctaaccagggcttttgc

SEQ ID NO: 4158 - DNA, 20 bp, Artificial Sequence
  B2M targeting sequence
cgcaaaagccctggttaggc

SEQ ID NO: 4159 - DNA, 20 bp, Artificial Sequence
  B2M targeting sequence
tgcatttttttttaagaaaa

SEQ ID NO: 4160 - DNA, 20 bp, Artificial Sequence
  B2M targeting sequence
taaaaaaaaatgcacgaatt

SEQ ID NO: 4161 - DNA, 20 bp, Artificial Sequence
  B2M targeting sequence
gcgtgagattctccagagca

SEQ ID NO: 4162 - DNA, 20 bp, Artificial Sequence
  B2M targeting sequence
cgcagaaggcaggcgttttt

SEQ ID NO: 4163 - DNA, 20 bp, Artificial Sequence
  B2M targeting sequence
cacgcagaaggcaggcgttt

SEQ ID NO: 4164 - DNA, 20 bp, Artificial Sequence
  B2M targeting sequence
ccagagcaaactgggcggca

SEQ ID NO: 4165 - DNA, 20 bp, Artificial Sequence
  B2M targeting sequence
agagcaaactgggcggcatg

SEQ ID NO: 4166 - DNA, 20 bp, Artificial Sequence
  B2M targeting sequence
ggagaatctcacgcagaagg

SEQ ID NO: 4167 - DNA, 20 bp, Artificial Sequence
  B2M targeting sequence
tttcgtacagagggcttcct

SEQ ID NO: 4168 - DNA, 20 bp, Artificial Sequence
  B2M targeting sequence
tacagagggcttcctctttg

SEQ ID NO: 4169 - DNA, 20 bp, Artificial Sequence
  B2M targeting sequence
gtacgaaaagaccacagggc

SEQ ID NO: 4170 - DNA, 20 bp, Artificial Sequence
  B2M targeting sequence
tctttggctctttgcctggt

SEQ ID NO: 4171 - DNA, 20 bp, Artificial Sequence
  B2M targeting sequence
ttggctctttgcctggttgt

SEQ ID NO: 4172 - DNA, 20 bp, Artificial Sequence
  B2M targeting sequence
ttgcctggttgtttccaaga

SEQ ID NO: 4173 - DNA, 20 bp, Artificial Sequence
  B2M targeting sequence
aagatgtactgtgcctctta

SEQ ID NO: 4174 - DNA, 20 bp, Artificial Sequence
  B2M targeting sequence
tggaaacaaccaggcaaaga

SEQ ID NO: 4175 - DNA, 20 bp, Artificial Sequence
  B2M targeting sequence
tactttcggttttgaaaaca

SEQ ID NO: 4176 - DNA, 20 bp, Artificial Sequence
  B2M targeting sequence
gttttgaaaacatgaggggg

SEQ ID NO: 4177 - DNA, 20 bp, Artificial Sequence
  B2M targeting sequence
aaaccgaaagtaagaggcac

SEQ ID NO: 4178 - DNA, 20 bp, Artificial Sequence
  B2M targeting sequence
tgttttcaaaaccgaaagta

SEQ ID NO: 4179 - DNA, 20 bp, Artificial Sequence
  B2M targeting sequence
cagcacttagggaggccgag

SEQ ID NO: 4180 - DNA, 20 bp, Artificial Sequence
  B2M targeting sequence
ctaagtgctgggattacagg

SEQ ID NO: 4181 - DNA, 20 bp, Artificial Sequence
  B2M targeting sequence
gcctccctaagtgctgggat

SEQ ID NO: 4182 - DNA, 20 bp, Artificial Sequence
  B2M targeting sequence
cgcctcggcctccctaagtg

SEQ ID NO: 4183 - DNA, 20 bp, Artificial Sequence
  B2M targeting sequence
tcccgcctcggcctccctaa

SEQ ID NO: 4184 - DNA, 20 bp, Artificial Sequence
  B2M targeting sequence
agccatcctcccgcctcggc

SEQ ID NO: 4185 - DNA, 20 bp, Artificial Sequence
  B2M targeting sequence
gtagttgagaccagcctggc

SEQ ID NO: 4186 - DNA, 20 bp, Artificial Sequence
  B2M targeting sequence
actacggacctcaagccatc

SEQ ID NO: 4187 - DNA, 20 bp, Artificial Sequence
  B2M targeting sequence
caactacggacctcaagcca

SEQ ID NO: 4188 - DNA, 20 bp, Artificial Sequence
  B2M targeting sequence
ccatgttggccaggctggtc

SEQ ID NO: 4189 - DNA, 20 bp, Artificial Sequence
  B2M targeting sequence
ctacaaaaaataataacaaa

SEQ ID NO: 4190 - DNA, 20 bp, Artificial Sequence
  B2M targeting sequence
acaaaaaataataacaaaaa

SEQ ID NO: 4191 - DNA, 20 bp, Artificial Sequence
  B2M targeting sequence
tgcctgtggtcccagctgct

SEQ ID NO: 4192 - DNA, 20 bp, Artificial Sequence
  B2M targeting sequence
cagctgctccggtggctgag

SEQ ID NO: 4193 - DNA, 20 bp, Artificial Sequence
  B2M targeting sequence
ggtggctgaggcgggaggat

SEQ ID NO: 4194 - DNA, 20 bp, Artificial Sequence
  B2M targeting sequence
gccaccggagcagctgggac

SEQ ID NO: 4195 - DNA, 20 bp, Artificial Sequence
  B2M targeting sequence
cgcctcagccaccggagcag

SEQ ID NO: 4196 - DNA, 20 bp, Artificial Sequence
  B2M targeting sequence
tcccgcctcagccaccggag

SEQ ID NO: 4197 - DNA, 20 bp, Artificial Sequence
  B2M targeting sequence
cttgagcttaggcttttgag

SEQ ID NO: 4198 - DNA, 20 bp, Artificial Sequence
  B2M targeting sequence
tgagcttaggcttttgagct

SEQ ID NO: 4199 - DNA, 20 bp, Artificial Sequence
  B2M targeting sequence
agagatcctcccgcctcagc

SEQ ID NO: 4200 - DNA, 20 bp, Artificial Sequence
  B2M targeting sequence
aaagcctaagctcaagagat

SEQ ID NO: 4201 - DNA, 20 bp, Artificial Sequence
  B2M targeting sequence
tggcgccagtgcactccagc

SEQ ID NO: 4202 - DNA, 20 bp, Artificial Sequence
  B2M targeting sequence
agcgtgggcaacagagcgag

SEQ ID NO: 4203 - DNA, 20 bp, Artificial Sequence
  B2M targeting sequence
gttgcccacgctggagtgca

SEQ ID NO: 4204 - DNA, 20 bp, Artificial Sequence
  B2M targeting sequence
ctctgttgcccacgctggag

SEQ ID NO: 4205 - DNA, 20 bp, Artificial Sequence
  B2M targeting sequence
cgctctgttgcccacgctgg

SEQ ID NO: 4206 - DNA, 20 bp, Artificial Sequence
  B2M targeting sequence
ctcaaaaaagaaaaaaaaaa

SEQ ID NO: 4207 - DNA, 20 bp, Artificial Sequence
  B2M targeting sequence
caaaaaagaaaaaaaaaaaa

SEQ ID NO: 4208 - DNA, 20 bp, Artificial Sequence
  B2M targeting sequence
aaaaagaaaaaaaaaaaaaa

SEQ ID NO: 4209 - DNA, 20 bp, Artificial Sequence
  B2M targeting sequence
tttttgagagacagggtctc

SEQ ID NO: 4210 - DNA, 20 bp, Artificial Sequence
  B2M targeting sequence
ttttttttttttttcttttt

SEQ ID NO: 4211 - DNA, 20 bp, Artificial Sequence
  B2M targeting sequence
ttctttttttttttttttct

SEQ ID NO: 4212 - DNA, 20 bp, Artificial Sequence
  B2M targeting sequence
ctttcttttttttttttttt

SEQ ID NO: 4213 - DNA, 20 bp, Artificial Sequence
  B2M targeting sequence
tttctctttctttttttttt

SEQ ID NO: 4214 - DNA, 20 bp, Artificial Sequence
  B2M targeting sequence
tttcttttctctttcttttt

SEQ ID NO: 4215 - DNA, 20 bp, Artificial Sequence
  B2M targeting sequence
ttcttttcttttctctttct

SEQ ID NO: 4216 - DNA, 20 bp, Artificial Sequence
  B2M targeting sequence
ttctttcttttcttttctct

SEQ ID NO: 4217 - DNA, 20 bp, Artificial Sequence
  B2M targeting sequence
cttctttctttcttttcttt

SEQ ID NO: 4218 - DNA, 20 bp, Artificial Sequence
  B2M targeting sequence
gtcaggggagctgtaaaacc

SEQ ID NO: 4219 - DNA, 20 bp, Artificial Sequence
  B2M targeting sequence
ggggagctgtaaaaccatta

SEQ ID NO: 4220 - DNA, 20 bp, Artificial Sequence
  B2M targeting sequence
cctgactgacaaaccttcac

SEQ ID NO: 4221 - DNA, 20 bp, Artificial Sequence
  B2M targeting sequence
ttattaatggttttacagct

SEQ ID NO: 4222 - DNA, 20 bp, Artificial Sequence
  B2M targeting sequence
aagatggttaccaagactgt

SEQ ID NO: 4223 - DNA, 20 bp, Artificial Sequence
  B2M targeting sequence
tggattatctttattaatgg

SEQ ID NO: 4224 - DNA, 20 bp, Artificial Sequence
  B2M targeting sequence
tggtaaccatcttggattat

SEQ ID NO: 4225 - DNA, 20 bp, Artificial Sequence
  B2M targeting sequence
acagtcttggtaaccatctt

SEQ ID NO: 4226 - DNA, 20 bp, Artificial Sequence
  B2M targeting sequence
tcaacagtcttggtaaccat

SEQ ID NO: 4227 - DNA, 20 bp, Artificial Sequence
  B2M targeting sequence
ggcgtcctcaacagtcttgg

SEQ ID NO: 4228 - DNA, 20 bp, Artificial Sequence
  B2M targeting sequence
ctggcgtcctcaacagtctt

SEQ ID NO: 4229 - DNA, 20 bp, Artificial Sequence
  B2M targeting sequence
tgagcactttctaagtacct

SEQ ID NO: 4230 - DNA, 20 bp, Artificial Sequence
  B2M targeting sequence
agatctctggcgtcctcaac

SEQ ID NO: 4231 - DNA, 20 bp, Artificial Sequence
  B2M targeting sequence
aagtacctggcaatacacta

SEQ ID NO: 4232 - DNA, 20 bp, Artificial Sequence
  B2M targeting sequence
ccttttcctctggcaaaaca

SEQ ID NO: 4233 - DNA, 20 bp, Artificial Sequence
  B2M targeting sequence
tctggcaaaacatgatcgaa

SEQ ID NO: 4234 - DNA, 20 bp, Artificial Sequence
  B2M targeting sequence
ggcaaaacatgatcgaaagc

SEQ ID NO: 4235 - DNA, 20 bp, Artificial Sequence
  B2M targeting sequence
tgttttgccagaggaaaagg

SEQ ID NO: 4236 - DNA, 20 bp, Artificial Sequence
  B2M targeting sequence
aaagcagaatgttttgatca

SEQ ID NO: 4237 - DNA, 20 bp, Artificial Sequence
  B2M targeting sequence
atcatgttttgccagaggaa

SEQ ID NO: 4238 - DNA, 20 bp, Artificial Sequence
  B2M targeting sequence
gctttcgatcatgttttgcc

SEQ ID NO: 4239 - DNA, 20 bp, Artificial Sequence
  B2M targeting sequence
aaacattctgctttcgatca

SEQ ID NO: 4240 - DNA, 20 bp, Artificial Sequence
  B2M targeting sequence
tgagaaaattgcatttaatt

SEQ ID NO: 4241 - DNA, 20 bp, Artificial Sequence
  B2M targeting sequence
tgatcaaaacattctgcttt

SEQ ID NO: 4242 - DNA, 20 bp, Artificial Sequence
  B2M targeting sequence
catgatcaaaacattctgct

SEQ ID NO: 4243 - DNA, 20 bp, Artificial Sequence
  B2M targeting sequence
aattaaatgcaattttctca

SEQ ID NO: 4244 - DNA, 20 bp, Artificial Sequence
  B2M targeting sequence
tttatgttgtaaataaattg

SEQ ID NO: 4245 - DNA, 20 bp, Artificial Sequence
  B2M targeting sequence
ccaccattactggtatttgc

SEQ ID NO: 4246 - DNA, 20 bp, Artificial Sequence
  B2M targeting sequence
aacataaccagcaaatacca

SEQ ID NO: 4247 - DNA, 20 bp, Artificial Sequence
  B2M targeting sequence
ttttaaaaaataacaatctg

SEQ ID NO: 4248 - DNA, 20 bp, Artificial Sequence
  B2M targeting sequence
gatatttaaaaaaaaatctt

SEQ ID NO: 4249 - DNA, 20 bp, Artificial Sequence
  B2M targeting sequence
gattgttattttttaaaatg

SEQ ID NO: 4250 - DNA, 20 bp, Artificial Sequence
  B2M targeting sequence
tattttgaaaatttccaaag

SEQ ID NO: 4251 - DNA, 20 bp, Artificial Sequence
  B2M targeting sequence
aaataagatttttttttaaa

SEQ ID NO: 4252 - DNA, 20 bp, Artificial Sequence
  B2M targeting sequence
aaagtaatacatgccatgca

SEQ ID NO: 4253 - DNA, 20 bp, Artificial Sequence
  B2M targeting sequence
atgcatggcatgtattactt

SEQ ID NO: 4254 - DNA, 20 bp, Artificial Sequence
  B2M targeting sequence
ggaagataccacaagaaaca

SEQ ID NO: 4255 - DNA, 20 bp, Artificial Sequence
  B2M targeting sequence
agaaatggtctatgcatggc

SEQ ID NO: 4256 - DNA, 20 bp, Artificial Sequence
  B2M targeting sequence
tccagaaatggtctatgcat

SEQ ID NO: 4257 - DNA, 20 bp, Artificial Sequence
  B2M targeting sequence
tgtggtatcttccagaaatg

SEQ ID NO: 4258 - DNA, 20 bp, Artificial Sequence
  B2M targeting sequence
ttacatgtttcttgtggtat

SEQ ID NO: 4259 - DNA, 20 bp, Artificial Sequence
  B2M targeting sequence
tcattacatgtttcttgtgg

SEQ ID NO: 4260 - DNA, 20 bp, Artificial Sequence
  B2M targeting sequence
gaaggtctattttcctcctc

SEQ ID NO: 4261 - DNA, 20 bp, Artificial Sequence
  B2M targeting sequence
gaggcaatcatcattacatg

SEQ ID NO: 4262 - DNA, 20 bp, Artificial Sequence
  B2M targeting sequence
attttcctcctctgacctgt

SEQ ID NO: 4263 - DNA, 20 bp, Artificial Sequence
  B2M targeting sequence
tcctctgacctgtgtgtggg

SEQ ID NO: 4264 - DNA, 20 bp, Artificial Sequence
  B2M targeting sequence
tctgacctgtgtgtgggttt

SEQ ID NO: 4265 - DNA, 20 bp, Artificial Sequence
  B2M targeting sequence
gacctgtgtgtgggttttgt

SEQ ID NO: 4266 - DNA, 20 bp, Artificial Sequence
  B2M targeting sequence
gaggaggaaaatagaccttc

SEQ ID NO: 4267 - DNA, 20 bp, Artificial Sequence
  B2M targeting sequence
gttaagttttggaagcttaa

SEQ ID NO: 4268 - DNA, 20 bp, Artificial Sequence
  B2M targeting sequence
aaaacttaactgaaaaatta

SEQ ID NO: 4269 - DNA, 20 bp, Artificial Sequence
  B2M targeting sequence
ccaaaagtcataaagccagt

SEQ ID NO: 4270 - DNA, 20 bp, Artificial Sequence
  B2M targeting sequence
aaaagtcataaagccagtaa

SEQ ID NO: 4271 - DNA, 20 bp, Artificial Sequence
  B2M targeting sequence
taaagccagtaactggttga

SEQ ID NO: 4272 - DNA, 20 bp, Artificial Sequence
  B2M targeting sequence
accagttactggctttatga

SEQ ID NO: 4273 - DNA, 20 bp, Artificial Sequence
  B2M targeting sequence
aacccagcctgtctgatact

SEQ ID NO: 4274 - DNA, 20 bp, Artificial Sequence
  B2M targeting sequence
gatacttgtcctcttcttag

SEQ ID NO: 4275 - DNA, 20 bp, Artificial Sequence
  B2M targeting sequence
gacaggctgggtttgaattt

SEQ ID NO: 4276 - DNA, 20 bp, Artificial Sequence
  B2M targeting sequence
tcttcttagaaaagattaca

SEQ ID NO: 4277 - DNA, 20 bp, Artificial Sequence
  B2M targeting sequence
tcttagaaaagattacagtg

SEQ ID NO: 4278 - DNA, 20 bp, Artificial Sequence
  B2M targeting sequence
tagaaaagattacagtgatg

SEQ ID NO: 4279 - DNA, 20 bp, Artificial Sequence
  B2M targeting sequence
aagaagaggacaagtatcag

SEQ ID NO: 4280 - DNA, 20 bp, Artificial Sequence
  B2M targeting sequence
tttctaagaagaggacaagt

SEQ ID NO: 4281 - DNA, 20 bp, Artificial Sequence
  B2M targeting sequence
ctgtaatcttttctaagaag

SEQ ID NO: 4282 - DNA, 20 bp, Artificial Sequence
  B2M targeting sequence
cacaaaatcttgccgccttc

SEQ ID NO: 4283 - DNA, 20 bp, Artificial Sequence
  B2M targeting sequence
caaaatcttgccgccttccc

SEQ ID NO: 4284 - DNA, 20 bp, Artificial Sequence
  B2M targeting sequence
tgccgccttccctcaaacag

SEQ ID NO: 4285 - DNA, 20 bp, Artificial Sequence
  B2M targeting sequence
ctcaaacagagagttccagg

SEQ ID NO: 4286 - DNA, 20 bp, Artificial Sequence
  B2M targeting sequence
aacagagagttccaggcagg

SEQ ID NO: 4287 - DNA, 20 bp, Artificial Sequence
  B2M targeting sequence
gtttgagggaaggcggcaag

SEQ ID NO: 4288 - DNA, 20 bp, Artificial Sequence
  B2M targeting sequence
ctgtttgagggaaggcggca

SEQ ID NO: 4289 - DNA, 20 bp, Artificial Sequence
  B2M targeting sequence
aggcaggatgaatctgtgct

SEQ ID NO: 4290 - DNA, 20 bp, Artificial Sequence
  B2M targeting sequence
tgcctggaactctctgtttg

SEQ ID NO: 4291 - DNA, 20 bp, Artificial Sequence
  B2M targeting sequence
tcctgcctggaactctctgt

SEQ ID NO: 4292 - DNA, 20 bp, Artificial Sequence
  B2M targeting sequence
gtgctctgatccctgaggca

SEQ ID NO: 4293 - DNA, 20 bp, Artificial Sequence
  B2M targeting sequence
gatccctgaggcatttaata

SEQ ID NO: 4294 - DNA, 20 bp, Artificial Sequence
  B2M targeting sequence
gagcacagattcatcctgcc

SEQ ID NO: 4295 - DNA, 20 bp, Artificial Sequence
  B2M targeting sequence
ctgaggcatttaatatgttc

SEQ ID NO: 4296 - DNA, 20 bp, Artificial Sequence
  B2M targeting sequence
gggatcagagcacagattca

SEQ ID NO: 4297 - DNA, 20 bp, Artificial Sequence
  B2M targeting sequence
tattattagaagctcagatg

SEQ ID NO: 4298 - DNA, 20 bp, Artificial Sequence
  B2M targeting sequence
aataataagaacatattaaa

SEQ ID NO: 4299 - DNA, 20 bp, Artificial Sequence
  B2M targeting sequence
gatgcaaagagctctcttag

SEQ ID NO: 4300 - DNA, 20 bp, Artificial Sequence
  B2M targeting sequence
gagcttctaataataagaac

SEQ ID NO: 4301 - DNA, 20 bp, Artificial Sequence
  B2M targeting sequence
ttgcatctgagcttctaata

SEQ ID NO: 4302 - DNA, 20 bp, Artificial Sequence
  B2M targeting sequence
cttagcttttaatgttatga

SEQ ID NO: 4303 - DNA, 20 bp, Artificial Sequence
  B2M targeting sequence
tagcttttaatgttatgaaa

SEQ ID NO: 4304 - DNA, 20 bp, Artificial Sequence
  B2M targeting sequence
taacattaaaagctaagaga

SEQ ID NO: 4305 - DNA, 20 bp, Artificial Sequence
  B2M targeting sequence
ggtcttcattagattcccca

SEQ ID NO: 4306 - DNA, 20 bp, Artificial Sequence
  B2M targeting sequence
tcattagattccccaatcca

SEQ ID NO: 4307 - DNA, 20 bp, Artificial Sequence
  B2M targeting sequence
ttagattccccaatccacct

SEQ ID NO: 4308 - DNA, 20 bp, Artificial Sequence
  B2M targeting sequence
aatgaagacctgattttttt

SEQ ID NO: 4309 - DNA, 20 bp, Artificial Sequence
  B2M targeting sequence
ccaatccacctcttgatggg

SEQ ID NO: 4310 - DNA, 20 bp, Artificial Sequence
  B2M targeting sequence
acctcttgatggggctagta

SEQ ID NO: 4311 - DNA, 20 bp, Artificial Sequence
  B2M targeting sequence
tgatggggctagtagccttt

SEQ ID NO: 4312 - DNA, 20 bp, Artificial Sequence
  B2M targeting sequence
agaggtggattggggaatct

SEQ ID NO: 4313 - DNA, 20 bp, Artificial Sequence
  B2M targeting sequence
ttaatgatagggtgtttcta

SEQ ID NO: 4314 - DNA, 20 bp, Artificial Sequence
  B2M targeting sequence
ttaaggaaaggctactagcc

SEQ ID NO: 4315 - DNA, 20 bp, Artificial Sequence
  B2M targeting sequence
agagagatatatctggtcaa

SEQ ID NO: 4316 - DNA, 20 bp, Artificial Sequence
  B2M targeting sequence
agaaacaccctatcattaag

SEQ ID NO: 4317 - DNA, 20 bp, Artificial Sequence
  B2M targeting sequence
ctagaaacaccctatcatta

SEQ ID NO: 4318 - DNA, 20 bp, Artificial Sequence
  B2M targeting sequence
ctctagaaacaccctatcat

SEQ ID NO: 4319 - DNA, 20 bp, Artificial Sequence
  B2M targeting sequence
ggtcaaggtggcctggtact

SEQ ID NO: 4320 - DNA, 20 bp, Artificial Sequence
  B2M targeting sequence
aggtggcctggtactcctcc

SEQ ID NO: 4321 - DNA, 20 bp, Artificial Sequence
  B2M targeting sequence
tccttctccccacagcctcc

SEQ ID NO: 4322 - DNA, 20 bp, Artificial Sequence
  B2M targeting sequence
ttctccccacagcctcccag

SEQ ID NO: 4323 - DNA, 20 bp, Artificial Sequence
  B2M targeting sequence
ccccacagcctcccagacaa

SEQ ID NO: 4324 - DNA, 20 bp, Artificial Sequence
  B2M targeting sequence
ccacagcctcccagacaagg

SEQ ID NO: 4325 - DNA, 20 bp, Artificial Sequence
  B2M targeting sequence
cagacaaggaggagtagctg

SEQ ID NO: 4326 - DNA, 20 bp, Artificial Sequence
  B2M targeting sequence
gggaggctgtggggagaagg

SEQ ID NO: 4327 - DNA, 20 bp, Artificial Sequence
  B2M targeting sequence
ttgtctgggaggctgtgggg

SEQ ID NO: 4328 - DNA, 20 bp, Artificial Sequence
  B2M targeting sequence
tccttgtctgggaggctgtg

SEQ ID NO: 4329 - DNA, 20 bp, Artificial Sequence
  B2M targeting sequence
ctaaaaggcagctactcctc

SEQ ID NO: 4330 - DNA, 20 bp, Artificial Sequence
  B2M targeting sequence
tgtaccctgaatataagtgt

SEQ ID NO: 4331 - DNA, 20 bp, Artificial Sequence
  B2M targeting sequence
gggtacatgatcactaaaag

SEQ ID NO: 4332 - DNA, 20 bp, Artificial Sequence
  B2M targeting sequence
tttaaatacacttatattca

SEQ ID NO: 4333 - DNA, 20 bp, Artificial Sequence
  B2M targeting sequence
atctgtatatttagtagcac

SEQ ID NO: 4334 - DNA, 20 bp, Artificial Sequence
  B2M targeting sequence
gtatatttagtagcactaac

SEQ ID NO: 4335 - DNA, 20 bp, Artificial Sequence
  B2M targeting sequence
cttcattttcaatgaaaaat

SEQ ID NO: 4336 - DNA, 20 bp, Artificial Sequence
  B2M targeting sequence
tcattttcaatgaaaaatat

SEQ ID NO: 4337 - DNA, 20 bp, Artificial Sequence
  B2M targeting sequence
ttttcaatgaaaaatataga

SEQ ID NO: 4338 - DNA, 20 bp, Artificial Sequence
  B2M targeting sequence
atgaaaaatatagagtttat

SEQ ID NO: 4339 - DNA, 20 bp, Artificial Sequence
  B2M targeting sequence
ttgaaaatgaagagaagtgt

SEQ ID NO: 4340 - DNA, 20 bp, Artificial Sequence
  B2M targeting sequence
atatttttcattgaaaatga

SEQ ID NO: 4341 - DNA, 20 bp, Artificial Sequence
  B2M targeting sequence
tcccacttccccatggatgg

SEQ ID NO: 4342 - DNA, 20 bp, Artificial Sequence
  B2M targeting sequence
cacttccccatggatggtct

SEQ ID NO: 4343 - DNA, 20 bp, Artificial Sequence
  B2M targeting sequence
ccatggatggtctagtcatg

SEQ ID NO: 4344 - DNA, 20 bp, Artificial Sequence
  B2M targeting sequence
atggggaagtgggaagaaaa

SEQ ID NO: 4345 - DNA, 20 bp, Artificial Sequence
  B2M targeting sequence
agtcatgcctctcattttgg

SEQ ID NO: 4346 - DNA, 20 bp, Artificial Sequence
  B2M targeting sequence
tgcctctcattttggaaagt

SEQ ID NO: 4347 - DNA, 20 bp, Artificial Sequence
  B2M targeting sequence
cattttggaaagtactgttt

SEQ ID NO: 4348 - DNA, 20 bp, Artificial Sequence
  B2M targeting sequence
ttttggaaagtactgtttct

SEQ ID NO: 4349 - DNA, 20 bp, Artificial Sequence
  B2M targeting sequence
aaaatgagaggcatgactag

SEQ ID NO: 4350 - DNA, 20 bp, Artificial Sequence
  B2M targeting sequence
gaaacattaggcaatatatt

SEQ ID NO: 4351 - DNA, 20 bp, Artificial Sequence
  B2M targeting sequence
gaaacagtactttccaaaat

SEQ ID NO: 4352 - DNA, 20 bp, Artificial Sequence
  B2M targeting sequence
caacctggctagtttacagc

SEQ ID NO: 4353 - DNA, 20 bp, Artificial Sequence
  B2M targeting sequence
cctgtggatgctaattaaaa

SEQ ID NO: 4354 - DNA, 20 bp, Artificial Sequence
  B2M targeting sequence
acaggtgattgctgtaaact

SEQ ID NO: 4355 - DNA, 20 bp, Artificial Sequence
  B2M targeting sequence
cactgtcacatgcattactc

SEQ ID NO: 4356 - DNA, 20 bp, Artificial Sequence
  B2M targeting sequence
catgcattactccatttgat

SEQ ID NO: 4357 - DNA, 20 bp, Artificial Sequence
  B2M targeting sequence
atttgatcataatggaaagt

SEQ ID NO: 4358 - DNA, 20 bp, Artificial Sequence
  B2M targeting sequence
aatggagtaatgcatgtgac

SEQ ID NO: 4359 - DNA, 20 bp, Artificial Sequence
  B2M targeting sequence
taatggaaagtatgttctgt

SEQ ID NO: 4360 - DNA, 20 bp, Artificial Sequence
  B2M targeting sequence
attatgatcaaatggagtaa

SEQ ID NO: 4361 - DNA, 20 bp, Artificial Sequence
  B2M targeting sequence
gtcccatttgccatagtcct

SEQ ID NO: 4362 - DNA, 20 bp, Artificial Sequence
  B2M targeting sequence
catttgccatagtcctcacc

SEQ ID NO: 4363 - DNA, 20 bp, Artificial Sequence
  B2M targeting sequence
tcacctatccctgttgtatt

SEQ ID NO: 4364 - DNA, 20 bp, Artificial Sequence
  B2M targeting sequence
cctatccctgttgtatttta

SEQ ID NO: 4365 - DNA, 20 bp, Artificial Sequence
  B2M targeting sequence
ctgttgtattttatcgggtc

SEQ ID NO: 4366 - DNA, 20 bp, Artificial Sequence
  B2M targeting sequence
ggtccaactcaaccatttaa

SEQ ID NO: 4367 - DNA, 20 bp, Artificial Sequence
  B2M targeting sequence
aactcaaccatttaaggtat

SEQ ID NO: 4368 - DNA, 20 bp, Artificial Sequence
  B2M targeting sequence
accatttaaggtatttgcca

SEQ ID NO: 4369 - DNA, 20 bp, Artificial Sequence
  B2M targeting sequence
tgtatgcatttaggttttgt

SEQ ID NO: 4370 - DNA, 20 bp, Artificial Sequence
  B2M targeting sequence
ttgttttttagctcatgaaa

SEQ ID NO: 4371 - DNA, 20 bp, Artificial Sequence
  B2M targeting sequence
tgaaattaggtacaaagtca

SEQ ID NO: 4372 - DNA, 20 bp, Artificial Sequence
  B2M targeting sequence
tgagctaaaaaacaaagaaa

SEQ ID NO: 4373 - DNA, 20 bp, Artificial Sequence
  B2M targeting sequence
gagaggggtctggcatataa

SEQ ID NO: 4374 - DNA, 20 bp, Artificial Sequence
  B2M targeting sequence
gactttgtacctaatttcat

SEQ ID NO: 4375 - DNA, 20 bp, Artificial Sequence
  B2M targeting sequence
ctgactttgtacctaatttc

SEQ ID NO: 4376 - DNA, 20 bp, Artificial Sequence
  B2M targeting sequence
ggcatataaaacctcagcag

SEQ ID NO: 4377 - DNA, 20 bp, Artificial Sequence
  B2M targeting sequence
gcagaaataaagaggttttg

SEQ ID NO: 4378 - DNA, 20 bp, Artificial Sequence
  B2M targeting sequence
gctgaggttttatatgccag

SEQ ID NO: 4379 - DNA, 20 bp, Artificial Sequence
  B2M targeting sequence
ttatttctgctgaggtttta

SEQ ID NO: 4380 - DNA, 20 bp, Artificial Sequence
  B2M targeting sequence
taccaaacaacaaaacctct

SEQ ID NO: 4381 - DNA, 20 bp, Artificial Sequence
  B2M targeting sequence
tgcctgtaatcccaacactt

SEQ ID NO: 4382 - DNA, 20 bp, Artificial Sequence
  B2M targeting sequence
caacactttgggaggccaag

SEQ ID NO: 4383 - DNA, 20 bp, Artificial Sequence
  B2M targeting sequence
caaagtgttgggattacagg

SEQ ID NO: 4384 - DNA, 20 bp, Artificial Sequence
  B2M targeting sequence
gcctgccttggcctcccaaa

SEQ ID NO: 4385 - DNA, 20 bp, Artificial Sequence
  B2M targeting sequence
cttgaagttgggagttcaag

SEQ ID NO: 4386 - DNA, 20 bp, Artificial Sequence
  B2M targeting sequence
agtgatcagcctgccttggc

SEQ ID NO: 4387 - DNA, 20 bp, Artificial Sequence
  B2M targeting sequence
caacttcaagtgatcagcct

SEQ ID NO: 4388 - DNA, 20 bp, Artificial Sequence
  B2M targeting sequence
agaccagcctggccaacatg

SEQ ID NO: 4389 - DNA, 20 bp, Artificial Sequence
  B2M targeting sequence
tgaactcccaacttcaagtg

SEQ ID NO: 4390 - DNA, 20 bp, Artificial Sequence
  B2M targeting sequence
ccatgttggccaggctggtc

SEQ ID NO: 4391 - DNA, 20 bp, Artificial Sequence
  B2M targeting sequence
cgtctctactgaaaatacaa

SEQ ID NO: 4392 - DNA, 20 bp, Artificial Sequence
  B2M targeting sequence
ctactgaaaatacaaaaatt

SEQ ID NO: 4393 - DNA, 20 bp, Artificial Sequence
  B2M targeting sequence
actgaaaatacaaaaattaa

SEQ ID NO: 4394 - DNA, 20 bp, Artificial Sequence
  B2M targeting sequence
gtagagacgggatttcacca

SEQ ID NO: 4395 - DNA, 20 bp, Artificial Sequence
  B2M targeting sequence
caggaatcacttgaacccag

SEQ ID NO: 4396 - DNA, 20 bp, Artificial Sequence
  B2M targeting sequence
tgggactacaggcacacacc

SEQ ID NO: 4397 - DNA, 20 bp, Artificial Sequence
  B2M targeting sequence
cttgaacccaggaggcggag

SEQ ID NO: 4398 - DNA, 20 bp, Artificial Sequence
  B2M targeting sequence
agtgattcctgggactacag

SEQ ID NO: 4399 - DNA, 20 bp, Artificial Sequence
  B2M targeting sequence
tgggttcaagtgattcctgg

SEQ ID NO: 4400 - DNA, 20 bp, Artificial Sequence
  B2M targeting sequence
gcctcctgggttcaagtgat

SEQ ID NO: 4401 - DNA, 20 bp, Artificial Sequence
  B2M targeting sequence
ctgcaacctccgcctcctgg

SEQ ID NO: 4402 - DNA, 20 bp, Artificial Sequence
  B2M targeting sequence
gctcactgcaacctccgcct

SEQ ID NO: 4403 - DNA, 20 bp, Artificial Sequence
  B2M targeting sequence
cagctcactgcaacctccgc

SEQ ID NO: 4404 - DNA, 20 bp, Artificial Sequence
  B2M targeting sequence
caccactgcacactgcactc

SEQ ID NO: 4405 - DNA, 20 bp, Artificial Sequence
  B2M targeting sequence
ccactgcacactgcactcca

SEQ ID NO: 4406 - DNA, 20 bp, Artificial Sequence
  B2M targeting sequence
agcctgggcaatggaatgag

SEQ ID NO: 4407 - DNA, 20 bp, Artificial Sequence
  B2M targeting sequence
attgcccaggctggagtgca

SEQ ID NO: 4408 - DNA, 20 bp, Artificial Sequence
  B2M targeting sequence
ttccattgcccaggctggag

SEQ ID NO: 4409 - DNA, 20 bp, Artificial Sequence
  B2M targeting sequence
cattccattgcccaggctgg

SEQ ID NO: 4410 - DNA, 20 bp, Artificial Sequence
  B2M targeting sequence
atcccaaaaaataaaaaaat

SEQ ID NO: 4411 - DNA, 20 bp, Artificial Sequence
  B2M targeting sequence
caaaaaataaaaaaataaaa

SEQ ID NO: 4412 - DNA, 20 bp, Artificial Sequence
  B2M targeting sequence
ttatttttttatttttttat

SEQ ID NO: 4413 - DNA, 20 bp, Artificial Sequence
  B2M targeting sequence
acccaaggtatgttctttat

SEQ ID NO: 4414 - DNA, 20 bp, Artificial Sequence
  B2M targeting sequence
acttaggaacctcagataat

SEQ ID NO: 4415 - DNA, 20 bp, Artificial Sequence
  B2M targeting sequence
taagtggatcaacccaaggt

SEQ ID NO: 4416 - DNA, 20 bp, Artificial Sequence
  B2M targeting sequence
gataataacatctgccacgt

SEQ ID NO: 4417 - DNA, 20 bp, Artificial Sequence
  B2M targeting sequence
gaggttcctaagtggatcaa

SEQ ID NO: 4418 - DNA, 20 bp, Artificial Sequence
  B2M targeting sequence
gccacgtatagagcaattgc

SEQ ID NO: 4419 - DNA, 20 bp, Artificial Sequence
  B2M targeting sequence
atacgtggcagatgttatta

SEQ ID NO: 4420 - DNA, 20 bp, Artificial Sequence
  B2M targeting sequence
caggcactctactagacact

SEQ ID NO: 4421 - DNA, 20 bp, Artificial Sequence
  B2M targeting sequence
actagacacttcatacagtt

SEQ ID NO: 4422 - DNA, 20 bp, Artificial Sequence
  B2M targeting sequence
agtagagtgcctgggacata

SEQ ID NO: 4423 - DNA, 20 bp, Artificial Sequence
  B2M targeting sequence
tacagtttagaaaatcagat

SEQ ID NO: 4424 - DNA, 20 bp, Artificial Sequence
  B2M targeting sequence
aaactgtatgaagtgtctag

SEQ ID NO: 4425 - DNA, 20 bp, Artificial Sequence
  B2M targeting sequence
gatgggtgtagatcaaggca

SEQ ID NO: 4426 - DNA, 20 bp, Artificial Sequence
  B2M targeting sequence
gattttctaaactgtatgaa

SEQ ID NO: 4427 - DNA, 20 bp, Artificial Sequence
  B2M targeting sequence
acacccatctgattttctaa

SEQ ID NO: 4428 - DNA, 20 bp, Artificial Sequence
  B2M targeting sequence
aggcaggagcaggaaccaaa

SEQ ID NO: 4429 - DNA, 20 bp, Artificial Sequence
  B2M targeting sequence
tgccttgatctacacccatc

SEQ ID NO: 4430 - DNA, 20 bp, Artificial Sequence
  B2M targeting sequence
tgctcctgccttgatctaca

SEQ ID NO: 4431 - DNA, 20 bp, Artificial Sequence
  B2M targeting sequence
ttttggttcctgctcctgcc

SEQ ID NO: 4432 - DNA, 20 bp, Artificial Sequence
  B2M targeting sequence
tatgtttatgcctttctttt

SEQ ID NO: 4433 - DNA, 20 bp, Artificial Sequence
  B2M targeting sequence
attttttttcttatgtttat

SEQ ID NO: 4434 - DNA, 20 bp, Artificial Sequence
  B2M targeting sequence
accccttccattttttttct

SEQ ID NO: 4435 - DNA, 20 bp, Artificial Sequence
  B2M targeting sequence
gtttccaccccttccatttt

SEQ ID NO: 4436 - DNA, 20 bp, Artificial Sequence
  B2M targeting sequence
tgttattgtactctgtttcc

SEQ ID NO: 4437 - DNA, 20 bp, Artificial Sequence
  B2M targeting sequence
aattactcatgttattgtac

SEQ ID NO: 4438 - DNA, 20 bp, Artificial Sequence
  B2M targeting sequence
taatagcccccatcaaatta

SEQ ID NO: 4439 - DNA, 20 bp, Artificial Sequence
  B2M targeting sequence
gttcataatagcccccatca

SEQ ID NO: 4440 - DNA, 20 bp, Artificial Sequence
  B2M targeting sequence
cagttcataatagcccccat

SEQ ID NO: 4441 - DNA, 20 bp, Artificial Sequence
  B2M targeting sequence
tttctcagttcataatagcc

SEQ ID NO: 4442 - DNA, 20 bp, Artificial Sequence
  B2M targeting sequence
aagttcatttctcagttcat

SEQ ID NO: 4443 - DNA, 20 bp, Artificial Sequence
  B2M targeting sequence
tggggccaaatcatgtagac

SEQ ID NO: 4444 - DNA, 20 bp, Artificial Sequence
  B2M targeting sequence
tgtagactcttgagtgatgt

SEQ ID NO: 4445 - DNA, 20 bp, Artificial Sequence
  B2M targeting sequence
acatgatttggccccaagat

SEQ ID NO: 4446 - DNA, 20 bp, Artificial Sequence
  B2M targeting sequence
tgagtgatgtgttaaggaat

SEQ ID NO: 4447 - DNA, 20 bp, Artificial Sequence
  B2M targeting sequence
agagtctacatgatttggcc

SEQ ID NO: 4448 - DNA, 20 bp, Artificial Sequence
  B2M targeting sequence
ctcaagagtctacatgattt

SEQ ID NO: 4449 - DNA, 20 bp, Artificial Sequence
  B2M targeting sequence
ttaacacatcactcaagagt

SEQ ID NO: 4450 - DNA, 20 bp, Artificial Sequence
  B2M targeting sequence
tagcattccttaacacatca

SEQ ID NO: 4451 - DNA, 20 bp, Artificial Sequence
  B2M targeting sequence
gcactcatagcattccttaa

SEQ ID NO: 4452 - DNA, 20 bp, Artificial Sequence
  B2M targeting sequence
cagcactcatagcattcctt

SEQ ID NO: 4453 - DNA, 20 bp, Artificial Sequence
  B2M targeting sequence
gaagtccttgagagcctcca

SEQ ID NO: 4454 - DNA, 20 bp, Artificial Sequence
  B2M targeting sequence
gatgccctctcagcactcat

SEQ ID NO: 4455 - DNA, 20 bp, Artificial Sequence
  B2M targeting sequence
ttgagagcctccagagaaag

SEQ ID NO: 4456 - DNA, 20 bp, Artificial Sequence
  B2M targeting sequence
aggacttctgatgccctctc

SEQ ID NO: 4457 - DNA, 20 bp, Artificial Sequence
  B2M targeting sequence
caaggacttctgatgccctc

SEQ ID NO: 4458 - DNA, 20 bp, Artificial Sequence
  B2M targeting sequence
agagaaaggctcttaaaaat

SEQ ID NO: 4459 - DNA, 20 bp, Artificial Sequence
  B2M targeting sequence
ggaggctctcaaggacttct

SEQ ID NO: 4460 - DNA, 20 bp, Artificial Sequence
  B2M targeting sequence
ctggaggctctcaaggactt

SEQ ID NO: 4461 - DNA, 20 bp, Artificial Sequence
  B2M targeting sequence
taaaaatgcagcgcaatctc

SEQ ID NO: 4462 - DNA, 20 bp, Artificial Sequence
  B2M targeting sequence
ccagtgacagaagatactgc

SEQ ID NO: 4463 - DNA, 20 bp, Artificial Sequence
  B2M targeting sequence
agtgacagaagatactgcta

SEQ ID NO: 4464 - DNA, 20 bp, Artificial Sequence
  B2M targeting sequence
ctggagattgcgctgcattt

SEQ ID NO: 4465 - DNA, 20 bp, Artificial Sequence
  B2M targeting sequence
gtcactggagattgcgctgc

SEQ ID NO: 4466 - DNA, 20 bp, Artificial Sequence
  B2M targeting sequence
tctgtcactggagattgcgc

SEQ ID NO: 4467 - DNA, 20 bp, Artificial Sequence
  B2M targeting sequence
agcagtatcttctgtcactg

SEQ ID NO: 4468 - DNA, 20 bp, Artificial Sequence
  B2M targeting sequence
gctagaaaaaaaacaaaaaa

SEQ ID NO: 4469 - DNA, 20 bp, Artificial Sequence
  B2M targeting sequence
agcagatttctagcagtatc

SEQ ID NO: 4470 - DNA, 20 bp, Artificial Sequence
  B2M targeting sequence
atacatgccttttttgtttt

SEQ ID NO: 4471 - DNA, 20 bp, Artificial Sequence
  B2M targeting sequence
tctatacatgccttttttgt

SEQ ID NO: 4472 - DNA, 20 bp, Artificial Sequence
  B2M targeting sequence
taattcctctatacatgcct

SEQ ID NO: 4473 - DNA, 20 bp, Artificial Sequence
  B2M targeting sequence
ctcataattcctctatacat

SEQ ID NO: 4474 - DNA, 20 bp, Artificial Sequence
  B2M targeting sequence
ttccctcataattcctctat

SEQ ID NO: 4475 - DNA, 20 bp, Artificial Sequence
  B2M targeting sequence
cggtttattcttcaaaatgg

SEQ ID NO: 4476 - DNA, 20 bp, Artificial Sequence
  B2M targeting sequence
tcaaaatggaggtggcttgt

SEQ ID NO: 4477 - DNA, 20 bp, Artificial Sequence
  B2M targeting sequence
aaatggaggtggcttgttgg

SEQ ID NO: 4478 - DNA, 20 bp, Artificial Sequence
  B2M targeting sequence
attttgaagaataaaccgtg

SEQ ID NO: 4479 - DNA, 20 bp, Artificial Sequence
  B2M targeting sequence
caacaagccacctccatttt

SEQ ID NO: 4480 - DNA, 20 bp, Artificial Sequence
  B2M targeting sequence
accttcccaacaagccacct

SEQ ID NO: 4481 - DNA, 20 bp, Artificial Sequence
  B2M targeting sequence
tttggccagagtggaaatgg

SEQ ID NO: 4482 - DNA, 20 bp, Artificial Sequence
  B2M targeting sequence
ggccaaatgagcttccacct

SEQ ID NO: 4483 - DNA, 20 bp, Artificial Sequence
  B2M targeting sequence
actctggccaaatgagcttc

SEQ ID NO: 4484 - DNA, 20 bp, Artificial Sequence
  B2M targeting sequence
atttccactctggccaaatg

SEQ ID NO: 4485 - DNA, 20 bp, Artificial Sequence
  B2M targeting sequence
caattccatttccactctgg

SEQ ID NO: 4486 - DNA, 20 bp, Artificial Sequence
  B2M targeting sequence
cccaattccatttccactct

SEQ ID NO: 4487 - DNA, 20 bp, Artificial Sequence
  B2M targeting sequence
atgaccaaatgtaaacactt

SEQ ID NO: 4488 - DNA, 20 bp, Artificial Sequence
  B2M targeting sequence
atttctcccaattccatttc

SEQ ID NO: 4489 - DNA, 20 bp, Artificial Sequence
  B2M targeting sequence
tcgatttctcccaattccat

SEQ ID NO: 4490 - DNA, 20 bp, Artificial Sequence
  B2M targeting sequence
ggcaccaagtgtttacattt

SEQ ID NO: 4491 - DNA, 20 bp, Artificial Sequence
  B2M targeting sequence
agctatatcaggcaccaagt

SEQ ID NO: 4492 - DNA, 20 bp, Artificial Sequence
  B2M targeting sequence
cttggggctaacttggtgtc

SEQ ID NO: 4493 - DNA, 20 bp, Artificial Sequence
  B2M targeting sequence
tttcccgatattcctcaggt

SEQ ID NO: 4494 - DNA, 20 bp, Artificial Sequence
  B2M targeting sequence
cgatattcctcaggtactcc

SEQ ID NO: 4495 - DNA, 20 bp, Artificial Sequence
  B2M targeting sequence
ggaaaagacacattaatatt

SEQ ID NO: 4496 - DNA, 20 bp, Artificial Sequence
  B2M targeting sequence
tcaggtactccaaagattca

SEQ ID NO: 4497 - DNA, 20 bp, Artificial Sequence
  B2M targeting sequence
ggtactccaaagattcaggt

SEQ ID NO: 4498 - DNA, 20 bp, Artificial Sequence
  B2M targeting sequence
aaagattcaggtttactcac

SEQ ID NO: 4499 - DNA, 20 bp, Artificial Sequence
  B2M targeting sequence
ttggagtacctgaggaatat

SEQ ID NO: 4500 - DNA, 20 bp, Artificial Sequence
  B2M targeting sequence
ggtttactcacgtcatccag

SEQ ID NO: 4501 - DNA, 20 bp, Artificial Sequence
  B2M targeting sequence
cgtcatccagcagagaatgg

SEQ ID NO: 4502 - DNA, 20 bp, Artificial Sequence
  B2M targeting sequence
tccagcagagaatggaaagt

SEQ ID NO: 4503 - DNA, 20 bp, Artificial Sequence
  B2M targeting sequence
agcagagaatggaaagtcaa

SEQ ID NO: 4504 - DNA, 20 bp, Artificial Sequence
  B2M targeting sequence
gctggatgacgtgagtaaac

SEQ ID NO: 4505 - DNA, 20 bp, Artificial Sequence
  B2M targeting sequence
ctgctggatgacgtgagtaa

SEQ ID NO: 4506 - DNA, 20 bp, Artificial Sequence
  B2M targeting sequence
attctctgctggatgacgtg

SEQ ID NO: 4507 - DNA, 20 bp, Artificial Sequence
  B2M targeting sequence
aatttcctgaattgctatgt

SEQ ID NO: 4508 - DNA, 20 bp, Artificial Sequence
  B2M targeting sequence
tgaattgctatgtgtctggg

SEQ ID NO: 4509 - DNA, 20 bp, Artificial Sequence
  B2M targeting sequence
ggaaatttgactttccattc

SEQ ID NO: 4510 - DNA, 20 bp, Artificial Sequence
  B2M targeting sequence
gggtttcatccatccgacat

SEQ ID NO: 4511 - DNA, 20 bp, Artificial Sequence
  B2M targeting sequence
tccatccgacattgaagttg

SEQ ID NO: 4512 - DNA, 20 bp, Artificial Sequence
  B2M targeting sequence
atccgacattgaagttgact

SEQ ID NO: 4513 - DNA, 20 bp, Artificial Sequence
  B2M targeting sequence
gacattgaagttgacttact

SEQ ID NO: 4514 - DNA, 20 bp, Artificial Sequence
  B2M targeting sequence
gatggatgaaacccagacac

SEQ ID NO: 4515 - DNA, 20 bp, Artificial Sequence
  B2M targeting sequence
atgtcggatggatgaaaccc

SEQ ID NO: 4516 - DNA, 20 bp, Artificial Sequence
  B2M targeting sequence
acttcaatgtcggatggatg

SEQ ID NO: 4517 - DNA, 20 bp, Artificial Sequence
  B2M targeting sequence
gtaagtcaacttcaatgtcg

SEQ ID NO: 4518 - DNA, 20 bp, Artificial Sequence
  B2M targeting sequence
tcagtaagtcaacttcaatg

SEQ ID NO: 4519 - DNA, 20 bp, Artificial Sequence
  B2M targeting sequence
attcttcagtaagtcaactt

SEQ ID NO: 4520 - DNA, 20 bp, Artificial Sequence
  B2M targeting sequence
ccattcttcagtaagtcaac

SEQ ID NO: 4521 - DNA, 20 bp, Artificial Sequence
  B2M targeting sequence
ctccattcttcagtaagtca

SEQ ID NO: 4522 - DNA, 20 bp, Artificial Sequence
  B2M targeting sequence
ctctccattcttcagtaagt

SEQ ID NO: 4523 - DNA, 20 bp, Artificial Sequence
  B2M targeting sequence
attctctctccattcttcag

SEQ ID NO: 4524 - DNA, 20 bp, Artificial Sequence
  B2M targeting sequence
actttttcaattctctctcc

SEQ ID NO: 4525 - DNA, 20 bp, Artificial Sequence
  B2M targeting sequence
gacttgtctttcagcaagga

SEQ ID NO: 4526 - DNA, 20 bp, Artificial Sequence
  B2M targeting sequence
gaatgctccactttttcaat

SEQ ID NO: 4527 - DNA, 20 bp, Artificial Sequence
  B2M targeting sequence
ttcagcaaggactggtcttt

SEQ ID NO: 4528 - DNA, 20 bp, Artificial Sequence
  B2M targeting sequence
gcaaggactggtctttctat

SEQ ID NO: 4529 - DNA, 20 bp, Artificial Sequence
  B2M targeting sequence
ttgctgaaagacaagtctga

SEQ ID NO: 4530 - DNA, 20 bp, Artificial Sequence
  B2M targeting sequence
ttctatctcttgtactacac

SEQ ID NO: 4531 - DNA, 20 bp, Artificial Sequence
  B2M targeting sequence
atctcttgtactacactgaa

SEQ ID NO: 4532 - DNA, 20 bp, Artificial Sequence
  B2M targeting sequence
cttgtactacactgaattca

SEQ ID NO: 4533 - DNA, 20 bp, Artificial Sequence
  B2M targeting sequence
tgtactacactgaattcacc

SEQ ID NO: 4534 - DNA, 20 bp, Artificial Sequence
  B2M targeting sequence
gtgtagtacaagagatagaa

SEQ ID NO: 4535 - DNA, 20 bp, Artificial Sequence
  B2M targeting sequence
cccccactgaaaaagatgag

SEQ ID NO: 4536 - DNA, 20 bp, Artificial Sequence
  B2M targeting sequence
gtgggggtgaattcagtgta

SEQ ID NO: 4537 - DNA, 20 bp, Artificial Sequence
  B2M targeting sequence
ttttcagtgggggtgaattc

SEQ ID NO: 4538 - DNA, 20 bp, Artificial Sequence
  B2M targeting sequence
tctttttcagtgggggtgaa

SEQ ID NO: 4539 - DNA, 20 bp, Artificial Sequence
  B2M targeting sequence
cacggcaggcatactcatct

SEQ ID NO: 4540 - DNA, 20 bp, Artificial Sequence
  B2M targeting sequence
catggttcacacggcaggca

SEQ ID NO: 4541 - DNA, 20 bp, Artificial Sequence
  B2M targeting sequence
cagcccaagatagttaagtg

SEQ ID NO: 4542 - DNA, 20 bp, Artificial Sequence
  B2M targeting sequence
tgggctgtgacaaagtcaca

SEQ ID NO: 4543 - DNA, 20 bp, Artificial Sequence
  B2M targeting sequence
tacattcttttgtaagctgc

SEQ ID NO: 4544 - DNA, 20 bp, Artificial Sequence
  B2M targeting sequence
tttgtaagctgctgaaagtt

SEQ ID NO: 4545 - DNA, 20 bp, Artificial Sequence
  B2M targeting sequence
gcagcttacaaaagaatgta

SEQ ID NO: 4546 - DNA, 20 bp, Artificial Sequence
  B2M targeting sequence
tacacaactttcagcagctt

SEQ ID NO: 4547 - DNA, 20 bp, Artificial Sequence
  B2M targeting sequence
tatcataaagctgctttgat

SEQ ID NO: 4548 - DNA, 20 bp, Artificial Sequence
  B2M targeting sequence
taaagctgctttgatataaa

SEQ ID NO: 4549 - DNA, 20 bp, Artificial Sequence
  B2M targeting sequence
aagcagctttatgatatgac

SEQ ID NO: 4550 - DNA, 20 bp, Artificial Sequence
  B2M targeting sequence
atggccatactaccctgaat

SEQ ID NO: 4551 - DNA, 20 bp, Artificial Sequence
  B2M targeting sequence
gggtagtatggccatagacc

SEQ ID NO: 4552 - DNA, 20 bp, Artificial Sequence
  B2M targeting sequence
ttcagggtagtatggccata

SEQ ID NO: 4553 - DNA, 20 bp, Artificial Sequence
  B2M targeting sequence
catcccatctgatataaaca

SEQ ID NO: 4554 - DNA, 20 bp, Artificial Sequence
  B2M targeting sequence
catctgatataaacaatctg

SEQ ID NO: 4555 - DNA, 20 bp, Artificial Sequence
  B2M targeting sequence
gatataaacaatctgcatat

SEQ ID NO: 4556 - DNA, 20 bp, Artificial Sequence
  B2M targeting sequence
gatgggatgggactcattca

SEQ ID NO: 4557 - DNA, 20 bp, Artificial Sequence
  B2M targeting sequence
gcatattgggattgtcaggg

SEQ ID NO: 4558 - DNA, 20 bp, Artificial Sequence
  B2M targeting sequence
caatatgcagattgtttata

SEQ ID NO: 4559 - DNA, 20 bp, Artificial Sequence
  B2M targeting sequence
gggaatgttcttaaagatca

SEQ ID NO: 4560 - DNA, 20 bp, Artificial Sequence
  B2M targeting sequence
ctgacaatcccaatatgcag

SEQ ID NO: 4561 - DNA, 20 bp, Artificial Sequence
  B2M targeting sequence
taaagatcagattagtggca

SEQ ID NO: 4562 - DNA, 20 bp, Artificial Sequence
  B2M targeting sequence
ttaagaacattccctgacaa

SEQ ID NO: 4563 - DNA, 20 bp, Artificial Sequence
  B2M targeting sequence
gattagtggcacctgctgag

SEQ ID NO: 4564 - DNA, 20 bp, Artificial Sequence
  B2M targeting sequence
gatctttaagaacattccct

SEQ ID NO: 4565 - DNA, 20 bp, Artificial Sequence
  B2M targeting sequence
gcaggtgccactaatctgat

SEQ ID NO: 4566 - DNA, 20 bp, Artificial Sequence
  B2M targeting sequence
cagcaggtgccactaatctg

SEQ ID NO: 4567 - DNA, 20 bp, Artificial Sequence
  B2M targeting sequence
gtatctcagcaggtgccact

SEQ ID NO: 4568 - DNA, 20 bp, Artificial Sequence
  B2M targeting sequence
gaaccagtagtttccctgca

SEQ ID NO: 4569 - DNA, 20 bp, Artificial Sequence
  B2M targeting sequence
gaaaccatgctgtgcatcag

SEQ ID NO: 4570 - DNA, 20 bp, Artificial Sequence
  B2M targeting sequence
ctgcagttgagcagggagca

SEQ ID NO: 4571 - DNA, 20 bp, Artificial Sequence
  B2M targeting sequence
actgcagggaaactactggt

SEQ ID NO: 4572 - DNA, 20 bp, Artificial Sequence
  B2M targeting sequence
ctgctcaactgcagggaaac

SEQ ID NO: 4573 - DNA, 20 bp, Artificial Sequence
  B2M targeting sequence
taacacttcttacctactgg

SEQ ID NO: 4574 - DNA, 20 bp, Artificial Sequence
  B2M targeting sequence
tacctactggcttcctctag

SEQ ID NO: 4575 - DNA, 20 bp, Artificial Sequence
  B2M targeting sequence
tctagcttttgtggcagctt

SEQ ID NO: 4576 - DNA, 20 bp, Artificial Sequence
  B2M targeting sequence
agcttttgtggcagcttcag

SEQ ID NO: 4577 - DNA, 20 bp, Artificial Sequence
  B2M targeting sequence
ggtatatttagcactgaacg

SEQ ID NO: 4578 - DNA, 20 bp, Artificial Sequence
  B2M targeting sequence
gtgctaaatatacctgaagc

SEQ ID NO: 4579 - DNA, 20 bp, Artificial Sequence
  B2M targeting sequence
ttcagtgctaaatatacctg

SEQ ID NO: 4580 - DNA, 20 bp, Artificial Sequence
  B2M targeting sequence
caagaaggtataggcctttg

SEQ ID NO: 4581 - DNA, 20 bp, Artificial Sequence
  B2M targeting sequence
agaaggtataggcctttgtt

SEQ ID NO: 4582 - DNA, 20 bp, Artificial Sequence
  B2M targeting sequence
tgagatgttcgttcagtgct

SEQ ID NO: 4583 - DNA, 20 bp, Artificial Sequence
  B2M targeting sequence
tgctgtcctagcatcctata

SEQ ID NO: 4584 - DNA, 20 bp, Artificial Sequence
  B2M targeting sequence
tagcatcctataatcctgga

SEQ ID NO: 4585 - DNA, 20 bp, Artificial Sequence
  B2M targeting sequence
tataatcctggacttctcca

SEQ ID NO: 4586 - DNA, 20 bp, Artificial Sequence
  B2M targeting sequence
tggacttctccagtactttc

SEQ ID NO: 4587 - DNA, 20 bp, Artificial Sequence
  B2M targeting sequence
aggattataggatgctagga

SEQ ID NO: 4588 - DNA, 20 bp, Artificial Sequence
  B2M targeting sequence
ccagtactttctggctggat

SEQ ID NO: 4589 - DNA, 20 bp, Artificial Sequence
  B2M targeting sequence
agtactttctggctggattg

SEQ ID NO: 4590 - DNA, 20 bp, Artificial Sequence
  B2M targeting sequence
ggctggattggtatctgagg

SEQ ID NO: 4591 - DNA, 20 bp, Artificial Sequence
  B2M targeting sequence
agccagaaagtactggagaa

SEQ ID NO: 4592 - DNA, 20 bp, Artificial Sequence
  B2M targeting sequence
gaggctagtaggaagggctt

SEQ ID NO: 4593 - DNA, 20 bp, Artificial Sequence
  B2M targeting sequence
gataccaatccagccagaaa

SEQ ID NO: 4594 - DNA, 20 bp, Artificial Sequence
  B2M targeting sequence
tactagcctcagataccaat

SEQ ID NO: 4595 - DNA, 20 bp, Artificial Sequence
  B2M targeting sequence
tgctgggtagctctaaacaa

SEQ ID NO: 4596 - DNA, 20 bp, Artificial Sequence
  B2M targeting sequence
aaacaatgtattcatgggta

SEQ ID NO: 4597 - DNA, 20 bp, Artificial Sequence
  B2M targeting sequence
tgggtaggaacagcagccta

SEQ ID NO: 4598 - DNA, 20 bp, Artificial Sequence
  B2M targeting sequence
tacccatgaatacattgttt

SEQ ID NO: 4599 - DNA, 20 bp, Artificial Sequence
  B2M targeting sequence
gccagccttatttctaacca

SEQ ID NO: 4600 - DNA, 20 bp, Artificial Sequence
  B2M targeting sequence
aaccattttagacatttgtt

SEQ ID NO: 4601 - DNA, 20 bp, Artificial Sequence
  B2M targeting sequence
aaaatggttagaaataaggc

SEQ ID NO: 4602 - DNA, 20 bp, Artificial Sequence
  B2M targeting sequence
tccttttttttctccactgt

SEQ ID NO: 4603 - DNA, 20 bp, Artificial Sequence
  B2M targeting sequence
ttttttttctccactgtctt

SEQ ID NO: 4604 - DNA, 20 bp, Artificial Sequence
  B2M targeting sequence
ccactgtctttttcatagat

SEQ ID NO: 4605 - DNA, 20 bp, Artificial Sequence
  B2M targeting sequence
actgtctttttcatagatcg

SEQ ID NO: 4606 - DNA, 20 bp, Artificial Sequence
  B2M targeting sequence
ttttcatagatcgagacatg

SEQ ID NO: 4607 - DNA, 20 bp, Artificial Sequence
  B2M targeting sequence
tagatcgagacatgtaagca

SEQ ID NO: 4608 - DNA, 20 bp, Artificial Sequence
  B2M targeting sequence
atgaaaaagacagtggagaa

SEQ ID NO: 4609 - DNA, 20 bp, Artificial Sequence
  B2M targeting sequence
agacatgtaagcagcatcat

SEQ ID NO: 4610 - DNA, 20 bp, Artificial Sequence
  B2M targeting sequence
atctatgaaaaagacagtgg

SEQ ID NO: 4611 - DNA, 20 bp, Artificial Sequence
  B2M targeting sequence
cgatctatgaaaaagacagt

SEQ ID NO: 4612 - DNA, 20 bp, Artificial Sequence
  B2M targeting sequence
tggaggtaagtttttgacct

SEQ ID NO: 4613 - DNA, 20 bp, Artificial Sequence
  B2M targeting sequence
atgatgctgcttacatgtct

SEQ ID NO: 4614 - DNA, 20 bp, Artificial Sequence
  B2M targeting sequence
aaaacttacctccatgatgc

SEQ ID NO: 4615 - DNA, 20 bp, Artificial Sequence
  B2M targeting sequence
aggtcaaaaacttacctcca

SEQ ID NO: 4616 - DNA, 20 bp, Artificial Sequence
  B2M targeting sequence
caaggtcaaaaacttacctc

SEQ ID NO: 4617 - DNA, 20 bp, Artificial Sequence
  B2M targeting sequence
ctgtcctgaggactatttat

SEQ ID NO: 4618 - DNA, 20 bp, Artificial Sequence
  B2M targeting sequence
tgaggactatttatagacag

SEQ ID NO: 4619 - DNA, 20 bp, Artificial Sequence
  B2M targeting sequence
ggacagtgaaacaaaaacat

SEQ ID NO: 4620 - DNA, 20 bp, Artificial Sequence
  B2M targeting sequence
tcaggacagtgaaacaaaaa

SEQ ID NO: 4621 - DNA, 20 bp, Artificial Sequence
  B2M targeting sequence
ataaatagtcctcaggacag

SEQ ID NO: 4622 - DNA, 20 bp, Artificial Sequence
  B2M targeting sequence
aacatgataaccctcactat

SEQ ID NO: 4623 - DNA, 20 bp, Artificial Sequence
  B2M targeting sequence
tgttagagctgtctataaat

SEQ ID NO: 4624 - DNA, 20 bp, Artificial Sequence
  B2M targeting sequence
ctatgtggagaacattgaca

SEQ ID NO: 4625 - DNA, 20 bp, Artificial Sequence
  B2M targeting sequence
acatagtgagggttatcatg

SEQ ID NO: 4626 - DNA, 20 bp, Artificial Sequence
  B2M targeting sequence
ccacatagtgagggttatca

SEQ ID NO: 4627 - DNA, 20 bp, Artificial Sequence
  B2M targeting sequence
atgttctccacatagtgagg

SEQ ID NO: 4628 - DNA, 20 bp, Artificial Sequence
  B2M targeting sequence
gtcaatgttctccacatagt

SEQ ID NO: 4629 - DNA, 20 bp, Artificial Sequence
  B2M targeting sequence
ctgctaaaatgttactctgt

SEQ ID NO: 4630 - DNA, 20 bp, Artificial Sequence
  B2M targeting sequence
ttccctgctaaaatgttact

SEQ ID NO: 4631 - DNA, 20 bp, Artificial Sequence
  B2M targeting sequence
tctttccctgctaaaatgtt

SEQ ID NO: 4632 - DNA, 20 bp, Artificial Sequence
  B2M targeting sequence
tacagggtcatgttcccttc

SEQ ID NO: 4633 - DNA, 20 bp, Artificial Sequence
  B2M targeting sequence
tgttcccttctcctgtggag

SEQ ID NO: 4634 - DNA, 20 bp, Artificial Sequence
  B2M targeting sequence
cttctcctgtggagtggcat

SEQ ID NO: 4635 - DNA, 20 bp, Artificial Sequence
  B2M targeting sequence
cctgtggagtggcatgaaga

SEQ ID NO: 4636 - DNA, 20 bp, Artificial Sequence
  B2M targeting sequence
tgtggagtggcatgaagaag

SEQ ID NO: 4637 - DNA, 20 bp, Artificial Sequence
  B2M targeting sequence
acaggagaagggaacatgac

SEQ ID NO: 4638 - DNA, 20 bp, Artificial Sequence
  B2M targeting sequence
tgccactccacaggagaagg

SEQ ID NO: 4639 - DNA, 20 bp, Artificial Sequence
  B2M targeting sequence
tcatgccactccacaggaga

SEQ ID NO: 4640 - DNA, 20 bp, Artificial Sequence
  B2M targeting sequence
gtaatatggccatacctggg

SEQ ID NO: 4641 - DNA, 20 bp, Artificial Sequence
  B2M targeting sequence
acagagagggcaaaggaact

SEQ ID NO: 4642 - DNA, 20 bp, Artificial Sequence
  B2M targeting sequence
gtagagggtcagtaatatgg

SEQ ID NO: 4643 - DNA, 20 bp, Artificial Sequence
  B2M targeting sequence
ctgtagagggtcagtaatat

SEQ ID NO: 4644 - DNA, 20 bp, Artificial Sequence
  B2M targeting sequence
tttgccctctctgtagaggg

SEQ ID NO: 4645 - DNA, 20 bp, Artificial Sequence
  B2M targeting sequence
tgcaataccatactggcagt

SEQ ID NO: 4646 - DNA, 20 bp, Artificial Sequence
  B2M targeting sequence
aagccttgcaggtaatgtgg

SEQ ID NO: 4647 - DNA, 20 bp, Artificial Sequence
  B2M targeting sequence
ttcttctgccatttccacat

SEQ ID NO: 4648 - DNA, 20 bp, Artificial Sequence
  B2M targeting sequence
tctgccatttccacattgga

SEQ ID NO: 4649 - DNA, 20 bp, Artificial Sequence
  B2M targeting sequence
gccatttccacattggacat

SEQ ID NO: 4650 - DNA, 20 bp, Artificial Sequence
  B2M targeting sequence
acattggacatctctgctga

SEQ ID NO: 4651 - DNA, 20 bp, Artificial Sequence
  B2M targeting sequence
aatgtggaaatggcagaaga

SEQ ID NO: 4652 - DNA, 20 bp, Artificial Sequence
  B2M targeting sequence
ctgctgaggagagaaaatga

SEQ ID NO: 4653 - DNA, 20 bp, Artificial Sequence
  B2M targeting sequence
gctgaggagagaaaatgaac

SEQ ID NO: 4654 - DNA, 20 bp, Artificial Sequence
  B2M targeting sequence
gcagagatgtccaatgtgga

SEQ ID NO: 4655 - DNA, 20 bp, Artificial Sequence
  B2M targeting sequence
tcagcagagatgtccaatgt

SEQ ID NO: 4656 - DNA, 20 bp, Artificial Sequence
  B2M targeting sequence
cctcagcagagatgtccaat

SEQ ID NO: 4657 - DNA, 20 bp, Artificial Sequence
  B2M targeting sequence
ctcctcagcagagatgtcca

SEQ ID NO: 4658 - DNA, 20 bp, Artificial Sequence
  B2M targeting sequence
ttttctctcctcagcagaga

SEQ ID NO: 4659 - DNA, 20 bp, Artificial Sequence
  B2M targeting sequence
tttcctttgtataatgttgt

SEQ ID NO: 4660 - DNA, 20 bp, Artificial Sequence
  B2M targeting sequence
tttgtataatgttgttttat

SEQ ID NO: 4661 - DNA, 20 bp, Artificial Sequence
  B2M targeting sequence
tcagacagaagagaggagtt

SEQ ID NO: 4662 - DNA, 20 bp, Artificial Sequence
  B2M targeting sequence
gacagaagagaggagttata

SEQ ID NO: 4663 - DNA, 20 bp, Artificial Sequence
  B2M targeting sequence
gaagaataaaacaacattat

SEQ ID NO: 4664 - DNA, 20 bp, Artificial Sequence
  B2M targeting sequence
gtctgaagaataaaacaaca

SEQ ID NO: 4665 - DNA, 20 bp, Artificial Sequence
  B2M targeting sequence
tctgtctgaagaataaaaca

SEQ ID NO: 4666 - DNA, 20 bp, Artificial Sequence
  B2M targeting sequence
cttctgtctgaagaataaaa

SEQ ID NO: 4667 - DNA, 20 bp, Artificial Sequence
  B2M targeting sequence
tctcttctgtctgaagaata

SEQ ID NO: 4668 - DNA, 20 bp, Artificial Sequence
  B2M targeting sequence
gcagacatcccattcctgta

SEQ ID NO: 4669 - DNA, 20 bp, Artificial Sequence
  B2M targeting sequence
gcagagctgtataactcctc

SEQ ID NO: 4670 - DNA, 20 bp, Artificial Sequence
  B2M targeting sequence
cattcctgtatggggactgt

SEQ ID NO: 4671 - DNA, 20 bp, Artificial Sequence
  B2M targeting sequence
tgtatggggactgtgtttgc

SEQ ID NO: 4672 - DNA, 20 bp, Artificial Sequence
  B2M targeting sequence
ccatacaggaatgggatgtc

SEQ ID NO: 4673 - DNA, 20 bp, Artificial Sequence
  B2M targeting sequence
tagaggttcccaggccacta

SEQ ID NO: 4674 - DNA, 20 bp, Artificial Sequence
  B2M targeting sequence
aagaggcaaacacagtcccc

SEQ ID NO: 4675 - DNA, 20 bp, Artificial Sequence
  B2M targeting sequence
caggccactagaggagataa

SEQ ID NO: 4676 - DNA, 20 bp, Artificial Sequence
  B2M targeting sequence
agtggcctgggaacctctaa

SEQ ID NO: 4677 - DNA, 20 bp, Artificial Sequence
  B2M targeting sequence
tctagtggcctgggaacctc

SEQ ID NO: 4678 - DNA, 20 bp, Artificial Sequence
  B2M targeting sequence
cctctagtggcctgggaacc

SEQ ID NO: 4679 - DNA, 20 bp, Artificial Sequence
  B2M targeting sequence
ctttatctcctctagtggcc

SEQ ID NO: 4680 - DNA, 20 bp, Artificial Sequence
  B2M targeting sequence
gtttccctttatctcctcta

SEQ ID NO: 4681 - DNA, 20 bp, Artificial Sequence
  B2M targeting sequence
agttataacaatctgtttcc

SEQ ID NO: 4682 - DNA, 20 bp, Artificial Sequence
  B2M targeting sequence
ttatatcaagttataacaat

SEQ ID NO: 4683 - DNA, 20 bp, Artificial Sequence
  B2M targeting sequence
attatagtatcattatatca

SEQ ID NO: 4684 - DNA, 20 bp, Artificial Sequence
  B2M targeting sequence
ttgtagttacatctattata

SEQ ID NO: 4685 - DNA, 20 bp, Artificial Sequence
  B2M targeting sequence
agaagcaagagagagggagg

SEQ ID NO: 4686 - DNA, 20 bp, Artificial Sequence
  B2M targeting sequence
ggagctccttgtagttacat

SEQ ID NO: 4687 - DNA, 20 bp, Artificial Sequence
  B2M targeting sequence
tgcttctggagctccttgta

SEQ ID NO: 4688 - DNA, 20 bp, Artificial Sequence
  B2M targeting sequence
cttgcttctggagctccttg

SEQ ID NO: 4689 - DNA, 20 bp, Artificial Sequence
  B2M targeting sequence
ctcttgcttctggagctcct

SEQ ID NO: 4690 - DNA, 20 bp, Artificial Sequence
  B2M targeting sequence
ctctctcttgcttctggagc

SEQ ID NO: 4691 - DNA, 20 bp, Artificial Sequence
  B2M targeting sequence
tccctctctcttgcttctgg

SEQ ID NO: 4692 - DNA, 20 bp, Artificial Sequence
  B2M targeting sequence
aagttcctccctctctcttg

SEQ ID NO: 4693 - DNA, 20 bp, Artificial Sequence
  B2M targeting sequence
ctgcatctttagttggagtc

SEQ ID NO: 4694 - DNA, 20 bp, Artificial Sequence
  B2M targeting sequence
gcatctttagttggagtcca

SEQ ID NO: 4695 - DNA, 20 bp, Artificial Sequence
  B2M targeting sequence
ttagttggagtccaaaggct

SEQ ID NO: 4696 - DNA, 20 bp, Artificial Sequence
  B2M targeting sequence
aactaaagatgcagagaagt

SEQ ID NO: 4697 - DNA, 20 bp, Artificial Sequence
  B2M targeting sequence
aaaggcttttcaatgaaatt

SEQ ID NO: 4698 - DNA, 20 bp, Artificial Sequence
  B2M targeting sequence
atgaaattctactgcccagg

SEQ ID NO: 4699 - DNA, 20 bp, Artificial Sequence
  B2M targeting sequence
ttgaaaagcctttggactcc

SEQ ID NO: 4700 - DNA, 20 bp, Artificial Sequence
  B2M targeting sequence
actgcccagggtacattgat

SEQ ID NO: 4701 - DNA, 20 bp, Artificial Sequence
  B2M targeting sequence
atgtaccctgggcagtagaa

SEQ ID NO: 4702 - DNA, 20 bp, Artificial Sequence
  B2M targeting sequence
gcatcaatgtaccctgggca

SEQ ID NO: 4703 - DNA, 20 bp, Artificial Sequence
  B2M targeting sequence
aatctcctgttatattctag

SEQ ID NO: 4704 - DNA, 20 bp, Artificial Sequence
  B2M targeting sequence
cctgttatattctagaacag

SEQ ID NO: 4705 - DNA, 20 bp, Artificial Sequence
  B2M targeting sequence
tgttatattctagaacaggg

SEQ ID NO: 4706 - DNA, 20 bp, Artificial Sequence
  B2M targeting sequence
agaacagggaattgatttgg

SEQ ID NO: 4707 - DNA, 20 bp, Artificial Sequence
  B2M targeting sequence
agaatataacaggagatttg

SEQ ID NO: 4708 - DNA, 20 bp, Artificial Sequence
  B2M targeting sequence
ctgttctagaatataacagg

SEQ ID NO: 4709 - DNA, 20 bp, Artificial Sequence
  B2M targeting sequence
attccctgttctagaatata

SEQ ID NO: 4710 - DNA, 20 bp, Artificial Sequence
  B2M targeting sequence
caaatcaattccctgttcta

SEQ ID NO: 4711 - DNA, 20 bp, Artificial Sequence
  B2M targeting sequence
cccaaatcaattccctgttc

SEQ ID NO: 4712 - DNA, 20 bp, Artificial Sequence
  B2M targeting sequence
ggaaggtggatgatctgccc

SEQ ID NO: 4713 - DNA, 20 bp, Artificial Sequence
  B2M targeting sequence
tgatgctctcccaaatcaat

SEQ ID NO: 4714 - DNA, 20 bp, Artificial Sequence
  B2M targeting sequence
accttcctgatgctctccca

SEQ ID NO: 4715 - DNA, 20 bp, Artificial Sequence
  B2M targeting sequence
tccaccttcctgatgctctc

SEQ ID NO: 4716 - DNA, 20 bp, Artificial Sequence
  B2M targeting sequence
gcccagtcacactgttagta

SEQ ID NO: 4717 - DNA, 20 bp, Artificial Sequence
  B2M targeting sequence
cactgttagtaaattgtaga

SEQ ID NO: 4718 - DNA, 20 bp, Artificial Sequence
  B2M targeting sequence
acaatttactaacagtgtga

SEQ ID NO: 4719 - DNA, 20 bp, Artificial Sequence
  B2M targeting sequence
tggctctacaatttactaac

SEQ ID NO: 4720 - DNA, 20 bp, Artificial Sequence
  B2M targeting sequence
ggtcctggctctacaattta

SEQ ID NO: 4721 - DNA, 20 bp, Artificial Sequence
  B2M targeting sequence
aatatagtcatgtgttactt

SEQ ID NO: 4722 - DNA, 20 bp, Artificial Sequence
  B2M targeting sequence
tgtgttacttaatgacgggg

SEQ ID NO: 4723 - DNA, 20 bp, Artificial Sequence
  B2M targeting sequence
ttaagtaacacatgactata

SEQ ID NO: 4724 - DNA, 20 bp, Artificial Sequence
  B2M targeting sequence
ccgtcattaagtaacacatg

SEQ ID NO: 4725 - DNA, 20 bp, Artificial Sequence
  B2M targeting sequence
gagaaatgcttacacaaacc

SEQ ID NO: 4726 - DNA, 20 bp, Artificial Sequence
  B2M targeting sequence
gaacatgtccccgtcattaa

SEQ ID NO: 4727 - DNA, 20 bp, Artificial Sequence
  B2M targeting sequence
cagaacatgtccccgtcatt

SEQ ID NO: 4728 - DNA, 20 bp, Artificial Sequence
  B2M targeting sequence
tagactacaaacctgtacag

SEQ ID NO: 4729 - DNA, 20 bp, Artificial Sequence
  B2M targeting sequence
aggagcaataggctatacca

SEQ ID NO: 4730 - DNA, 20 bp, Artificial Sequence
  B2M targeting sequence
gtacagtaacaggctgtaca

SEQ ID NO: 4731 - DNA, 20 bp, Artificial Sequence
  B2M targeting sequence
aaacatagaagttgcagtaa

SEQ ID NO: 4732 - DNA, 20 bp, Artificial Sequence
  B2M targeting sequence
atgtttagatacacaaatac

SEQ ID NO: 4733 - DNA, 20 bp, Artificial Sequence
  B2M targeting sequence
tatgagaccactgtcatata

SEQ ID NO: 4734 - DNA, 20 bp, Artificial Sequence
  B2M targeting sequence
taagattaaaatagcatatt

SEQ ID NO: 4735 - DNA, 20 bp, Artificial Sequence
  B2M targeting sequence
cataagattaaaatagcata

SEQ ID NO: 4736 - DNA, 20 bp, Artificial Sequence
  B2M targeting sequence
tatatacagtccatcattga

SEQ ID NO: 4737 - DNA, 20 bp, Artificial Sequence
  B2M targeting sequence
atcattgaccaaaacatcat

SEQ ID NO: 4738 - DNA, 20 bp, Artificial Sequence
  B2M targeting sequence
ttgaccaaaacatcatatca

SEQ ID NO: 4739 - DNA, 20 bp, Artificial Sequence
  B2M targeting sequence
atgatggactgtatatatga

SEQ ID NO: 4740 - DNA, 20 bp, Artificial Sequence
  B2M targeting sequence
tatcagcattttttcttcta

SEQ ID NO: 4741 - DNA, 20 bp, Artificial Sequence
  B2M targeting sequence
gcattttttcttctaagatt

SEQ ID NO: 4742 - DNA, 20 bp, Artificial Sequence
  B2M targeting sequence
tctaagattttgggagcacc

SEQ ID NO: 4743 - DNA, 20 bp, Artificial Sequence
  B2M targeting sequence
aagattttgggagcaccaaa

SEQ ID NO: 4744 - DNA, 20 bp, Artificial Sequence
  B2M targeting sequence
tagaagaaaaaatgctgata

SEQ ID NO: 4745 - DNA, 20 bp, Artificial Sequence
  B2M targeting sequence
caaaatcttagaagaaaaaa

SEQ ID NO: 4746 - DNA, 20 bp, Artificial Sequence
  B2M targeting sequence
ctttggtgctcccaaaatct

SEQ ID NO: 4747 - DNA, 20 bp, Artificial Sequence
  B2M targeting sequence
tgttagtgtatccctttggt

SEQ ID NO: 4748 - DNA, 20 bp, Artificial Sequence
  B2M targeting sequence
ttataatgggtttggagaac

SEQ ID NO: 4749 - DNA, 20 bp, Artificial Sequence
  B2M targeting sequence
aaacccattataaagagtat

SEQ ID NO: 4750 - DNA, 20 bp, Artificial Sequence
  B2M targeting sequence
ccaaacccattataaagagt

SEQ ID NO: 4751 - DNA, 20 bp, Artificial Sequence
  B2M targeting sequence
gcagctacttcttttaaaaa

SEQ ID NO: 4752 - DNA, 20 bp, Artificial Sequence
  B2M targeting sequence
tttaaaaaggtgatctacac

SEQ ID NO: 4753 - DNA, 20 bp, Artificial Sequence
  B2M targeting sequence
cctttttaaaagaagtagct

SEQ ID NO: 4754 - DNA, 20 bp, Artificial Sequence
  B2M targeting sequence
acacagtagaaattagacaa

SEQ ID NO: 4755 - DNA, 20 bp, Artificial Sequence
  B2M targeting sequence
actgtgtagatcaccttttt

SEQ ID NO: 4756 - DNA, 20 bp, Artificial Sequence
  B2M targeting sequence
aatttctactgtgtagatca

SEQ ID NO: 4757 - DNA, 20 bp, Artificial Sequence
  B2M targeting sequence
ttaccaaacttgtctaattt

SEQ ID NO: 4758 - DNA, 20 bp, Artificial Sequence
  B2M targeting sequence
cattaccaaacttgtctaat

SEQ ID NO: 4759 - DNA, 20 bp, Artificial Sequence
  B2M targeting sequence
gcaatccaaataaaataaat

SEQ ID NO: 4760 - DNA, 20 bp, Artificial Sequence
  B2M targeting sequence
aaataaaataaattcattgc

SEQ ID NO: 4761 - DNA, 20 bp, Artificial Sequence
  B2M targeting sequence
ttgctaacctttttcttttc

SEQ ID NO: 4762 - DNA, 20 bp, Artificial Sequence
  B2M targeting sequence
tttcttttcaggtttgaaga

SEQ ID NO: 4763 - DNA, 20 bp, Artificial Sequence
  B2M targeting sequence
tttcaggtttgaagatgccg

SEQ ID NO: 4764 - DNA, 20 bp, Artificial Sequence
  B2M targeting sequence
ggtttgaagatgccgcattt

SEQ ID NO: 4765 - DNA, 20 bp, Artificial Sequence
  B2M targeting sequence
aacctgaaaagaaaagaaaa

SEQ ID NO: 4766 - DNA, 20 bp, Artificial Sequence
  B2M targeting sequence
tcaaacctgaaaagaaaaga

SEQ ID NO: 4767 - DNA, 20 bp, Artificial Sequence
  B2M targeting sequence
aaatgcggcatcttcaaacc

SEQ ID NO: 4768 - DNA, 20 bp, Artificial Sequence
  B2M targeting sequence
aatccaaatgcggcatcttc

SEQ ID NO: 4769 - DNA, 20 bp, Artificial Sequence
  B2M targeting sequence
tccaatccaaatgcggcatc

SEQ ID NO: 4770 - DNA, 20 bp, Artificial Sequence
  B2M targeting sequence
aaattctgcttgcttgcttt

SEQ ID NO: 4771 - DNA, 20 bp, Artificial Sequence
  B2M targeting sequence
gcttgcttgctttttaatat

SEQ ID NO: 4772 - DNA, 20 bp, Artificial Sequence
  B2M targeting sequence
atattaaaaagcaagcaagc

SEQ ID NO: 4773 - DNA, 20 bp, Artificial Sequence
  B2M targeting sequence
atgttaacattattataacc

SEQ ID NO: 4774 - DNA, 20 bp, Artificial Sequence
  B2M targeting sequence
tgtccatgttaacattatta

SEQ ID NO: 4775 - DNA, 20 bp, Artificial Sequence
  B2M targeting sequence
tctttataattctactttga

SEQ ID NO: 4776 - DNA, 20 bp, Artificial Sequence
  B2M targeting sequence
ttataattctactttgagtg

SEQ ID NO: 4777 - DNA, 20 bp, Artificial Sequence
  B2M targeting sequence
actttgagtgctgtctccat

SEQ ID NO: 4778 - DNA, 20 bp, Artificial Sequence
  B2M targeting sequence
aagtagaattataaagaaga

SEQ ID NO: 4779 - DNA, 20 bp, Artificial Sequence
  B2M targeting sequence
ccatgtttgatgtatctgag

SEQ ID NO: 4780 - DNA, 20 bp, Artificial Sequence
  B2M targeting sequence
atgtttgatgtatctgagca

SEQ ID NO: 4781 - DNA, 20 bp, Artificial Sequence
  B2M targeting sequence
aacatggagacagcactcaa

SEQ ID NO: 4782 - DNA, 20 bp, Artificial Sequence
  B2M targeting sequence
gagcaggttgctccacaggt

SEQ ID NO: 4783 - DNA, 20 bp, Artificial Sequence
  B2M targeting sequence
gatacatcaaacatggagac

SEQ ID NO: 4784 - DNA, 20 bp, Artificial Sequence
  B2M targeting sequence
acaggtagctctaggagggc

SEQ ID NO: 4785 - DNA, 20 bp, Artificial Sequence
  B2M targeting sequence
aggagggctggcaacttaga

SEQ ID NO: 4786 - DNA, 20 bp, Artificial Sequence
  B2M targeting sequence
tagagctacctgtggagcaa

SEQ ID NO: 4787 - DNA, 20 bp, Artificial Sequence
  B2M targeting sequence
aagttgccagccctcctaga

SEQ ID NO: 4788 - DNA, 20 bp, Artificial Sequence
  B2M targeting sequence
ccacctctaagttgccagcc

SEQ ID NO: 4789 - DNA, 20 bp, Artificial Sequence
  B2M targeting sequence
gctccccacctctaagttgc

SEQ ID NO: 4790 - DNA, 20 bp, Artificial Sequence
  B2M targeting sequence
ctgctccccacctctaagtt

SEQ ID NO: 4791 - DNA, 20 bp, Artificial Sequence
  B2M targeting sequence
cttatccaacatcaacatct

SEQ ID NO: 4792 - DNA, 20 bp, Artificial Sequence
  B2M targeting sequence
tatccaacatcaacatcttg

SEQ ID NO: 4793 - DNA, 20 bp, Artificial Sequence
  B2M targeting sequence
aacatcaacatcttggtcag

SEQ ID NO: 4794 - DNA, 20 bp, Artificial Sequence
  B2M targeting sequence
acatcttggtcagatttgaa

SEQ ID NO: 4795 - DNA, 20 bp, Artificial Sequence
  B2M targeting sequence
tggtcagatttgaactcttc

SEQ ID NO: 4796 - DNA, 20 bp, Artificial Sequence
  B2M targeting sequence
gatttgaactcttcaatctc

SEQ ID NO: 4797 - DNA, 20 bp, Artificial Sequence
  B2M targeting sequence
gaccaagatgttgatgttgg

SEQ ID NO: 4798 - DNA, 20 bp, Artificial Sequence
  B2M targeting sequence
aatctgaccaagatgttgat

SEQ ID NO: 4799 - DNA, 20 bp, Artificial Sequence
  B2M targeting sequence
tcaatctcttgcactcaaag

SEQ ID NO: 4800 - DNA, 20 bp, Artificial Sequence
  B2M targeting sequence
atctcttgcactcaaagctt

SEQ ID NO: 4801 - DNA, 20 bp, Artificial Sequence
  B2M targeting sequence
cttgcactcaaagcttgtta

SEQ ID NO: 4802 - DNA, 20 bp, Artificial Sequence
  B2M targeting sequence
tgcactcaaagcttgttaag

SEQ ID NO: 4803 - DNA, 20 bp, Artificial Sequence
  B2M targeting sequence
aagcttgttaagatagttaa

SEQ ID NO: 4804 - DNA, 20 bp, Artificial Sequence
  B2M targeting sequence
taacaagctttgagtgcaag

SEQ ID NO: 4805 - DNA, 20 bp, Artificial Sequence
  B2M targeting sequence
aatttacatactctgcttag

SEQ ID NO: 4806 - DNA, 20 bp, Artificial Sequence
  B2M targeting sequence
gcttagaatttgggggaaaa

SEQ ID NO: 4807 - DNA, 20 bp, Artificial Sequence
  B2M targeting sequence
aagcagagtatgtaaattgg

SEQ ID NO: 4808 - DNA, 20 bp, Artificial Sequence
  B2M targeting sequence
cccaaattctaagcagagta

SEQ ID NO: 4809 - DNA, 20 bp, Artificial Sequence
  B2M targeting sequence
aaattttcccccaaattcta

SEQ ID NO: 4810 - DNA, 20 bp, Artificial Sequence
  B2M targeting sequence
attatatttctaaattttcc

SEQ ID NO: 4811 - DNA, 20 bp, Artificial Sequence
  B2M targeting sequence
tgtcaattatatttctaaat

SEQ ID NO: 4812 - DNA, 20 bp, Artificial Sequence
  B2M targeting sequence
aataatcctgtcaattatat

SEQ ID NO: 4813 - DNA, 20 bp, Artificial Sequence
  B2M targeting sequence
ttataacaaatttccaataa

SEQ ID NO: 4814 - DNA, 20 bp, Artificial Sequence
  B2M targeting sequence
ttcattataacaaatttcca

SEQ ID NO: 4815 - DNA, 20 bp, Artificial Sequence
  B2M targeting sequence
tataagattcatatttactt

SEQ ID NO: 4816 - DNA, 20 bp, Artificial Sequence
  B2M targeting sequence
tatatgacaaaatgtttcat

SEQ ID NO: 4817 - DNA, 20 bp, Artificial Sequence
  B2M targeting sequence
tatttacttcttatacattt

SEQ ID NO: 4818 - DNA, 20 bp, Artificial Sequence
  B2M targeting sequence
tatacatttgataaagtaag

SEQ ID NO: 4819 - DNA, 20 bp, Artificial Sequence
  B2M targeting sequence
aatgtataagaagtaaatat

SEQ ID NO: 4820 - DNA, 20 bp, Artificial Sequence
  B2M targeting sequence
ggtttatttttgttccacaa

SEQ ID NO: 4821 - DNA, 20 bp, Artificial Sequence
  B2M targeting sequence
acaagttaaataaatcataa

SEQ ID NO: 4822 - DNA, 20 bp, Artificial Sequence
  B2M targeting sequence
taaaacttgatgtgttatct

SEQ ID NO: 4823 - DNA, 20 bp, Artificial Sequence
  B2M targeting sequence
agttttatgatttatttaac

SEQ ID NO: 4824 - DNA, 20 bp, Artificial Sequence
  B2M targeting sequence
cttatatctcactcccacta

SEQ ID NO: 4825 - DNA, 20 bp, Artificial Sequence
  B2M targeting sequence
tatatctcactcccactatt

SEQ ID NO: 4826 - DNA, 20 bp, Artificial Sequence
  B2M targeting sequence
cactcccactattacccctt

SEQ ID NO: 4827 - DNA, 20 bp, Artificial Sequence
  B2M targeting sequence
ctcccactattaccccttta

SEQ ID NO: 4828 - DNA, 20 bp, Artificial Sequence
  B2M targeting sequence
cactattacccctttatttt

SEQ ID NO: 4829 - DNA, 20 bp, Artificial Sequence
  B2M targeting sequence
aacagggaaacagtcttcaa

SEQ ID NO: 4830 - DNA, 20 bp, Artificial Sequence
  B2M targeting sequence
ctgtttgaaaataaaggggt

SEQ ID NO: 4831 - DNA, 20 bp, Artificial Sequence
  B2M targeting sequence
tcaagttccacttggtaaaa

SEQ ID NO: 4832 - DNA, 20 bp, Artificial Sequence
  B2M targeting sequence
agttccacttggtaaaaaat

SEQ ID NO: 4833 - DNA, 20 bp, Artificial Sequence
  B2M targeting sequence
acttggtaaaaaatgtgaac

SEQ ID NO: 4834 - DNA, 20 bp, Artificial Sequence
  B2M targeting sequence
cattttttaccaagtggaac

SEQ ID NO: 4835 - DNA, 20 bp, Artificial Sequence
  B2M targeting sequence
atatacaaggggttcacatt

SEQ ID NO: 4836 - DNA, 20 bp, Artificial Sequence
  B2M targeting sequence
cagtgtaaagggcctcagtg

SEQ ID NO: 4837 - DNA, 20 bp, Artificial Sequence
  B2M targeting sequence
gtgattcacattttccagat

SEQ ID NO: 4838 - DNA, 20 bp, Artificial Sequence
  B2M targeting sequence
ctgaggccctttacactgtg

SEQ ID NO: 4839 - DNA, 20 bp, Artificial Sequence
  B2M targeting sequence
cattttccagattaggaatc

SEQ ID NO: 4840 - DNA, 20 bp, Artificial Sequence
  B2M targeting sequence
agattaggaatctgatgctc

SEQ ID NO: 4841 - DNA, 20 bp, Artificial Sequence
  B2M targeting sequence
ggaaaatgtgaatcactgag

SEQ ID NO: 4842 - DNA, 20 bp, Artificial Sequence
  B2M targeting sequence
taatctggaaaatgtgaatc

SEQ ID NO: 4843 - DNA, 20 bp, Artificial Sequence
  B2M targeting sequence
gatgctcaaagaagttaaat

SEQ ID NO: 4844 - DNA, 20 bp, Artificial Sequence
  B2M targeting sequence
gattcctaatctggaaaatg

SEQ ID NO: 4845 - DNA, 20 bp, Artificial Sequence
  B2M targeting sequence
aagaagttaaatggcatagt

SEQ ID NO: 4846 - DNA, 20 bp, Artificial Sequence
  B2M targeting sequence
ttgagcatcagattcctaat

SEQ ID NO: 4847 - DNA, 20 bp, Artificial Sequence
  B2M targeting sequence
ccccaactatgccatttaac

SEQ ID NO: 4848 - DNA, 20 bp, Artificial Sequence
  B2M targeting sequence
agtgggaggccagccttcta

SEQ ID NO: 4849 - DNA, 20 bp, Artificial Sequence
  B2M targeting sequence
cactagacagctgtgtcacc

SEQ ID NO: 4850 - DNA, 20 bp, Artificial Sequence
  B2M targeting sequence
atattttagccagcgttctt

SEQ ID NO: 4851 - DNA, 20 bp, Artificial Sequence
  B2M targeting sequence
ttcctgcgggccaggtcatg

SEQ ID NO: 4852 - DNA, 20 bp, Artificial Sequence
  B2M targeting sequence
tgcgggccaggtcatgagga

SEQ ID NO: 4853 - DNA, 20 bp, Artificial Sequence
  B2M targeting sequence
tgaggagtatgcagactcta

SEQ ID NO: 4854 - DNA, 20 bp, Artificial Sequence
  B2M targeting sequence
tgacctggcccgcaggaaag

SEQ ID NO: 4855 - DNA, 20 bp, Artificial Sequence
  B2M targeting sequence
tcatgacctggcccgcagga

SEQ ID NO: 4856 - DNA, 20 bp, Artificial Sequence
  B2M targeting sequence
gcatactcctcatgacctgg

SEQ ID NO: 4857 - DNA, 20 bp, Artificial Sequence
  B2M targeting sequence
aagagggagcaaaagtatct

SEQ ID NO: 4858 - DNA, 20 bp, Artificial Sequence
  B2M targeting sequence
tagagtctgcatactcctca

SEQ ID NO: 4859 - DNA, 20 bp, Artificial Sequence
  B2M targeting sequence
ctcttagagtctgcatactc

SEQ ID NO: 4860 - DNA, 20 bp, Artificial Sequence
  B2M targeting sequence
gaaggatttaatattttagc

SEQ ID NO: 4861 - DNA, 20 bp, Artificial Sequence
  B2M targeting sequence
gatacttttgctccctctta

SEQ ID NO: 4862 - DNA, 20 bp, Artificial Sequence
  B2M targeting sequence
ttcagatacttttgctccct

SEQ ID NO: 4863 - DNA, 20 bp, Artificial Sequence
  B2M targeting sequence
ttgctaaaatattaaatcct

SEQ ID NO: 4864 - DNA, 20 bp, Artificial Sequence
  B2M targeting sequence
attccttgctaaaatattaa

SEQ ID NO: 4865 - DNA, 20 bp, Artificial Sequence
  B2M targeting sequence
tcccttggtctccctggggg

SEQ ID NO: 4866 - DNA, 20 bp, Artificial Sequence
  B2M targeting sequence
cttggtctccctgggggatt

SEQ ID NO: 4867 - DNA, 20 bp, Artificial Sequence
  B2M targeting sequence
ccctgggggattggtttcag

SEQ ID NO: 4868 - DNA, 20 bp, Artificial Sequence
  B2M targeting sequence
ctgggggattggtttcagga

SEQ ID NO: 4869 - DNA, 20 bp, Artificial Sequence
  B2M targeting sequence
cccagggagaccaagggatg

SEQ ID NO: 4870 - DNA, 20 bp, Artificial Sequence
  B2M targeting sequence
ggaccccttcttggacacca

SEQ ID NO: 4871 - DNA, 20 bp, Artificial Sequence
  B2M targeting sequence
tgaaaccaatcccccaggga

SEQ ID NO: 4872 - DNA, 20 bp, Artificial Sequence
  B2M targeting sequence
tggacaccaaatctatggat

SEQ ID NO: 4873 - DNA, 20 bp, Artificial Sequence
  B2M targeting sequence
aagaaggggtcctgaaacca

SEQ ID NO: 4874 - DNA, 20 bp, Artificial Sequence
  B2M targeting sequence
atggatatttaagtcccttc

SEQ ID NO: 4875 - DNA, 20 bp, Artificial Sequence
  B2M targeting sequence
atagatttggtgtccaagaa

SEQ ID NO: 4876 - DNA, 20 bp, Artificial Sequence
  B2M targeting sequence
cttctataaaatggtatagt

SEQ ID NO: 4877 - DNA, 20 bp, Artificial Sequence
  B2M targeting sequence
ataaaatggtatagtatttg

SEQ ID NO: 4878 - DNA, 20 bp, Artificial Sequence
  B2M targeting sequence
acatcctcctgtatacttta

SEQ ID NO: 4879 - DNA, 20 bp, Artificial Sequence
  B2M targeting sequence
tcctgtatactttaaatcat

SEQ ID NO: 4880 - DNA, 20 bp, Artificial Sequence
  B2M targeting sequence
tgtatactttaaatcatttc

SEQ ID NO: 4881 - DNA, 20 bp, Artificial Sequence
  B2M targeting sequence
tttctagattacttgtaata

SEQ ID NO: 4882 - DNA, 20 bp, Artificial Sequence
  B2M targeting sequence
agattacttgtaatacctaa

SEQ ID NO: 4883 - DNA, 20 bp, Artificial Sequence
  B2M targeting sequence
agaaatgatttaaagtatac

SEQ ID NO: 4884 - DNA, 20 bp, Artificial Sequence
  B2M targeting sequence
ttaaacaataacaactattt

SEQ ID NO: 4885 - DNA, 20 bp, Artificial Sequence
  B2M targeting sequence
ttattccttaaacaataaca

SEQ ID NO: 4886 - DNA, 20 bp, Artificial Sequence
  B2M targeting sequence
tgtcattattccttaaacaa

SEQ ID NO: 4887 - DNA, 20 bp, Artificial Sequence
  B2M targeting sequence
gtacatgctcagtaaagaca

SEQ ID NO: 4888 - DNA, 20 bp, Artificial Sequence
  B2M targeting sequence
gtaaagacacaaccatccct

SEQ ID NO: 4889 - DNA, 20 bp, Artificial Sequence
  B2M targeting sequence
ttactgagcatgtacagact

SEQ ID NO: 4890 - DNA, 20 bp, Artificial Sequence
  B2M targeting sequence
ctttttttccccagtgtttt

SEQ ID NO: 4891 - DNA, 20 bp, Artificial Sequence
  B2M targeting sequence
ccagtgtttttgatccatgg

SEQ ID NO: 4892 - DNA, 20 bp, Artificial Sequence
  B2M targeting sequence
aaaacactggggaaaaaaag

SEQ ID NO: 4893 - DNA, 20 bp, Artificial Sequence
  B2M targeting sequence
atggtttgctgaatccacag

SEQ ID NO: 4894 - DNA, 20 bp, Artificial Sequence
  B2M targeting sequence
gcaaaccatggatcaaaaac

SEQ ID NO: 4895 - DNA, 20 bp, Artificial Sequence
  B2M targeting sequence
acagatgtggagcccctgga

SEQ ID NO: 4896 - DNA, 20 bp, Artificial Sequence
  B2M targeting sequence
gtggattcagcaaaccatgg

SEQ ID NO: 4897 - DNA, 20 bp, Artificial Sequence
  B2M targeting sequence
acatctgtggattcagcaaa

SEQ ID NO: 4898 - DNA, 20 bp, Artificial Sequence
  B2M targeting sequence
aggggctccacatctgtgga

SEQ ID NO: 4899 - DNA, 20 bp, Artificial Sequence
  B2M targeting sequence
gtatccaggggctccacatc

SEQ ID NO: 4900 - DNA, 20 bp, Artificial Sequence
  B2M targeting sequence
aagtacagcgggccttccgt

SEQ ID NO: 4901 - DNA, 20 bp, Artificial Sequence
  B2M targeting sequence
ttcaaagtacagcgggcctt

SEQ ID NO: 4902 - DNA, 20 bp, Artificial Sequence
  B2M targeting sequence
gttatttgtcattcaaagta

SEQ ID NO: 4903 - DNA, 20 bp, Artificial Sequence
  B2M targeting sequence
aggcatagttttatacctga

SEQ ID NO: 4904 - DNA, 20 bp, Artificial Sequence
  B2M targeting sequence
ggtataaaactatgccttga

SEQ ID NO: 4905 - DNA, 20 bp, Artificial Sequence
  B2M targeting sequence
aataaacaaagctggccatc

SEQ ID NO: 4906 - DNA, 20 bp, Artificial Sequence
  B2M targeting sequence
tggtcaaataaacaaagctg

SEQ ID NO: 4907 - DNA, 20 bp, Artificial Sequence
  B2M targeting sequence
gagttagctagttctaggta

SEQ ID NO: 4908 - DNA, 20 bp, Artificial Sequence
  B2M targeting sequence
gattcttggtcaaataaaca

SEQ ID NO: 4909 - DNA, 20 bp, Artificial Sequence
  B2M targeting sequence
aggtactgacaggataaata

SEQ ID NO: 4910 - DNA, 20 bp, Artificial Sequence
  B2M targeting sequence
gtacctagaactagctaact

SEQ ID NO: 4911 - DNA, 20 bp, Artificial Sequence
  B2M targeting sequence
tgtcagtacctagaactagc

SEQ ID NO: 4912 - DNA, 20 bp, Artificial Sequence
  B2M targeting sequence
cgatcttctcagtttagcag

SEQ ID NO: 4913 - DNA, 20 bp, Artificial Sequence
  B2M targeting sequence
ggagcagtgttgtgttttat

SEQ ID NO: 4914 - DNA, 20 bp, Artificial Sequence
  B2M targeting sequence
tctcagtttagcagagggac

SEQ ID NO: 4915 - DNA, 20 bp, Artificial Sequence
  B2M targeting sequence
cagtttagcagagggacaga

SEQ ID NO: 4916 - DNA, 20 bp, Artificial Sequence
  B2M targeting sequence
gtttagcagagggacagata

SEQ ID NO: 4917 - DNA, 20 bp, Artificial Sequence
  B2M targeting sequence
gctaaactgagaagatcggg

SEQ ID NO: 4918 - DNA, 20 bp, Artificial Sequence
  B2M targeting sequence
ctctgctaaactgagaagat

SEQ ID NO: 4919 - DNA, 20 bp, Artificial Sequence
  B2M targeting sequence
gtccctctgctaaactgaga

SEQ ID NO: 4920 - DNA, 20 bp, Artificial Sequence
  B2M targeting sequence
aataattaaaatatatcctg

SEQ ID NO: 4921 - DNA, 20 bp, Artificial Sequence
  B2M targeting sequence
tgataagaatatagcatagg

SEQ ID NO: 4922 - DNA, 20 bp, Artificial Sequence
  B2M targeting sequence
ggatatattttaattatttg

SEQ ID NO: 4923 - DNA, 20 bp, Artificial Sequence
  B2M targeting sequence
tatcaggatatattttaatt

SEQ ID NO: 4924 - DNA, 20 bp, Artificial Sequence
  B2M targeting sequence
cgcgtacctatgctatattc

SEQ ID NO: 4925 - DNA, 20 bp, Artificial Sequence
  B2M targeting sequence
tcgcgcgtacctatgctata

SEQ ID NO: 4926 - DNA, 20 bp, Artificial Sequence
  B2M targeting sequence
aaattttgttgttcaggctg

SEQ ID NO: 4927 - DNA, 20 bp, Artificial Sequence
  B2M targeting sequence
attgccaagttcttcgcgcg

SEQ ID NO: 4928 - DNA, 20 bp, Artificial Sequence
  B2M targeting sequence
ggctgggcgaggtgtctcat

SEQ ID NO: 4929 - DNA, 20 bp, Artificial Sequence
  B2M targeting sequence
cccagcctgaacaacaaaat

SEQ ID NO: 4930 - DNA, 20 bp, Artificial Sequence
  B2M targeting sequence
catgtctgtaatcccagcac

SEQ ID NO: 4931 - DNA, 20 bp, Artificial Sequence
  B2M targeting sequence
tgtctgtaatcccagcactt

SEQ ID NO: 4932 - DNA, 20 bp, Artificial Sequence
  B2M targeting sequence
gtaatcccagcactttggga

SEQ ID NO: 4933 - DNA, 20 bp, Artificial Sequence
  B2M targeting sequence
cagcactttgggaggccatg

SEQ ID NO: 4934 - DNA, 20 bp, Artificial Sequence
  B2M targeting sequence
caaagtgctgggattacaga

SEQ ID NO: 4935 - DNA, 20 bp, Artificial Sequence
  B2M targeting sequence
taccatggcctcccaaagtg

SEQ ID NO: 4936 - DNA, 20 bp, Artificial Sequence
  B2M targeting sequence
tcctaccatggcctcccaaa

SEQ ID NO: 4937 - DNA, 20 bp, Artificial Sequence
  B2M targeting sequence
cttgagcccaggagtccgag

SEQ ID NO: 4938 - DNA, 20 bp, Artificial Sequence
  B2M targeting sequence
agcgatcatcctaccatggc

SEQ ID NO: 4939 - DNA, 20 bp, Artificial Sequence
  B2M targeting sequence
tgggctcaagcgatcatcct

SEQ ID NO: 4940 - DNA, 20 bp, Artificial Sequence
  B2M targeting sequence
gagaccagcctgggcaacat

SEQ ID NO: 4941 - DNA, 20 bp, Artificial Sequence
  B2M targeting sequence
gactcctgggctcaagcgat

SEQ ID NO: 4942 - DNA, 20 bp, Artificial Sequence
  B2M targeting sequence
cggactcctgggctcaagcg

SEQ ID NO: 4943 - DNA, 20 bp, Artificial Sequence
  B2M targeting sequence
tgttatgttgcccaggctgg

SEQ ID NO: 4944 - DNA, 20 bp, Artificial Sequence
  B2M targeting sequence
caattcaaagaattgaatta

SEQ ID NO: 4945 - DNA, 20 bp, Artificial Sequence
  B2M targeting sequence
attcaaagaattgaattaaa

SEQ ID NO: 4946 - DNA, 20 bp, Artificial Sequence
  B2M targeting sequence
aagaattgaattaaaaaaaa

SEQ ID NO: 4947 - DNA, 20 bp, Artificial Sequence
  B2M targeting sequence
ttgaattgagacagggtctt

SEQ ID NO: 4948 - DNA, 20 bp, Artificial Sequence
  B2M targeting sequence
attctttgaattgagacagg

SEQ ID NO: 4949 - DNA, 20 bp, Artificial Sequence
  B2M targeting sequence
tttttaaaaaaattattttt

SEQ ID NO: 4950 - DNA, 20 bp, Artificial Sequence
  B2M targeting sequence
aggaacaacaacaaaaatct

SEQ ID NO: 4951 - DNA, 20 bp, Artificial Sequence
  B2M targeting sequence
ttgaacaacaacatttcttt

SEQ ID NO: 4952 - DNA, 20 bp, Artificial Sequence
  B2M targeting sequence
agggaggtgttagagaagcc

SEQ ID NO: 4953 - DNA, 20 bp, Artificial Sequence
  B2M targeting sequence
ctagatttttgttgttgttc

SEQ ID NO: 4954 - DNA, 20 bp, Artificial Sequence
  B2M targeting sequence
aacacctccctagatttttg

SEQ ID NO: 4955 - DNA, 20 bp, Artificial Sequence
  B2M targeting sequence
ctaacacctccctagatttt

SEQ ID NO: 4956 - DNA, 20 bp, Artificial Sequence
  B2M targeting sequence
ggcaaatggcttctctaaca

SEQ ID NO: 4957 - DNA, 20 bp, Artificial Sequence
  B2M targeting sequence
gctcaggcaaatggcttctc

SEQ ID NO: 4958 - DNA, 20 bp, Artificial Sequence
  B2M targeting sequence
cagctcaggcaaatggcttc

SEQ ID NO: 4959 - DNA, 20 bp, Artificial Sequence
  B2M targeting sequence
cttgattggtaggtggggcc

SEQ ID NO: 4960 - DNA, 20 bp, Artificial Sequence
  B2M targeting sequence
tgattggtaggtggggcctg

SEQ ID NO: 4961 - DNA, 20 bp, Artificial Sequence
  B2M targeting sequence
agagaaccactagcaactta

SEQ ID NO: 4962 - DNA, 20 bp, Artificial Sequence
  B2M targeting sequence
aggcatggtagccaggaagg

SEQ ID NO: 4963 - DNA, 20 bp, Artificial Sequence
  B2M targeting sequence
tggctaccatgcctggaaac

SEQ ID NO: 4964 - DNA, 20 bp, Artificial Sequence
  B2M targeting sequence
ttcctggctaccatgcctgg

SEQ ID NO: 4965 - DNA, 20 bp, Artificial Sequence
  B2M targeting sequence
aaacagtggaggaagggtgt

SEQ ID NO: 4966 - DNA, 20 bp, Artificial Sequence
  B2M targeting sequence
actgtttggaattacccaaa

SEQ ID NO: 4967 - DNA, 20 bp, Artificial Sequence
  B2M targeting sequence
tccactgtttggaattaccc

SEQ ID NO: 4968 - DNA, 20 bp, Artificial Sequence
  B2M targeting sequence
gggggaagacttgtaggaac

SEQ ID NO: 4969 - DNA, 20 bp, Artificial Sequence
  B2M targeting sequence
cccagacacccttcctccac

SEQ ID NO: 4970 - DNA, 20 bp, Artificial Sequence
  B2M targeting sequence
tcccccagacacccttcctc

SEQ ID NO: 4971 - DNA, 20 bp, Artificial Sequence
  B2M targeting sequence
tacaagtcttcccccagaca

SEQ ID NO: 4972 - DNA, 20 bp, Artificial Sequence
  B2M targeting sequence
gctgaaaaaattgggggatg

SEQ ID NO: 4973 - DNA, 20 bp, Artificial Sequence
  B2M targeting sequence
gctgagttcctacaagtctt

SEQ ID NO: 4974 - DNA, 20 bp, Artificial Sequence
  B2M targeting sequence
cccaattttttcagctgagt

SEQ ID NO: 4975 - DNA, 20 bp, Artificial Sequence
  B2M targeting sequence
tcccccaattttttcagctg

SEQ ID NO: 4976 - DNA, 20 bp, Artificial Sequence
  B2M targeting sequence
gaaagaaaaacaaagtttta

SEQ ID NO: 4977 - DNA, 20 bp, Artificial Sequence
  B2M targeting sequence
gagtatcatcccccaatttt

SEQ ID NO: 4978 - DNA, 20 bp, Artificial Sequence
  B2M targeting sequence
ttcagagtatcatcccccaa

SEQ ID NO: 4979 - DNA, 20 bp, Artificial Sequence
  B2M targeting sequence
actcttacacttaacacata

SEQ ID NO: 4980 - DNA, 20 bp, Artificial Sequence
  B2M targeting sequence
tacacttaacacataatgct

SEQ ID NO: 4981 - DNA, 20 bp, Artificial Sequence
  B2M targeting sequence
gtgaccggatatttaggggt

SEQ ID NO: 4982 - DNA, 20 bp, Artificial Sequence
  B2M targeting sequence
cagaagcattatgtgttaag

SEQ ID NO: 4983 - DNA, 20 bp, Artificial Sequence
  B2M targeting sequence
ggtcacagaagcattatgtg

SEQ ID NO: 4984 - DNA, 20 bp, Artificial Sequence
  B2M targeting sequence
ccccacactctgttaggaga

SEQ ID NO: 4985 - DNA, 20 bp, Artificial Sequence
  B2M targeting sequence
gttaggagaaaaattttaga

SEQ ID NO: 4986 - DNA, 20 bp, Artificial Sequence
  B2M targeting sequence
taacagagtgtggggggaaa

SEQ ID NO: 4987 - DNA, 20 bp, Artificial Sequence
  B2M targeting sequence
cctaacagagtgtgggggga

SEQ ID NO: 4988 - DNA, 20 bp, Artificial Sequence
  B2M targeting sequence
aaaatttttctcctaacaga

SEQ ID NO: 4989 - DNA, 20 bp, Artificial Sequence
  B2M targeting sequence
gtctaaaatttttctcctaa

SEQ ID NO: 4990 - DNA, 20 bp, Artificial Sequence
  B2M targeting sequence
gttaaatttaatctgtctaa

SEQ ID NO: 4991 - DNA, 20 bp, Artificial Sequence
  B2M targeting sequence
gttaaactctgttaaattta

SEQ ID NO: 4992 - DNA, 20 bp, Artificial Sequence
  B2M targeting sequence
tttttgctcagttaaactct

SEQ ID NO: 4993 - DNA, 20 bp, Artificial Sequence
  B2M targeting sequence
cgaaccaggcagctgccgga

SEQ ID NO: 4994 - DNA, 20 bp, Artificial Sequence
  B2M targeting sequence
aaccaggcagctgccggagc

SEQ ID NO: 4995 - DNA, 20 bp, Artificial Sequence
  B2M targeting sequence
agaatcatttttgctcagtt

SEQ ID NO: 4996 - DNA, 20 bp, Artificial Sequence
  B2M targeting sequence
ggcagctgcctggttcgaga

SEQ ID NO: 4997 - DNA, 20 bp, Artificial Sequence
  B2M targeting sequence
ggctccggcagctgcctggt

SEQ ID NO: 4998 - DNA, 20 bp, Artificial Sequence
  B2M targeting sequence
aaatgactctgggggtgcca

SEQ ID NO: 4999 - DNA, 20 bp, Artificial Sequence
  B2M targeting sequence
ttttgaacctattctggctc

SEQ ID NO: 5000 - DNA, 20 bp, Artificial Sequence
  B2M targeting sequence
gggggtgccacatggttgga

SEQ ID NO: 5001 - DNA, 20 bp, Artificial Sequence
  B2M targeting sequence
aaccatgtggcacccccaga

SEQ ID NO: 5002 - DNA, 20 bp, Artificial Sequence
  B2M targeting sequence
tccaaccatgtggcaccccc

SEQ ID NO: 5003 - DNA, 20 bp, Artificial Sequence
  B2M targeting sequence
ctaaatgtcatccaaccatg

SEQ ID NO: 5004 - DNA, 20 bp, Artificial Sequence
  B2M targeting sequence
gtccctaaatgtcatccaac

SEQ ID NO: 5005 - DNA, 20 bp, Artificial Sequence
  B2M targeting sequence
tttttctgtccctaaatgtc

SEQ ID NO: 5006 - DNA, 20 bp, Artificial Sequence
  B2M targeting sequence
ctttcctttttctgtcccta

SEQ ID NO: 5007 - DNA, 20 bp, Artificial Sequence
  B2M targeting sequence
gcacatcactttcctttttc

SEQ ID NO: 5008 - DNA, 20 bp, Artificial Sequence
  B2M targeting sequence
attttctgcacatcactttc

SEQ ID NO: 5009 - DNA, 20 bp, Artificial Sequence
  B2M targeting sequence
ggggcagaagcagccagatt

SEQ ID NO: 5010 - DNA, 20 bp, Artificial Sequence
  B2M targeting sequence
gcccctgacttccattttct

SEQ ID NO: 5011 - DNA, 20 bp, Artificial Sequence
  B2M targeting sequence
ggctgcttctgcccctgact

SEQ ID NO: 5012 - DNA, 20 bp, Artificial Sequence
  B2M targeting sequence
gcatttgcctcatttaaaca

SEQ ID NO: 5013 - DNA, 20 bp, Artificial Sequence
  B2M targeting sequence
tttaaacagggtttgaagag

SEQ ID NO: 5014 - DNA, 20 bp, Artificial Sequence
  B2M targeting sequence
aaccctgtttaaatgaggca

SEQ ID NO: 5015 - DNA, 20 bp, Artificial Sequence
  B2M targeting sequence
tcaaaccctgtttaaatgag

SEQ ID NO: 5016 - DNA, 20 bp, Artificial Sequence
  B2M targeting sequence
caggtggccaactcttcaaa

SEQ ID NO: 5017 - DNA, 20 bp, Artificial Sequence
  B2M targeting sequence
gccaatcacaggtggccaac

SEQ ID NO: 5018 - DNA, 20 bp, Artificial Sequence
  B2M targeting sequence
cagccaatcacaggtggcca

SEQ ID NO: 5019 - DNA, 20 bp, Artificial Sequence
  B2M targeting sequence
gtggtataagagtaagttac

SEQ ID NO: 5020 - DNA, 20 bp, Artificial Sequence
  B2M targeting sequence
tataccacagagtctcagcc

SEQ ID NO: 5021 - DNA, 20 bp, Artificial Sequence
  B2M targeting sequence
gtttacacatccagttaggt

SEQ ID NO: 5022 - DNA, 20 bp, Artificial Sequence
  B2M targeting sequence
agttaggttacagttcacta

SEQ ID NO: 5023 - DNA, 20 bp, Artificial Sequence
  B2M targeting sequence
ctatgcagagagaaatcttt

SEQ ID NO: 5024 - DNA, 20 bp, Artificial Sequence
  B2M targeting sequence
gcatagtgaactgtaaccta

SEQ ID NO: 5025 - DNA, 20 bp, Artificial Sequence
  B2M targeting sequence
ctgcatagtgaactgtaacc

SEQ ID NO: 5026 - DNA, 20 bp, Artificial Sequence
  B2M targeting sequence
ctctgcatagtgaactgtaa

SEQ ID NO: 5027 - DNA, 20 bp, Artificial Sequence
  B2M targeting sequence
ttagcctgaacttacacagg

SEQ ID NO: 5028 - DNA, 20 bp, Artificial Sequence
  B2M targeting sequence
ggctaaagatttctctctgc

SEQ ID NO: 5029 - DNA, 20 bp, Artificial Sequence
  B2M targeting sequence
ctgtgtaagttcaggctaaa

SEQ ID NO: 5030 - DNA, 20 bp, Artificial Sequence
  B2M targeting sequence
aaaaaaaaaaattaaataaa

SEQ ID NO: 5031 - DNA, 20 bp, Artificial Sequence
  B2M targeting sequence
caaaaaaaaaaaattaaata

SEQ ID NO: 5032 - DNA, 20 bp, Artificial Sequence
  B2M targeting sequence
cactctgtcacccgggctgg

SEQ ID NO: 5033 - DNA, 20 bp, Artificial Sequence
  B2M targeting sequence
ctctgtcacccgggctggag

SEQ ID NO: 5034 - DNA, 20 bp, Artificial Sequence
  B2M targeting sequence
gtcacccgggctggagttca

SEQ ID NO: 5035 - DNA, 20 bp, Artificial Sequence
  B2M targeting sequence
cccgggctggagttcagtgg

SEQ ID NO: 5036 - DNA, 20 bp, Artificial Sequence
  B2M targeting sequence
agcccgggtgacagagtgag

SEQ ID NO: 5037 - DNA, 20 bp, Artificial Sequence
  B2M targeting sequence
gtggtatgatcatggcttat

SEQ ID NO: 5038 - DNA, 20 bp, Artificial Sequence
  B2M targeting sequence
taccactgaactccagcccg

SEQ ID NO: 5039 - DNA, 20 bp, Artificial Sequence
  B2M targeting sequence
tggcttattgcagcctcgac

SEQ ID NO: 5040 - DNA, 20 bp, Artificial Sequence
  B2M targeting sequence
acttcctggcctcaagcaat

SEQ ID NO: 5041 - DNA, 20 bp, Artificial Sequence
  B2M targeting sequence
aggctgcaataagccatgat

SEQ ID NO: 5042 - DNA, 20 bp, Artificial Sequence
  B2M targeting sequence
tggcctcaagcaatccttcc

SEQ ID NO: 5043 - DNA, 20 bp, Artificial Sequence
  B2M targeting sequence
agcaatccttccgcctcagg

SEQ ID NO: 5044 - DNA, 20 bp, Artificial Sequence
  B2M targeting sequence
ttccgcctcaggctctagag

SEQ ID NO: 5045 - DNA, 20 bp, Artificial Sequence
  B2M targeting sequence
gcctcaggctctagagtagc

SEQ ID NO: 5046 - DNA, 20 bp, Artificial Sequence
  B2M targeting sequence
ggctctagagtagctgggac

SEQ ID NO: 5047 - DNA, 20 bp, Artificial Sequence
  B2M targeting sequence
agagtagctgggactacagg

SEQ ID NO: 5048 - DNA, 20 bp, Artificial Sequence
  B2M targeting sequence
agagcctgaggcggaaggat

SEQ ID NO: 5049 - DNA, 20 bp, Artificial Sequence
  B2M targeting sequence
cagctactctagagcctgag

SEQ ID NO: 5050 - DNA, 20 bp, Artificial Sequence
  B2M targeting sequence
gcatgcctggctaattttgt

SEQ ID NO: 5051 - DNA, 20 bp, Artificial Sequence
  B2M targeting sequence
actaaaaattaaaaaacaaa

SEQ ID NO: 5052 - DNA, 20 bp, Artificial Sequence
  B2M targeting sequence
ctactaaaaattaaaaaaca

SEQ ID NO: 5053 - DNA, 20 bp, Artificial Sequence
  B2M targeting sequence
tctctactaaaaattaaaaa

SEQ ID NO: 5054 - DNA, 20 bp, Artificial Sequence
  B2M targeting sequence
tggccttgcacaattctttc

SEQ ID NO: 5055 - DNA, 20 bp, Artificial Sequence
  B2M targeting sequence
ttcgcctcagcctccgaaaa

SEQ ID NO: 5056 - DNA, 20 bp, Artificial Sequence
  B2M targeting sequence
cctcagcctccgaaaatgct

SEQ ID NO: 5057 - DNA, 20 bp, Artificial Sequence
  B2M targeting sequence
gcctccgaaaatgctgggat

SEQ ID NO: 5058 - DNA, 20 bp, Artificial Sequence
  B2M targeting sequence
gaaaatgctgggattacagg

SEQ ID NO: 5059 - DNA, 20 bp, Artificial Sequence
  B2M targeting sequence
gaggctgaggcgaaagaatt

SEQ ID NO: 5060 - DNA, 20 bp, Artificial Sequence
  B2M targeting sequence
cagcattttcggaggctgag

SEQ ID NO: 5061 - DNA, 20 bp, Artificial Sequence
  B2M targeting sequence
cacctgtaatcccagcattt

SEQ ID NO: 5062 - DNA, 20 bp, Artificial Sequence
  B2M targeting sequence
aaaaaaggtttagcctaaag

SEQ ID NO: 5063 - DNA, 20 bp, Artificial Sequence
  B2M targeting sequence
caaaaaaaggtttagcctaa

SEQ ID NO: 5064 - DNA, 20 bp, Artificial Sequence
  B2M targeting sequence
gtctcaaaaaaaggtttagc

SEQ ID NO: 5065 - DNA, 20 bp, Artificial Sequence
  B2M targeting sequence
ctcttgttgtctaggctgga

SEQ ID NO: 5066 - DNA, 20 bp, Artificial Sequence
  B2M targeting sequence
cttgttgtctaggctggagt

SEQ ID NO: 5067 - DNA, 20 bp, Artificial Sequence
  B2M targeting sequence
tgttgtctaggctggagtgc

SEQ ID NO: 5068 - DNA, 20 bp, Artificial Sequence
  B2M targeting sequence
aggctggagtgcagttgcac

SEQ ID NO: 5069 - DNA, 20 bp, Artificial Sequence
  B2M targeting sequence
agcctagacaacaagagaga

SEQ ID NO: 5070 - DNA, 20 bp, Artificial Sequence
  B2M targeting sequence
tggctcactgcaacctccac

SEQ ID NO: 5071 - DNA, 20 bp, Artificial Sequence
  B2M targeting sequence
ctgcaacctccacctccagg

SEQ ID NO: 5072 - DNA, 20 bp, Artificial Sequence
  B2M targeting sequence
acctccagggttcaagtgat

SEQ ID NO: 5073 - DNA, 20 bp, Artificial Sequence
  B2M targeting sequence
agggttcaagtgattctcgt

SEQ ID NO: 5074 - DNA, 20 bp, Artificial Sequence
  B2M targeting sequence
agtgattctcgttcctcagc

SEQ ID NO: 5075 - DNA, 20 bp, Artificial Sequence
  B2M targeting sequence
cttgaaccctggaggtggag

SEQ ID NO: 5076 - DNA, 20 bp, Artificial Sequence
  B2M targeting sequence
cgttcctcagcctcccgagt

SEQ ID NO: 5077 - DNA, 20 bp, Artificial Sequence
  B2M targeting sequence
ttcctcagcctcccgagtaa

SEQ ID NO: 5078 - DNA, 20 bp, Artificial Sequence
  B2M targeting sequence
tcagcctcccgagtaactgg

SEQ ID NO: 5079 - DNA, 20 bp, Artificial Sequence
  B2M targeting sequence
gcctcccgagtaactgggat

SEQ ID NO: 5080 - DNA, 20 bp, Artificial Sequence
  B2M targeting sequence
cgagtaactgggattacagg

SEQ ID NO: 5081 - DNA, 20 bp, Artificial Sequence
  B2M targeting sequence
ggaggctgaggaacgagaat

SEQ ID NO: 5082 - DNA, 20 bp, Artificial Sequence
  B2M targeting sequence
cagttactcgggaggctgag

SEQ ID NO: 5083 - DNA, 20 bp, Artificial Sequence
  B2M targeting sequence
actaaaaacacaaaattagc

SEQ ID NO: 5084 - DNA, 20 bp, Artificial Sequence
  B2M targeting sequence
ctactaaaaacacaaaatta

SEQ ID NO: 5085 - DNA, 20 bp, Artificial Sequence
  B2M targeting sequence
ccatgttgtccaggctggtc

SEQ ID NO: 5086 - DNA, 20 bp, Artificial Sequence
  B2M targeting sequence
aggctggtctcaaactcctg

SEQ ID NO: 5087 - DNA, 20 bp, Artificial Sequence
  B2M targeting sequence
caaactcctggcctcaagtg

SEQ ID NO: 5088 - DNA, 20 bp, Artificial Sequence
  B2M targeting sequence
aactcctggcctcaagtgat

SEQ ID NO: 5089 - DNA, 20 bp, Artificial Sequence
  B2M targeting sequence
tggcctcaagtgatcctctg

SEQ ID NO: 5090 - DNA, 20 bp, Artificial Sequence
  B2M targeting sequence
agtgatcctctggcctcagc

SEQ ID NO: 5091 - DNA, 20 bp, Artificial Sequence
  B2M targeting sequence
cttgaggccaggagtttgag

SEQ ID NO: 5092 - DNA, 20 bp, Artificial Sequence
  B2M targeting sequence
tctggcctcagcttcccaga

SEQ ID NO: 5093 - DNA, 20 bp, Artificial Sequence
  B2M targeting sequence
ggcctcagcttcccagagta

SEQ ID NO: 5094 - DNA, 20 bp, Artificial Sequence
  B2M targeting sequence
gcttcccagagtactgagat

SEQ ID NO: 5095 - DNA, 20 bp, Artificial Sequence
  B2M targeting sequence
cagagtactgagattacagg

SEQ ID NO: 5096 - DNA, 20 bp, Artificial Sequence
  B2M targeting sequence
gggaagctgaggccagagga

SEQ ID NO: 5097 - DNA, 20 bp, Artificial Sequence
  B2M targeting sequence
gtactctgggaagctgaggc

SEQ ID NO: 5098 - DNA, 20 bp, Artificial Sequence
  B2M targeting sequence
cagtactctgggaagctgag

SEQ ID NO: 5099 - DNA, 20 bp, Artificial Sequence
  B2M targeting sequence
tgcctgtaatctcagtactc

SEQ ID NO: 5100 - DNA, 20 bp, Artificial Sequence
  B2M targeting sequence
ccagcagacaccaactgggt

SEQ ID NO: 5101 - DNA, 20 bp, Artificial Sequence
  B2M targeting sequence
agcagacaccaactgggtat

SEQ ID NO: 5102 - DNA, 20 bp, Artificial Sequence
  B2M targeting sequence
gctggagattgtttggtgtt

SEQ ID NO: 5103 - DNA, 20 bp, Artificial Sequence
  B2M targeting sequence
cataattcaattcgattttg

SEQ ID NO: 5104 - DNA, 20 bp, Artificial Sequence
  B2M targeting sequence
attcgattttgattggatct

SEQ ID NO: 5105 - DNA, 20 bp, Artificial Sequence
  B2M targeting sequence
attttgattggatctacctg

SEQ ID NO: 5106 - DNA, 20 bp, Artificial Sequence
  B2M targeting sequence
aattgaattatgggataccc

SEQ ID NO: 5107 - DNA, 20 bp, Artificial Sequence
  B2M targeting sequence
aaatcgaattgaattatggg

SEQ ID NO: 5108 - DNA, 20 bp, Artificial Sequence
  B2M targeting sequence
aatcaaaatcgaattgaatt

SEQ ID NO: 5109 - DNA, 20 bp, Artificial Sequence
  B2M targeting sequence
acctggagatggtgtcagat

SEQ ID NO: 5110 - DNA, 20 bp, Artificial Sequence
  B2M targeting sequence
aggtagatccaatcaaaatc

SEQ ID NO: 5111 - DNA, 20 bp, Artificial Sequence
  B2M targeting sequence
ccaggtagatccaatcaaaa

SEQ ID NO: 5112 - DNA, 20 bp, Artificial Sequence
  B2M targeting sequence
gatcccgctggttgagggtt

SEQ ID NO: 5113 - DNA, 20 bp, Artificial Sequence
  B2M targeting sequence
gacaccatctccaggtagat

SEQ ID NO: 5114 - DNA, 20 bp, Artificial Sequence
  B2M targeting sequence
cgctggttgagggttcagtc

SEQ ID NO: 5115 - DNA, 20 bp, Artificial Sequence
  B2M targeting sequence
accagcgggatctgacacca

SEQ ID NO: 5116 - DNA, 20 bp, Artificial Sequence
  B2M targeting sequence
gtcccacaagactgccctcc

SEQ ID NO: 5117 - DNA, 20 bp, Artificial Sequence
  B2M targeting sequence
cacaagactgccctccactt

SEQ ID NO: 5118 - DNA, 20 bp, Artificial Sequence
  B2M targeting sequence
tgtgggactgaaccctcaac

SEQ ID NO: 5119 - DNA, 20 bp, Artificial Sequence
  B2M targeting sequence
acttcagatgccaatcacac

SEQ ID NO: 5120 - DNA, 20 bp, Artificial Sequence
  B2M targeting sequence
gatgccaatcacacattgta

SEQ ID NO: 5121 - DNA, 20 bp, Artificial Sequence
  B2M targeting sequence
gaagtggagggcagtcttgt

SEQ ID NO: 5122 - DNA, 20 bp, Artificial Sequence
  B2M targeting sequence
cacattgtaggttgttacct

SEQ ID NO: 5123 - DNA, 20 bp, Artificial Sequence
  B2M targeting sequence
acttctgactgaccagctgg

SEQ ID NO: 5124 - DNA, 20 bp, Artificial Sequence
  B2M targeting sequence
gactgaccagctggaaacca

SEQ ID NO: 5125 - DNA, 20 bp, Artificial Sequence
  B2M targeting sequence
gaagtagaggtaacaaccta

SEQ ID NO: 5126 - DNA, 20 bp, Artificial Sequence
  B2M targeting sequence
gtcagaagtagaggtaacaa

SEQ ID NO: 5127 - DNA, 20 bp, Artificial Sequence
  B2M targeting sequence
agctggtcagtcagaagtag

SEQ ID NO: 5128 - DNA, 20 bp, Artificial Sequence
  B2M targeting sequence
ggtttccagctggtcagtca

SEQ ID NO: 5129 - DNA, 20 bp, Artificial Sequence
  B2M targeting sequence
catgactgcctccttgactt

SEQ ID NO: 5130 - DNA, 20 bp, Artificial Sequence
  B2M targeting sequence
tgggagttctggtttccagc

SEQ ID NO: 5131 - DNA, 20 bp, Artificial Sequence
  B2M targeting sequence
ttgactttggttaatttgct

SEQ ID NO: 5132 - DNA, 20 bp, Artificial Sequence
  B2M targeting sequence
aggaggcagtcatgggagtt

SEQ ID NO: 5133 - DNA, 20 bp, Artificial Sequence
  B2M targeting sequence
tagcaaattaaccaaagtca

SEQ ID NO: 5134 - DNA, 20 bp, Artificial Sequence
  B2M targeting sequence
tatttaccaatctattataa

SEQ ID NO: 5135 - DNA, 20 bp, Artificial Sequence
  B2M targeting sequence
attataaaagattaaaggct

SEQ ID NO: 5136 - DNA, 20 bp, Artificial Sequence
  B2M targeting sequence
tttataatagattggtaaat

SEQ ID NO: 5137 - DNA, 20 bp, Artificial Sequence
  B2M targeting sequence
gtagcctttaatcttttata

SEQ ID NO: 5138 - DNA, 20 bp, Artificial Sequence
  B2M targeting sequence
tctgtagcctttaatctttt

SEQ ID NO: 5139 - DNA, 20 bp, Artificial Sequence
  B2M targeting sequence
agttattcgtctgtagcctt

SEQ ID NO: 5140 - DNA, 20 bp, Artificial Sequence
  B2M targeting sequence
tctagttattcgtctgtagc

SEQ ID NO: 5141 - DNA, 20 bp, Artificial Sequence
  B2M targeting sequence
tttcatctagttattcgtct

SEQ ID NO: 5142 - DNA, 20 bp, Artificial Sequence
  B2M targeting sequence
tcttttcatctagttattcg

SEQ ID NO: 5143 - DNA, 20 bp, Artificial Sequence
  B2M targeting sequence
ccaccacaaccccctacata

SEQ ID NO: 5144 - DNA, 20 bp, Artificial Sequence
  B2M targeting sequence
atgccctctccaggtgtatg

SEQ ID NO: 5145 - DNA, 20 bp, Artificial Sequence
  B2M targeting sequence
ccaggtgtatgccaccctcc

SEQ ID NO: 5146 - DNA, 20 bp, Artificial Sequence
  B2M targeting sequence
aggtgtatgccaccctccca

SEQ ID NO: 5147 - DNA, 20 bp, Artificial Sequence
  B2M targeting sequence
cagcacctccacacattcag

SEQ ID NO: 5148 - DNA, 20 bp, Artificial Sequence
  B2M targeting sequence
acacattcagcaaacaggaa

SEQ ID NO: 5149 - DNA, 20 bp, Artificial Sequence
  B2M targeting sequence
gcaaacaggaagctcatcgt

SEQ ID NO: 5150 - DNA, 20 bp, Artificial Sequence
  B2M targeting sequence
tgtttgctgaatgtgtggag

SEQ ID NO: 5151 - DNA, 20 bp, Artificial Sequence
  B2M targeting sequence
tcgttcaagagtttttatag

SEQ ID NO: 5152 - DNA, 20 bp, Artificial Sequence
  B2M targeting sequence
ttcaagagtttttatagagc

SEQ ID NO: 5153 - DNA, 20 bp, Artificial Sequence
  B2M targeting sequence
agagtttttatagagcttga

SEQ ID NO: 5154 - DNA, 20 bp, Artificial Sequence
  B2M targeting sequence
tgaacgatgagcttcctgtt

SEQ ID NO: 5155 - DNA, 20 bp, Artificial Sequence
  B2M targeting sequence
ataaaaactcttgaacgatg

SEQ ID NO: 5156 - DNA, 20 bp, Artificial Sequence
  B2M targeting sequence
agctctataaaaactcttga

SEQ ID NO: 5157 - DNA, 20 bp, Artificial Sequence
  B2M targeting sequence
ccagctccccttcaccttcc

SEQ ID NO: 5158 - DNA, 20 bp, Artificial Sequence
  B2M targeting sequence
agctccccttcaccttccca

SEQ ID NO: 5159 - DNA, 20 bp, Artificial Sequence
  B2M targeting sequence
ccttcaccttcccagaggtg

SEQ ID NO: 5160 - DNA, 20 bp, Artificial Sequence
  B2M targeting sequence
ccttcccagaggtggatggg

SEQ ID NO: 5161 - DNA, 20 bp, Artificial Sequence
  B2M targeting sequence
cagaggtggatgggtggggg

SEQ ID NO: 5162 - DNA, 20 bp, Artificial Sequence
  B2M targeting sequence
gggaaggtgaaggggagctg

SEQ ID NO: 5163 - DNA, 20 bp, Artificial Sequence
  B2M targeting sequence
acctctgggaaggtgaaggg

SEQ ID NO: 5164 - DNA, 20 bp, Artificial Sequence
  B2M targeting sequence
acccccacccatccacctct

SEQ ID NO: 5165 - DNA, 20 bp, Artificial Sequence
  B2M targeting sequence
aacacactaatcttctcatc

SEQ ID NO: 5166 - DNA, 20 bp, Artificial Sequence
  B2M targeting sequence
tctcatcacttggtctttct

SEQ ID NO: 5167 - DNA, 20 bp, Artificial Sequence
  B2M targeting sequence
catcacttggtctttctggt

SEQ ID NO: 5168 - DNA, 20 bp, Artificial Sequence
  B2M targeting sequence
tcacttggtctttctggtga

SEQ ID NO: 5169 - DNA, 20 bp, Artificial Sequence
  B2M targeting sequence
cttggtctttctggtgacta

SEQ ID NO: 5170 - DNA, 20 bp, Artificial Sequence
  B2M targeting sequence
ttctggtgactagcaccatc

SEQ ID NO: 5171 - DNA, 20 bp, Artificial Sequence
  B2M targeting sequence
ggtgactagcaccatcctga

SEQ ID NO: 5172 - DNA, 20 bp, Artificial Sequence
  B2M targeting sequence
ccagaaagaccaagtgatga

SEQ ID NO: 5173 - DNA, 20 bp, Artificial Sequence
  B2M targeting sequence
tgaggctatctaggggccca

SEQ ID NO: 5174 - DNA, 20 bp, Artificial Sequence
  B2M targeting sequence
ggatggtgctagtcaccaga

SEQ ID NO: 5175 - DNA, 20 bp, Artificial Sequence
  B2M targeting sequence
aggggcccaaacctatgagt

SEQ ID NO: 5176 - DNA, 20 bp, Artificial Sequence
  B2M targeting sequence
taggtttgggcccctagata

SEQ ID NO: 5177 - DNA, 20 bp, Artificial Sequence
  B2M targeting sequence
ttagcatatactcaagggtt

SEQ ID NO: 5178 - DNA, 20 bp, Artificial Sequence
  B2M targeting sequence
agggttaccaaagaggctta

SEQ ID NO: 5179 - DNA, 20 bp, Artificial Sequence
  B2M targeting sequence
ttggtaacccttgagtatat

SEQ ID NO: 5180 - DNA, 20 bp, Artificial Sequence
  B2M targeting sequence
tttattattaataataagcc

SEQ ID NO: 5181 - DNA, 20 bp, Artificial Sequence
  B2M targeting sequence
tatcactcaaaattcaaagg

SEQ ID NO: 5182 - DNA, 20 bp, Artificial Sequence
  B2M targeting sequence
ctcaaaattcaaaggatttt

SEQ ID NO: 5183 - DNA, 20 bp, Artificial Sequence
  B2M targeting sequence
aaattcaaaggattttagga

SEQ ID NO: 5184 - DNA, 20 bp, Artificial Sequence
  B2M targeting sequence
aaggattttaggaacttctg

SEQ ID NO: 5185 - DNA, 20 bp, Artificial Sequence
  B2M targeting sequence
tttgaattttgagtgatagg

SEQ ID NO: 5186 - DNA, 20 bp, Artificial Sequence
  B2M targeting sequence
taaaatcctttgaattttga

SEQ ID NO: 5187 - DNA, 20 bp, Artificial Sequence
  B2M targeting sequence
gacaggaactggggacaaag

SEQ ID NO: 5188 - DNA, 20 bp, Artificial Sequence
  B2M targeting sequence
gaagttcctaaaatcctttg

SEQ ID NO: 5189 - DNA, 20 bp, Artificial Sequence
  B2M targeting sequence
tgtcagaagttcctaaaatc

SEQ ID NO: 5190 - DNA, 20 bp, Artificial Sequence
  B2M targeting sequence
ccagttcctgtcagaagttc

SEQ ID NO: 5191 - DNA, 20 bp, Artificial Sequence
  B2M targeting sequence
ttgtccccagttcctgtcag

SEQ ID NO: 5192 - DNA, 20 bp, Artificial Sequence
  B2M targeting sequence
tattataccacacttaccta

SEQ ID NO: 5193 - DNA, 20 bp, Artificial Sequence
  B2M targeting sequence
ttaactcttcacctggctgc

SEQ ID NO: 5194 - DNA, 20 bp, Artificial Sequence
  B2M targeting sequence
tcacctggctgcaaactaaa

SEQ ID NO: 5195 - DNA, 20 bp, Artificial Sequence
  B2M targeting sequence
cctggctgcaaactaaaatt

SEQ ID NO: 5196 - DNA, 20 bp, Artificial Sequence
  B2M targeting sequence
acatgtaattttagtttgca

SEQ ID NO: 5197 - DNA, 20 bp, Artificial Sequence
  B2M targeting sequence
tacaaactctacatgtaatt

SEQ ID NO: 5198 - DNA, 20 bp, Artificial Sequence
  B2M targeting sequence
gtgtgtgtgtttgttttgtt

SEQ ID NO: 5199 - DNA, 20 bp, Artificial Sequence
  B2M targeting sequence
cgcctgtaagcccaacactt

SEQ ID NO: 5200 - DNA, 20 bp, Artificial Sequence
  B2M targeting sequence
aaagtgttgggcttacaggc

SEQ ID NO: 5201 - DNA, 20 bp, Artificial Sequence
  B2M targeting sequence
aggtgagcagattacgagga

SEQ ID NO: 5202 - DNA, 20 bp, Artificial Sequence
  B2M targeting sequence
ccttgactttccaaagtgtt

SEQ ID NO: 5203 - DNA, 20 bp, Artificial Sequence
  B2M targeting sequence
gctcaccttgactttccaaa

SEQ ID NO: 5204 - DNA, 20 bp, Artificial Sequence
  B2M targeting sequence
taatctgctcaccttgactt

SEQ ID NO: 5205 - DNA, 20 bp, Artificial Sequence
  B2M targeting sequence
tcgtaatctgctcaccttga

SEQ ID NO: 5206 - DNA, 20 bp, Artificial Sequence
  B2M targeting sequence
agaccagcctggctaacatg

SEQ ID NO: 5207 - DNA, 20 bp, Artificial Sequence
  B2M targeting sequence
tgaactcctcgtaatctgct

SEQ ID NO: 5208 - DNA, 20 bp, Artificial Sequence
  B2M targeting sequence
ccatgttagccaggctggtc

SEQ ID NO: 5209 - DNA, 20 bp, Artificial Sequence
  B2M targeting sequence
ctactaagaatacaaaaatt

SEQ ID NO: 5210 - DNA, 20 bp, Artificial Sequence
  B2M targeting sequence
actaagaatacaaaaattag

SEQ ID NO: 5211 - DNA, 20 bp, Artificial Sequence
  B2M targeting sequence
tagtagagacagggtttcac

SEQ ID NO: 5212 - DNA, 20 bp, Artificial Sequence
  B2M targeting sequence
cagctactcaggaggctgag

SEQ ID NO: 5213 - DNA, 20 bp, Artificial Sequence
  B2M targeting sequence
ggaggctgaggcaagagaat

SEQ ID NO: 5214 - DNA, 20 bp, Artificial Sequence
  B2M targeting sequence
tgagtagctgggattatagg

SEQ ID NO: 5215 - DNA, 20 bp, Artificial Sequence
  B2M targeting sequence
gcctcctgagtagctgggat

SEQ ID NO: 5216 - DNA, 20 bp, Artificial Sequence
  B2M targeting sequence
tgcctcagcctcctgagtag

SEQ ID NO: 5217 - DNA, 20 bp, Artificial Sequence
  B2M targeting sequence
cttgcctcagcctcctgagt

SEQ ID NO: 5218 - DNA, 20 bp, Artificial Sequence
  B2M targeting sequence
cttgaacctcggaggcagag

SEQ ID NO: 5219 - DNA, 20 bp, Artificial Sequence
  B2M targeting sequence
agcgattctcttgcctcagc

SEQ ID NO: 5220 - DNA, 20 bp, Artificial Sequence
  B2M targeting sequence
gaggcagaggttgcagtgag

SEQ ID NO: 5221 - DNA, 20 bp, Artificial Sequence
  B2M targeting sequence
gaggttcaagcgattctctt

SEQ ID NO: 5222 - DNA, 20 bp, Artificial Sequence
  B2M targeting sequence
gcctccgaggttcaagcgat

SEQ ID NO: 5223 - DNA, 20 bp, Artificial Sequence
  B2M targeting sequence
ctgcaacctctgcctccgag

SEQ ID NO: 5224 - DNA, 20 bp, Artificial Sequence
  B2M targeting sequence
gctcactgcaacctctgcct

SEQ ID NO: 5225 - DNA, 20 bp, Artificial Sequence
  B2M targeting sequence
cggctcactgcaacctctgc

SEQ ID NO: 5226 - DNA, 20 bp, Artificial Sequence
  B2M targeting sequence
tgccattgcactccagcctg

SEQ ID NO: 5227 - DNA, 20 bp, Artificial Sequence
  B2M targeting sequence
agcctgagtgacagagtgag

SEQ ID NO: 5228 - DNA, 20 bp, Artificial Sequence
  B2M targeting sequence
ggctggagtgcaatggcatg

SEQ ID NO: 5229 - DNA, 20 bp, Artificial Sequence
  B2M targeting sequence
ctcaggctggagtgcaatgg

SEQ ID NO: 5230 - DNA, 20 bp, Artificial Sequence
  B2M targeting sequence
gtcactcaggctggagtgca

SEQ ID NO: 5231 - DNA, 20 bp, Artificial Sequence
  B2M targeting sequence
ctctgtcactcaggctggag

SEQ ID NO: 5232 - DNA, 20 bp, Artificial Sequence
  B2M targeting sequence
cactctgtcactcaggctgg

SEQ ID NO: 5233 - DNA, 20 bp, Artificial Sequence
  B2M targeting sequence
atctcaaaaacagcaacaac

SEQ ID NO: 5234 - DNA, 20 bp, Artificial Sequence
  B2M targeting sequence
caaaaacagcaacaacaaca

SEQ ID NO: 5235 - DNA, 20 bp, Artificial Sequence
  B2M targeting sequence
aaaacagcaacaacaacaac

SEQ ID NO: 5236 - DNA, 20 bp, Artificial Sequence
  B2M targeting sequence
ccagcttcccagactcccat

SEQ ID NO: 5237 - DNA, 20 bp, Artificial Sequence
  B2M targeting sequence
cagactcccatccaggccaa

SEQ ID NO: 5238 - DNA, 20 bp, Artificial Sequence
  B2M targeting sequence
gggaagctggtgagttgttg

SEQ ID NO: 5239 - DNA, 20 bp, Artificial Sequence
  B2M targeting sequence
catccaggccaattaaacca

SEQ ID NO: 5240 - DNA, 20 bp, Artificial Sequence
  B2M targeting sequence
aggccaattaaaccataatc

SEQ ID NO: 5241 - DNA, 20 bp, Artificial Sequence
  B2M targeting sequence
ctcggtatggagcccaggta

SEQ ID NO: 5242 - DNA, 20 bp, Artificial Sequence
  B2M targeting sequence
cggtatggagcccaggtata

SEQ ID NO: 5243 - DNA, 20 bp, Artificial Sequence
  B2M targeting sequence
gtatggagcccaggtatagt

SEQ ID NO: 5244 - DNA, 20 bp, Artificial Sequence
  B2M targeting sequence
ataccgagagattatggttt

SEQ ID NO: 5245 - DNA, 20 bp, Artificial Sequence
  B2M targeting sequence
agatagttttaatgtacatc

SEQ ID NO: 5246 - DNA, 20 bp, Artificial Sequence
  B2M targeting sequence
agaggttttttaaaaaataa

SEQ ID NO: 5247 - DNA, 20 bp, Artificial Sequence
  B2M targeting sequence
aagattgacagacccattga

SEQ ID NO: 5248 - DNA, 20 bp, Artificial Sequence
  B2M targeting sequence
tggatgtacattaaaactat

SEQ ID NO: 5249 - DNA, 20 bp, Artificial Sequence
  B2M targeting sequence
atcttggatgtacattaaaa

SEQ ID NO: 5250 - DNA, 20 bp, Artificial Sequence
  B2M targeting sequence
gtcaatcttggatgtacatt

SEQ ID NO: 5251 - DNA, 20 bp, Artificial Sequence
  B2M targeting sequence
atgggtctgtcaatcttgga

SEQ ID NO: 5252 - DNA, 20 bp, Artificial Sequence
  B2M targeting sequence
gtcataaagaactctctctc

SEQ ID NO: 5253 - DNA, 20 bp, Artificial Sequence
  B2M targeting sequence
taaagaactctctctccatt

SEQ ID NO: 5254 - DNA, 20 bp, Artificial Sequence
  B2M targeting sequence
ttatgactgaactcaatggg

SEQ ID NO: 5255 - DNA, 20 bp, Artificial Sequence
  B2M targeting sequence
ctctccattccatatcattc

SEQ ID NO: 5256 - DNA, 20 bp, Artificial Sequence
  B2M targeting sequence
ctccattccatatcattcaa

SEQ ID NO: 5257 - DNA, 20 bp, Artificial Sequence
  B2M targeting sequence
ccattccatatcattcaaca

SEQ ID NO: 5258 - DNA, 20 bp, Artificial Sequence
  B2M targeting sequence
attccatatcattcaacaga

SEQ ID NO: 5259 - DNA, 20 bp, Artificial Sequence
  B2M targeting sequence
atatcattcaacagagctat

SEQ ID NO: 5260 - DNA, 20 bp, Artificial Sequence
  B2M targeting sequence
ttcaacagagctattttgtg

SEQ ID NO: 5261 - DNA, 20 bp, Artificial Sequence
  B2M targeting sequence
acagagctattttgtgaggg

SEQ ID NO: 5262 - DNA, 20 bp, Artificial Sequence
  B2M targeting sequence
gttgaatgatatggaatgga

SEQ ID NO: 5263 - DNA, 20 bp, Artificial Sequence
  B2M targeting sequence
caaaatagctctgttgaatg

SEQ ID NO: 5264 - DNA, 20 bp, Artificial Sequence
  B2M targeting sequence
gctggctgatattacaaggt

SEQ ID NO: 5265 - DNA, 20 bp, Artificial Sequence
  B2M targeting sequence
gccagcagagcagcccctca

SEQ ID NO: 5266 - DNA, 20 bp, Artificial Sequence
  B2M targeting sequence
aagtcaaatgaaatatagag

SEQ ID NO: 5267 - DNA, 20 bp, Artificial Sequence
  B2M targeting sequence
aatgaaatatagagttgaat

SEQ ID NO: 5268 - DNA, 20 bp, Artificial Sequence
  B2M targeting sequence
tttgactttgacatagtatt

SEQ ID NO: 5269 - DNA, 20 bp, Artificial Sequence
  B2M targeting sequence
atatttcatttgactttgac

SEQ ID NO: 5270 - DNA, 20 bp, Artificial Sequence
  B2M targeting sequence
actctatatttcatttgact

SEQ ID NO: 5271 - DNA, 20 bp, Artificial Sequence
  B2M targeting sequence
ctgaaattaaaatgttttat

SEQ ID NO: 5272 - DNA, 20 bp, Artificial Sequence
  B2M targeting sequence
gaaattaaaatgttttattt

SEQ ID NO: 5273 - DNA, 20 bp, Artificial Sequence
  B2M targeting sequence
gagattcaactctatatttc

SEQ ID NO: 5274 - DNA, 20 bp, Artificial Sequence
  B2M targeting sequence
caaataaaacattttaattt

SEQ ID NO: 5275 - DNA, 20 bp, Artificial Sequence
  B2M targeting sequence
tcccaaataaaacattttaa

SEQ ID NO: 5276 - DNA, 20 bp, Artificial Sequence
  B2M targeting sequence
ttcctcccaaataaaacatt

SEQ ID NO: 5277 - DNA, 20 bp, Artificial Sequence
  B2M targeting sequence
gggcatacacacagaccagc

SEQ ID NO: 5278 - DNA, 20 bp, Artificial Sequence
  B2M targeting sequence
gtgtgtatgccctgagttgc

SEQ ID NO: 5279 - DNA, 20 bp, Artificial Sequence
  B2M targeting sequence
ttggcatgtctgaagtacaa

SEQ ID NO: 5280 - DNA, 20 bp, Artificial Sequence
  B2M targeting sequence
gaagtacaaaaaggttttat

SEQ ID NO: 5281 - DNA, 20 bp, Artificial Sequence
  B2M targeting sequence
gacatgccaaagaccagctg

SEQ ID NO: 5282 - DNA, 20 bp, Artificial Sequence
  B2M targeting sequence
cattttataaaacctttttg

SEQ ID NO: 5283 - DNA, 20 bp, Artificial Sequence
  B2M targeting sequence
ctctgagaaaatttcactgg

SEQ ID NO: 5284 - DNA, 20 bp, Artificial Sequence
  B2M targeting sequence
gagaaaatttcactggtgct

SEQ ID NO: 5285 - DNA, 20 bp, Artificial Sequence
  B2M targeting sequence
gagcgataagtaacattttc

SEQ ID NO: 5286 - DNA, 20 bp, Artificial Sequence
  B2M targeting sequence
cagagcgataagtaacattt

SEQ ID NO: 5287 - DNA, 20 bp, Artificial Sequence
  B2M targeting sequence
ctggtgctagtaaagttttg

SEQ ID NO: 5288 - DNA, 20 bp, Artificial Sequence
  B2M targeting sequence
aaactttactagcaccagtg

SEQ ID NO: 5289 - DNA, 20 bp, Artificial Sequence
  B2M targeting sequence
tcaaaactttactagcacca

SEQ ID NO: 5290 - DNA, 20 bp, Artificial Sequence
  B2M targeting sequence
aaacttgccagctcctcaaa

SEQ ID NO: 5291 - DNA, 20 bp, Artificial Sequence
  B2M targeting sequence
tttgccaatcaaaacttgcc

SEQ ID NO: 5292 - DNA, 20 bp, Artificial Sequence
  B2M targeting sequence
tcatttgccaatcaaaactt

SEQ ID NO: 5293 - DNA, 20 bp, Artificial Sequence
  B2M targeting sequence
gtttattgtcatcatttgcc

SEQ ID NO: 5294 - DNA, 20 bp, Artificial Sequence
  B2M targeting sequence
cagagttgtagcaggtcatt

SEQ ID NO: 5295 - DNA, 20 bp, Artificial Sequence
  B2M targeting sequence
gagttgtagcaggtcatttc

SEQ ID NO: 5296 - DNA, 20 bp, Artificial Sequence
  B2M targeting sequence
gagactagttctgtttattg

SEQ ID NO: 5297 - DNA, 20 bp, Artificial Sequence
  B2M targeting sequence
tttcagtagccattagttaa

SEQ ID NO: 5298 - DNA, 20 bp, Artificial Sequence
  B2M targeting sequence
gtagccattagttaaacctg

SEQ ID NO: 5299 - DNA, 20 bp, Artificial Sequence
  B2M targeting sequence
gatgatagcaggcagtttca

SEQ ID NO: 5300 - DNA, 20 bp, Artificial Sequence
  B2M targeting sequence
gaaaccaggtttaactaatg

SEQ ID NO: 5301 - DNA, 20 bp, Artificial Sequence
  B2M targeting sequence
tctgaaaccaggtttaacta

SEQ ID NO: 5302 - DNA, 20 bp, Artificial Sequence
  B2M targeting sequence
gcttccaggcttgcagaaaa

SEQ ID NO: 5303 - DNA, 20 bp, Artificial Sequence
  B2M targeting sequence
aggcttgcagaaaatcgcat

SEQ ID NO: 5304 - DNA, 20 bp, Artificial Sequence
  B2M targeting sequence
gcaagcctggaagctgaaac

SEQ ID NO: 5305 - DNA, 20 bp, Artificial Sequence
  B2M targeting sequence
catttttggaacaatgtttt

SEQ ID NO: 5306 - DNA, 20 bp, Artificial Sequence
  B2M targeting sequence
aaaaatgcgattttctgcaa

SEQ ID NO: 5307 - DNA, 20 bp, Artificial Sequence
  B2M targeting sequence
gggcacaaaacattgttcca

SEQ ID NO: 5308 - DNA, 20 bp, Artificial Sequence
  B2M targeting sequence
ccctggcttcttgactctgt

SEQ ID NO: 5309 - DNA, 20 bp, Artificial Sequence
  B2M targeting sequence
ctggcttcttgactctgttt

SEQ ID NO: 5310 - DNA, 20 bp, Artificial Sequence
  B2M targeting sequence
tgactctgttttagttgagt

SEQ ID NO: 5311 - DNA, 20 bp, Artificial Sequence
  B2M targeting sequence
agaagccagggagaagcact

SEQ ID NO: 5312 - DNA, 20 bp, Artificial Sequence
  B2M targeting sequence
gttttagttgagtaagacaa

SEQ ID NO: 5313 - DNA, 20 bp, Artificial Sequence
  B2M targeting sequence
actaaaacagagtcaagaag

SEQ ID NO: 5314 - DNA, 20 bp, Artificial Sequence
  B2M targeting sequence
tactcaactaaaacagagtc

SEQ ID NO: 5315 - DNA, 20 bp, Artificial Sequence
  B2M targeting sequence
tttttgtcttactcaactaa

SEQ ID NO: 5316 - DNA, 20 bp, Artificial Sequence
  B2M targeting sequence
aactgggtcatttttgtctt

SEQ ID NO: 5317 - DNA, 20 bp, Artificial Sequence
  B2M targeting sequence
tcaaactgggtcatttttgt

SEQ ID NO: 5318 - DNA, 20 bp, Artificial Sequence
  B2M targeting sequence
cagttcctttggagcatgcc

SEQ ID NO: 5319 - DNA, 20 bp, Artificial Sequence
  B2M targeting sequence
tttggagcatgccttagttt

SEQ ID NO: 5320 - DNA, 20 bp, Artificial Sequence
  B2M targeting sequence
aaaggaactgtgaaagttgg

SEQ ID NO: 5321 - DNA, 20 bp, Artificial Sequence
  B2M targeting sequence
ctttttagaagagagcaagc

SEQ ID NO: 5322 - DNA, 20 bp, Artificial Sequence
  B2M targeting sequence
ttttagaagagagcaagcaa

SEQ ID NO: 5323 - DNA, 20 bp, Artificial Sequence
  B2M targeting sequence
aaaaagagaaactaaggcat

SEQ ID NO: 5324 - DNA, 20 bp, Artificial Sequence
  B2M targeting sequence
tctaaaaagagaaactaagg

SEQ ID NO: 5325 - DNA, 20 bp, Artificial Sequence
  B2M targeting sequence
cttctaaaaagagaaactaa

SEQ ID NO: 5326 - DNA, 20 bp, Artificial Sequence
  B2M targeting sequence
ttgcttgctctcttctaaaa

SEQ ID NO: 5327 - DNA, 20 bp, Artificial Sequence
  B2M targeting sequence
tctttgcttgctctcttcta

SEQ ID NO: 5328 - DNA, 20 bp, Artificial Sequence
  B2M targeting sequence
tcctctttgcttgctctctt

SEQ ID NO: 5329 - DNA, 20 bp, Artificial Sequence
  B2M targeting sequence
tgtattcctcctctttgctt

SEQ ID NO: 5330 - DNA, 20 bp, Artificial Sequence
  B2M targeting sequence
gtttaatttgcattgcacaa

SEQ ID NO: 5331 - DNA, 20 bp, Artificial Sequence
  B2M targeting sequence
caacatcagtaatagagaag

SEQ ID NO: 5332 - DNA, 20 bp, Artificial Sequence
  B2M targeting sequence
gtaatagagaagtagatcct

SEQ ID NO: 5333 - DNA, 20 bp, Artificial Sequence
  B2M targeting sequence
attactgatgttgggacttt

SEQ ID NO: 5334 - DNA, 20 bp, Artificial Sequence
  B2M targeting sequence
ctattactgatgttgggact

SEQ ID NO: 5335 - DNA, 20 bp, Artificial Sequence
  B2M targeting sequence
acttctctattactgatgtt

SEQ ID NO: 5336 - DNA, 20 bp, Artificial Sequence
  B2M targeting sequence
tacatactgacatggaagca

SEQ ID NO: 5337 - DNA, 20 bp, Artificial Sequence
  B2M targeting sequence
gtatgtaggatctacttctc

SEQ ID NO: 5338 - DNA, 20 bp, Artificial Sequence
  B2M targeting sequence
atgtcagtatgtaggatcta

SEQ ID NO: 5339 - DNA, 20 bp, Artificial Sequence
  B2M targeting sequence
gcaatatagtatgggtatgc

SEQ ID NO: 5340 - DNA, 20 bp, Artificial Sequence
  B2M targeting sequence
acaaaatatgtgtaagaagc

SEQ ID NO: 5341 - DNA, 20 bp, Artificial Sequence
  B2M targeting sequence
tacacatattttgtagaaac

SEQ ID NO: 5342 - DNA, 20 bp, Artificial Sequence
  B2M targeting sequence
cacctgtaatcccagcattt

SEQ ID NO: 5343 - DNA, 20 bp, Artificial Sequence
  B2M targeting sequence
cagcatttttggaggccaag

SEQ ID NO: 5344 - DNA, 20 bp, Artificial Sequence
  B2M targeting sequence
aaaaatgctgggattacagg

SEQ ID NO: 5345 - DNA, 20 bp, Artificial Sequence
  B2M targeting sequence
caccttggcctccaaaaatg

SEQ ID NO: 5346 - DNA, 20 bp, Artificial Sequence
  B2M targeting sequence
tcccaccttggcctccaaaa

SEQ ID NO: 5347 - DNA, 20 bp, Artificial Sequence
  B2M targeting sequence
cgcagtcctcccaccttggc

SEQ ID NO: 5348 - DNA, 20 bp, Artificial Sequence
  B2M targeting sequence
tagctcacgcagtcctccca

SEQ ID NO: 5349 - DNA, 20 bp, Artificial Sequence
  B2M targeting sequence
aacttcttagctcacgcagt

SEQ ID NO: 5350 - DNA, 20 bp, Artificial Sequence
  B2M targeting sequence
caaacttcttagctcacgca

SEQ ID NO: 5351 - DNA, 20 bp, Artificial Sequence
  B2M targeting sequence
ctatgttgcccaggcttgtc

SEQ ID NO: 5352 - DNA, 20 bp, Artificial Sequence
  B2M targeting sequence
cactatgttgcccaggcttg

SEQ ID NO: 5353 - DNA, 20 bp, Artificial Sequence
  B2M targeting sequence
ctctctctatttatgtattt

SEQ ID NO: 5354 - DNA, 20 bp, Artificial Sequence
  B2M targeting sequence
ctctctatttatgtatttat

SEQ ID NO: 5355 - DNA, 20 bp, Artificial Sequence
  B2M targeting sequence
ctctatttatgtatttattt

SEQ ID NO: 5356 - DNA, 20 bp, Artificial Sequence
  B2M targeting sequence
ctatttatgtatttatttat

SEQ ID NO: 5357 - DNA, 20 bp, Artificial Sequence
  B2M targeting sequence
atttatgtatttatttatgt

SEQ ID NO: 5358 - DNA, 20 bp, Artificial Sequence
  B2M targeting sequence
ataaatatgtacatacataa

SEQ ID NO: 5359 - DNA, 20 bp, Artificial Sequence
  B2M targeting sequence
aataaataaatcaataaata

SEQ ID NO: 5360 - DNA, 20 bp, Artificial Sequence
  B2M targeting sequence
caaataaataaatcaataaa

SEQ ID NO: 5361 - DNA, 20 bp, Artificial Sequence
  B2M targeting sequence
gtctcaaataaataaatcaa

SEQ ID NO: 5362 - DNA, 20 bp, Artificial Sequence
  B2M targeting sequence
tgccctgtcacccaggctgg

SEQ ID NO: 5363 - DNA, 20 bp, Artificial Sequence
  B2M targeting sequence
cccaggctggagtgcaatgt

SEQ ID NO: 5364 - DNA, 20 bp, Artificial Sequence
  B2M targeting sequence
agcctgggtgacagggcaag

SEQ ID NO: 5365 - DNA, 20 bp, Artificial Sequence
  B2M targeting sequence
tgatctcagctcactgcaac

SEQ ID NO: 5366 - DNA, 20 bp, Artificial Sequence
  B2M targeting sequence
cgacattgcactccagcctg

SEQ ID NO: 5367 - DNA, 20 bp, Artificial Sequence
  B2M targeting sequence
cagctcactgcaacctccac

SEQ ID NO: 5368 - DNA, 20 bp, Artificial Sequence
  B2M targeting sequence
gctcactgcaacctccacct

SEQ ID NO: 5369 - DNA, 20 bp, Artificial Sequence
  B2M targeting sequence
ctgcaacctccacctcccag

SEQ ID NO: 5370 - DNA, 20 bp, Artificial Sequence
  B2M targeting sequence
acctcccaggttcaaacgat

SEQ ID NO: 5371 - DNA, 20 bp, Artificial Sequence
  B2M targeting sequence
caggttcaaacgattctcct

SEQ ID NO: 5372 - DNA, 20 bp, Artificial Sequence
  B2M targeting sequence
aacgattctcctgcctcagc

SEQ ID NO: 5373 - DNA, 20 bp, Artificial Sequence
  B2M targeting sequence
tttgaacctgggaggtggag

SEQ ID NO: 5374 - DNA, 20 bp, Artificial Sequence
  B2M targeting sequence
cctgcctcagcctcctgagt

SEQ ID NO: 5375 - DNA, 20 bp, Artificial Sequence
  B2M targeting sequence
tgcctcagcctcctgagtag

SEQ ID NO: 5376 - DNA, 20 bp, Artificial Sequence
  B2M targeting sequence
gcctcctgagtagctggaat

SEQ ID NO: 5377 - DNA, 20 bp, Artificial Sequence
  B2M targeting sequence
tgagtagctggaattacagg

SEQ ID NO: 5378 - DNA, 20 bp, Artificial Sequence
  B2M targeting sequence
ggaggctgaggcaggagaat

SEQ ID NO: 5379 - DNA, 20 bp, Artificial Sequence
  B2M targeting sequence
agctactcaggaggctgagg

SEQ ID NO: 5380 - DNA, 20 bp, Artificial Sequence
  B2M targeting sequence
actaaaaatacaaaaaataa

SEQ ID NO: 5381 - DNA, 20 bp, Artificial Sequence
  B2M targeting sequence
ctactaaaaatacaaaaaat

SEQ ID NO: 5382 - DNA, 20 bp, Artificial Sequence
  B2M targeting sequence
cgtctctactaaaaatacaa

SEQ ID NO: 5383 - DNA, 20 bp, Artificial Sequence
  B2M targeting sequence
tcatgttggtcaggctggtc

SEQ ID NO: 5384 - DNA, 20 bp, Artificial Sequence
  B2M targeting sequence
tgttggtcaggctggtctca

SEQ ID NO: 5385 - DNA, 20 bp, Artificial Sequence
  B2M targeting sequence
ggctggtctcaaactcctga

SEQ ID NO: 5386 - DNA, 20 bp, Artificial Sequence
  B2M targeting sequence
caaactcctgacctcatgat

SEQ ID NO: 5387 - DNA, 20 bp, Artificial Sequence
  B2M targeting sequence
aactcctgacctcatgatcc

SEQ ID NO: 5388 - DNA, 20 bp, Artificial Sequence
  B2M targeting sequence
tgacctcatgatccacccgc

SEQ ID NO: 5389 - DNA, 20 bp, Artificial Sequence
  B2M targeting sequence
ggagtttgagaccagcctga

SEQ ID NO: 5390 - DNA, 20 bp, Artificial Sequence
  B2M targeting sequence
tgatccacccgcctcggcct

SEQ ID NO: 5391 - DNA, 20 bp, Artificial Sequence
  B2M targeting sequence
tgaggtcaggagtttgagac

SEQ ID NO: 5392 - DNA, 20 bp, Artificial Sequence
  B2M targeting sequence
acccgcctcggcctcccaaa

SEQ ID NO: 5393 - DNA, 20 bp, Artificial Sequence
  B2M targeting sequence
gcctcccaaagtgctgggat

SEQ ID NO: 5394 - DNA, 20 bp, Artificial Sequence
  B2M targeting sequence
caaagtgctgggattacagg

SEQ ID NO: 5395 - DNA, 20 bp, Artificial Sequence
  B2M targeting sequence
cagcactttgggaggccgag

SEQ ID NO: 5396 - DNA, 20 bp, Artificial Sequence
  B2M targeting sequence
cacctgtaatcccagcactt

SEQ ID NO: 5397 - DNA, 20 bp, Artificial Sequence
  B2M targeting sequence
gccgggcgcggtggctcaca

SEQ ID NO: 5398 - DNA, 20 bp, Artificial Sequence
  B2M targeting sequence
cggccgggcgcggtggctca

SEQ ID NO: 5399 - DNA, 20 bp, Artificial Sequence
  B2M targeting sequence
ctttaaaaaaaaatggctaa

SEQ ID NO: 5400 - DNA, 20 bp, Artificial Sequence
  B2M targeting sequence
ttaaaaaaaaatggctaaca

SEQ ID NO: 5401 - DNA, 20 bp, Artificial Sequence
  B2M targeting sequence
ccatgttagccatttttttt

SEQ ID NO: 5402 - DNA, 20 bp, Artificial Sequence
  B2M targeting sequence
ctactaaaaatacaaaaatt

SEQ ID NO: 5403 - DNA, 20 bp, Artificial Sequence
  B2M targeting sequence
actaaaaatacaaaaattag

SEQ ID NO: 5404 - DNA, 20 bp, Artificial Sequence
  B2M targeting sequence
cagctacttgggaggctgag

SEQ ID NO: 5405 - DNA, 20 bp, Artificial Sequence
  B2M targeting sequence
caagtagctgggattacagg

SEQ ID NO: 5406 - DNA, 20 bp, Artificial Sequence
  B2M targeting sequence
gcctcccaagtagctgggat

SEQ ID NO: 5407 - DNA, 20 bp, Artificial Sequence
  B2M targeting sequence
tgcctcagcctcccaagtag

SEQ ID NO: 5408 - DNA, 20 bp, Artificial Sequence
  B2M targeting sequence
cctgcctcagcctcccaagt

SEQ ID NO: 5409 - DNA, 20 bp, Artificial Sequence
  B2M targeting sequence
cttgaacccaggaggcggag

SEQ ID NO: 5410 - DNA, 20 bp, Artificial Sequence
  B2M targeting sequence
agtgattctcctgcctcagc

SEQ ID NO: 5411 - DNA, 20 bp, Artificial Sequence
  B2M targeting sequence
tgggttcaagtgattctcct

SEQ ID NO: 5412 - DNA, 20 bp, Artificial Sequence
  B2M targeting sequence
gcctcctgggttcaagtgat

SEQ ID NO: 5413 - DNA, 20 bp, Artificial Sequence
  B2M targeting sequence
ctgcaacctccgcctcctgg

SEQ ID NO: 5414 - DNA, 20 bp, Artificial Sequence
  B2M targeting sequence
gctcactgcaacctccgcct

SEQ ID NO: 5415 - DNA, 20 bp, Artificial Sequence
  B2M targeting sequence
ccgctcactgcaacctccgc

SEQ ID NO: 5416 - DNA, 20 bp, Artificial Sequence
  B2M targeting sequence
ccgcacactagcctgggtga

SEQ ID NO: 5417 - DNA, 20 bp, Artificial Sequence
  B2M targeting sequence
cccaggctagtgtgcggtga

SEQ ID NO: 5418 - DNA, 20 bp, Artificial Sequence
  B2M targeting sequence
gtcacccaggctagtgtgcg

SEQ ID NO: 5419 - DNA, 20 bp, Artificial Sequence
  B2M targeting sequence
tgctctgtcacccaggctag

SEQ ID NO: 5420 - DNA, 20 bp, Artificial Sequence
  B2M targeting sequence
cacacacacacacaaaaaag

SEQ ID NO: 5421 - DNA, 20 bp, Artificial Sequence
  B2M targeting sequence
acttttttgtgtgtgtgtgt

SEQ ID NO: 5422 - DNA, 20 bp, Artificial Sequence
  B2M targeting sequence
cttgagcctgggaggttgag

SEQ ID NO: 5423 - DNA, 20 bp, Artificial Sequence
  B2M targeting sequence
agtgatgcaagcgtccactt

SEQ ID NO: 5424 - DNA, 20 bp, Artificial Sequence
  B2M targeting sequence
caggctcaagtgatgcaagc

SEQ ID NO: 5425 - DNA, 20 bp, Artificial Sequence
  B2M targeting sequence
acctcccaggctcaagtgat

SEQ ID NO: 5426 - DNA, 20 bp, Artificial Sequence
  B2M targeting sequence
ctgcagcctcaacctcccag

SEQ ID NO: 5427 - DNA, 20 bp, Artificial Sequence
  B2M targeting sequence
gctcactgcagcctcaacct

SEQ ID NO: 5428 - DNA, 20 bp, Artificial Sequence
  B2M targeting sequence
ctgctcactgcagcctcaac

SEQ ID NO: 5429 - DNA, 20 bp, Artificial Sequence
  B2M targeting sequence
ggacactacactccagcctg

SEQ ID NO: 5430 - DNA, 20 bp, Artificial Sequence
  B2M targeting sequence
tgatctctgctcactgcagc

SEQ ID NO: 5431 - DNA, 20 bp, Artificial Sequence
  B2M targeting sequence
agcctgggtgatgaagcaag

SEQ ID NO: 5432 - DNA, 20 bp, Artificial Sequence
  B2M targeting sequence
cccaggctggagtgtagtgt

SEQ ID NO: 5433 - DNA, 20 bp, Artificial Sequence
  B2M targeting sequence
tcacccaggctggagtgtag

SEQ ID NO: 5434 - DNA, 20 bp, Artificial Sequence
  B2M targeting sequence
ctcaaaaaggaaaaaaaaaa

SEQ ID NO: 5435 - DNA, 20 bp, Artificial Sequence
  B2M targeting sequence
aaaaggaaaaaaaaaaaaag

SEQ ID NO: 5436 - DNA, 20 bp, Artificial Sequence
  B2M targeting sequence
tttttgagggacttgcttca

SEQ ID NO: 5437 - DNA, 20 bp, Artificial Sequence
  B2M targeting sequence
actttttttttttttccttt

SEQ ID NO: 5438 - DNA, 20 bp, Artificial Sequence
  B2M targeting sequence
gtattgttcaaaggttaact

SEQ ID NO: 5439 - DNA, 20 bp, Artificial Sequence
  B2M targeting sequence
aaggttaactgtatcctcct

SEQ ID NO: 5440 - DNA, 20 bp, Artificial Sequence
  B2M targeting sequence
tcctttaaaaaaggggttac

SEQ ID NO: 5441 - DNA, 20 bp, Artificial Sequence
  B2M targeting sequence
tttaaaaaaggggttactgt

SEQ ID NO: 5442 - DNA, 20 bp, Artificial Sequence
  B2M targeting sequence
tactttttttcatgatccct

SEQ ID NO: 5443 - DNA, 20 bp, Artificial Sequence
  B2M targeting sequence
tgatccctaaggaaaacatg

SEQ ID NO: 5444 - DNA, 20 bp, Artificial Sequence
  B2M targeting sequence
tgaaaaaaagtaagatataa

SEQ ID NO: 5445 - DNA, 20 bp, Artificial Sequence
  B2M targeting sequence
ctaaggaaaacatgtcacaa

SEQ ID NO: 5446 - DNA, 20 bp, Artificial Sequence
  B2M targeting sequence
ttagggatcatgaaaaaaag

SEQ ID NO: 5447 - DNA, 20 bp, Artificial Sequence
  B2M targeting sequence
caaatggatatgtctttcta

SEQ ID NO: 5448 - DNA, 20 bp, Artificial Sequence
  B2M targeting sequence
atttgtgacatgttttcctt

SEQ ID NO: 5449 - DNA, 20 bp, Artificial Sequence
  B2M targeting sequence
ttctagttttgtcaacaacc

SEQ ID NO: 5450 - DNA, 20 bp, Artificial Sequence
  B2M targeting sequence
agttttgtcaacaaccactt

SEQ ID NO: 5451 - DNA, 20 bp, Artificial Sequence
  B2M targeting sequence
acaaccactttcacggtatt

SEQ ID NO: 5452 - DNA, 20 bp, Artificial Sequence
  B2M targeting sequence
cggtatttttgggctgttgc

SEQ ID NO: 5453 - DNA, 20 bp, Artificial Sequence
  B2M targeting sequence
tttttgtgttgtaaaccctt

SEQ ID NO: 5454 - DNA, 20 bp, Artificial Sequence
  B2M targeting sequence
agggtttacaacacaaaaat

SEQ ID NO: 5455 - DNA, 20 bp, Artificial Sequence
  B2M targeting sequence
aggtcttttctttttttctt

SEQ ID NO: 5456 - DNA, 20 bp, Artificial Sequence
  B2M targeting sequence
tttctttttttcttttcttt

SEQ ID NO: 5457 - DNA, 20 bp, Artificial Sequence
  B2M targeting sequence
ttttttcttttcttttcttt

SEQ ID NO: 5458 - DNA, 20 bp, Artificial Sequence
  B2M targeting sequence
tttcttttcttttctgagac

SEQ ID NO: 5459 - DNA, 20 bp, Artificial Sequence
  B2M targeting sequence
tttcttttctgagacagggt

SEQ ID NO: 5460 - DNA, 20 bp, Artificial Sequence
  B2M targeting sequence
tttctgagacagggtattac

SEQ ID NO: 5461 - DNA, 20 bp, Artificial Sequence
  B2M targeting sequence
gagacagggtattaccctgt

SEQ ID NO: 5462 - DNA, 20 bp, Artificial Sequence
  B2M targeting sequence
gaaaagaaaagaaaagaaaa

SEQ ID NO: 5463 - DNA, 20 bp, Artificial Sequence
  B2M targeting sequence
cagaaaagaaaagaaaagaa

SEQ ID NO: 5464 - DNA, 20 bp, Artificial Sequence
  B2M targeting sequence
cccaggcttgtgtgcagagg

SEQ ID NO: 5465 - DNA, 20 bp, Artificial Sequence
  B2M targeting sequence
gcacacaagcctgggtgaca

SEQ ID NO: 5466 - DNA, 20 bp, Artificial Sequence
  B2M targeting sequence
tggctcactgcagcctcagc

SEQ ID NO: 5467 - DNA, 20 bp, Artificial Sequence
  B2M targeting sequence
ctgcagcctcagcctcttgg

SEQ ID NO: 5468 - DNA, 20 bp, Artificial Sequence
  B2M targeting sequence
gcctcttggactcaagcaat

SEQ ID NO: 5469 - DNA, 20 bp, Artificial Sequence
  B2M targeting sequence
tggactcaagcaatcctccc

SEQ ID NO: 5470 - DNA, 20 bp, Artificial Sequence
  B2M targeting sequence
aagaggctgaggctgcagtg

SEQ ID NO: 5471 - DNA, 20 bp, Artificial Sequence
  B2M targeting sequence
agcaatcctcccatctcagc

SEQ ID NO: 5472 - DNA, 20 bp, Artificial Sequence
  B2M targeting sequence
tcccatctcagcctcccaag

SEQ ID NO: 5473 - DNA, 20 bp, Artificial Sequence
  B2M targeting sequence
catctcagcctcccaagtag

SEQ ID NO: 5474 - DNA, 20 bp, Artificial Sequence
  B2M targeting sequence
cagcctcccaagtagctgag

SEQ ID NO: 5475 - DNA, 20 bp, Artificial Sequence
  B2M targeting sequence
gcctcccaagtagctgagac

SEQ ID NO: 5476 - DNA, 20 bp, Artificial Sequence
  B2M targeting sequence
caagtagctgagaccacagg

SEQ ID NO: 5477 - DNA, 20 bp, Artificial Sequence
  B2M targeting sequence
gctacttgggaggctgagat

SEQ ID NO: 5478 - DNA, 20 bp, Artificial Sequence
  B2M targeting sequence
cagctacttgggaggctgag

SEQ ID NO: 5479 - DNA, 20 bp, Artificial Sequence
  B2M targeting sequence
tggctaattttttttgtgta

SEQ ID NO: 5480 - DNA, 20 bp, Artificial Sequence
  B2M targeting sequence
acaaaaaaatacacaaaaaa

SEQ ID NO: 5481 - DNA, 20 bp, Artificial Sequence
  B2M targeting sequence
ctacaaaaaaatacacaaaa

SEQ ID NO: 5482 - DNA, 20 bp, Artificial Sequence
  B2M targeting sequence
cactatgtttccctggctgg

SEQ ID NO: 5483 - DNA, 20 bp, Artificial Sequence
  B2M targeting sequence
ctatgtttccctggctggtc

SEQ ID NO: 5484 - DNA, 20 bp, Artificial Sequence
  B2M targeting sequence
ctggctggtcttgaactctt

SEQ ID NO: 5485 - DNA, 20 bp, Artificial Sequence
  B2M targeting sequence
tgaactcttgggttcaagcg

SEQ ID NO: 5486 - DNA, 20 bp, Artificial Sequence
  B2M targeting sequence
agaccagccagggaaacata

SEQ ID NO: 5487 - DNA, 20 bp, Artificial Sequence
  B2M targeting sequence
tgggttcaagcgatcctcca

SEQ ID NO: 5488 - DNA, 20 bp, Artificial Sequence
  B2M targeting sequence
agcgatcctccagtctcgcc

SEQ ID NO: 5489 - DNA, 20 bp, Artificial Sequence
  B2M targeting sequence
cttgaacccaagagttcaag

SEQ ID NO: 5490 - DNA, 20 bp, Artificial Sequence
  B2M targeting sequence
tccagtctcgcctctcaaag

SEQ ID NO: 5491 - DNA, 20 bp, Artificial Sequence
  B2M targeting sequence
agtctcgcctctcaaagtgc

SEQ ID NO: 5492 - DNA, 20 bp, Artificial Sequence
  B2M targeting sequence
cgcctctcaaagtgctggga

SEQ ID NO: 5493 - DNA, 20 bp, Artificial Sequence
  B2M targeting sequence
cctctcaaagtgctgggatt

SEQ ID NO: 5494 - DNA, 20 bp, Artificial Sequence
  B2M targeting sequence
caaagtgctgggattacaga

SEQ ID NO: 5495 - DNA, 20 bp, Artificial Sequence
  B2M targeting sequence
aagtgctgggattacagagc

SEQ ID NO: 5496 - DNA, 20 bp, Artificial Sequence
  B2M targeting sequence
cagcactttgagaggcgaga

SEQ ID NO: 5497 - DNA, 20 bp, Artificial Sequence
  B2M targeting sequence
gtaatcccagcactttgaga

SEQ ID NO: 5498 - DNA, 20 bp, Artificial Sequence
  B2M targeting sequence
gccatttcctataataaaaa

SEQ ID NO: 5499 - DNA, 20 bp, Artificial Sequence
  B2M targeting sequence
tataataaaaaaatattttg

SEQ ID NO: 5500 - DNA, 20 bp, Artificial Sequence
  B2M targeting sequence
gtgatgtagccatcaaagtt

SEQ ID NO: 5501 - DNA, 20 bp, Artificial Sequence
  B2M targeting sequence
cagacaaaatatttttttat

SEQ ID NO: 5502 - DNA, 20 bp, Artificial Sequence
  B2M targeting sequence
aagttttagggggaaaaatt

SEQ ID NO: 5503 - DNA, 20 bp, Artificial Sequence
  B2M targeting sequence
ccctaaaactttgatggcta

SEQ ID NO: 5504 - DNA, 20 bp, Artificial Sequence
  B2M targeting sequence
ttccctggagtctagaccta

SEQ ID NO: 5505 - DNA, 20 bp, Artificial Sequence
  B2M targeting sequence
ctggagtctagacctatagg

SEQ ID NO: 5506 - DNA, 20 bp, Artificial Sequence
  B2M targeting sequence
agggaaagacaatgccaatt

SEQ ID NO: 5507 - DNA, 20 bp, Artificial Sequence
  B2M targeting sequence
agacctataggaaaaaaatt

SEQ ID NO: 5508 - DNA, 20 bp, Artificial Sequence
  B2M targeting sequence
agactccagggaaagacaat

SEQ ID NO: 5509 - DNA, 20 bp, Artificial Sequence
  B2M targeting sequence
tataggtctagactccaggg

SEQ ID NO: 5510 - DNA, 20 bp, Artificial Sequence
  B2M targeting sequence
atttttttcctataggtcta

SEQ ID NO: 5511 - DNA, 20 bp, Artificial Sequence
  B2M targeting sequence
agataacgcaaaataaataa

SEQ ID NO: 5512 - DNA, 20 bp, Artificial Sequence
  B2M targeting sequence
agaacccaaatattagcctt

SEQ ID NO: 5513 - DNA, 20 bp, Artificial Sequence
  B2M targeting sequence
gtgattaccttgattgaaaa

SEQ ID NO: 5514 - DNA, 20 bp, Artificial Sequence
  B2M targeting sequence
cagatgttttattatttatt

SEQ ID NO: 5515 - DNA, 20 bp, Artificial Sequence
  B2M targeting sequence
aggtaatcacagatgtttta

SEQ ID NO: 5516 - DNA, 20 bp, Artificial Sequence
  B2M targeting sequence
atcaaggtaatcacagatgt

SEQ ID NO: 5517 - DNA, 20 bp, Artificial Sequence
  B2M targeting sequence
atgcacaaacttttcaatca

SEQ ID NO: 5518 - DNA, 20 bp, Artificial Sequence
  B2M targeting sequence
ggtactttggagagctacaa

SEQ ID NO: 5519 - DNA, 20 bp, Artificial Sequence
  B2M targeting sequence
aaagtaccagaataatttct

SEQ ID NO: 5520 - DNA, 20 bp, Artificial Sequence
  B2M targeting sequence
ccaaagtaccagaataattt

SEQ ID NO: 5521 - DNA, 20 bp, Artificial Sequence
  B2M targeting sequence
tgtagctctccaaagtacca

SEQ ID NO: 5522 - DNA, 20 bp, Artificial Sequence
  B2M targeting sequence
gttaggccttcttgtagctc

SEQ ID NO: 5523 - DNA, 20 bp, Artificial Sequence
  B2M targeting sequence
gtttttttttctgttaggcc

SEQ ID NO: 5524 - DNA, 20 bp, Artificial Sequence
  B2M targeting sequence
agcatatattaaagcactta

SEQ ID NO: 5525 - DNA, 20 bp, Artificial Sequence
  B2M targeting sequence
actgttattttaattgtatt

SEQ ID NO: 5526 - DNA, 20 bp, Artificial Sequence
  B2M targeting sequence
atatatctcctgtcattagt

SEQ ID NO: 5527 - DNA, 20 bp, Artificial Sequence
  B2M targeting sequence
cctgtcattagttggatgca

SEQ ID NO: 5528 - DNA, 20 bp, Artificial Sequence
  B2M targeting sequence
tgtcattagttggatgcaat

SEQ ID NO: 5529 - DNA, 20 bp, Artificial Sequence
  B2M targeting sequence
ttagttggatgcaattatta

SEQ ID NO: 5530 - DNA, 20 bp, Artificial Sequence
  B2M targeting sequence
aactaatgacaggagatata

SEQ ID NO: 5531 - DNA, 20 bp, Artificial Sequence
  B2M targeting sequence
aataattgcatccaactaat

SEQ ID NO: 5532 - DNA, 20 bp, Artificial Sequence
  B2M targeting sequence
ttggtcctccacaacatagg

SEQ ID NO: 5533 - DNA, 20 bp, Artificial Sequence
  B2M targeting sequence
tccacaacataggtgattaa

SEQ ID NO: 5534 - DNA, 20 bp, Artificial Sequence
  B2M targeting sequence
acaacataggtgattaaaaa

SEQ ID NO: 5535 - DNA, 20 bp, Artificial Sequence
  B2M targeting sequence
cctatgttgtggaggaccaa

SEQ ID NO: 5536 - DNA, 20 bp, Artificial Sequence
  B2M targeting sequence
taggctttttaatcacctat

SEQ ID NO: 5537 - DNA, 20 bp, Artificial Sequence
  B2M targeting sequence
gtttcttaggctttttaatc

SEQ ID NO: 5538 - DNA, 20 bp, Artificial Sequence
  B2M targeting sequence
atgtctttggtaagacacac

SEQ ID NO: 5539 - DNA, 20 bp, Artificial Sequence
  B2M targeting sequence
ttggtaagacacacaggccc

SEQ ID NO: 5540 - DNA, 20 bp, Artificial Sequence
  B2M targeting sequence
taccaaagacatagataacg

SEQ ID NO: 5541 - DNA, 20 bp, Artificial Sequence
  B2M targeting sequence
cttgggcctgtgtgtcttac

SEQ ID NO: 5542 - DNA, 20 bp, Artificial Sequence
  B2M targeting sequence
ttgcaggcttcacttgggcc

SEQ ID NO: 5543 - DNA, 20 bp, Artificial Sequence
  B2M targeting sequence
cctcccccacggaccacatg

SEQ ID NO: 5544 - DNA, 20 bp, Artificial Sequence
  B2M targeting sequence
cccacggaccacatggacca

SEQ ID NO: 5545 - DNA, 20 bp, Artificial Sequence
  B2M targeting sequence
gtgggggaggggaagcctgc

SEQ ID NO: 5546 - DNA, 20 bp, Artificial Sequence
  B2M targeting sequence
atgtggtccgtgggggaggg

SEQ ID NO: 5547 - DNA, 20 bp, Artificial Sequence
  B2M targeting sequence
tctttttttttttttttttt

SEQ ID NO: 5548 - DNA, 20 bp, Artificial Sequence
  B2M targeting sequence
tttttttttttttttttttt

SEQ ID NO: 5549 - DNA, 20 bp, Artificial Sequence
  B2M targeting sequence
ttagacagagtctcactgta

SEQ ID NO: 5550 - DNA, 20 bp, Artificial Sequence
  B2M targeting sequence
aaagaaaaaaaaaaaaaaaa

SEQ ID NO: 5551 - DNA, 20 bp, Artificial Sequence
  B2M targeting sequence
gtctaaagaaaaaaaaaaaa

SEQ ID NO: 5552 - DNA, 20 bp, Artificial Sequence
  B2M targeting sequence
cactgtatcgcctaggctgg

SEQ ID NO: 5553 - DNA, 20 bp, Artificial Sequence
  B2M targeting sequence
ctgtatcgcctaggctggag

SEQ ID NO: 5554 - DNA, 20 bp, Artificial Sequence
  B2M targeting sequence
cctaggctggagtgcagtgg

SEQ ID NO: 5555 - DNA, 20 bp, Artificial Sequence
  B2M targeting sequence
agcctaggcgatacagtgag

SEQ ID NO: 5556 - DNA, 20 bp, Artificial Sequence
  B2M targeting sequence
cggctcactgcaacctctgc

SEQ ID NO: 5557 - DNA, 20 bp, Artificial Sequence
  B2M targeting sequence
gctcactgcaacctctgctt

SEQ ID NO: 5558 - DNA, 20 bp, Artificial Sequence
  B2M targeting sequence
ctgcaacctctgcttcctgg

SEQ ID NO: 5559 - DNA, 20 bp, Artificial Sequence
  B2M targeting sequence
gcttcctgggttcaagtgat

SEQ ID NO: 5560 - DNA, 20 bp, Artificial Sequence
  B2M targeting sequence
tgggttcaagtgattctcct

SEQ ID NO: 5561 - DNA, 20 bp, Artificial Sequence
  B2M targeting sequence
agtgattctcctgcctcagc

SEQ ID NO: 5562 - DNA, 20 bp, Artificial Sequence
  B2M targeting sequence
cttgaacccaggaagcagag

SEQ ID NO: 5563 - DNA, 20 bp, Artificial Sequence
  B2M targeting sequence
cctgcctcagcctcccgagt

SEQ ID NO: 5564 - DNA, 20 bp, Artificial Sequence
  B2M targeting sequence
tgcctcagcctcccgagtag

SEQ ID NO: 5565 - DNA, 20 bp, Artificial Sequence
  B2M targeting sequence
gcctcccgagtagctgggaa

SEQ ID NO: 5566 - DNA, 20 bp, Artificial Sequence
  B2M targeting sequence
cgagtagctgggaatacagg

SEQ ID NO: 5567 - DNA, 20 bp, Artificial Sequence
  B2M targeting sequence
ggaggctgaggcaggagaat

SEQ ID NO: 5568 - DNA, 20 bp, Artificial Sequence
  B2M targeting sequence
cagctactcgggaggctgag

SEQ ID NO: 5569 - DNA, 20 bp, Artificial Sequence
  B2M targeting sequence
ggcatggtggtgcatgcctg

SEQ ID NO: 5570 - DNA, 20 bp, Artificial Sequence
  B2M targeting sequence
accaaaaacacacacataaa

SEQ ID NO: 5571 - DNA, 20 bp, Artificial Sequence
  B2M targeting sequence
ctaccaaaaacacacacata

SEQ ID NO: 5572 - DNA, 20 bp, Artificial Sequence
  B2M targeting sequence
ccatgctggccaggctggtc

SEQ ID NO: 5573 - DNA, 20 bp, Artificial Sequence
  B2M targeting sequence
caaactcctgacctcgtgat

SEQ ID NO: 5574 - DNA, 20 bp, Artificial Sequence
  B2M targeting sequence
aactcctgacctcgtgatct

SEQ ID NO: 5575 - DNA, 20 bp, Artificial Sequence
  B2M targeting sequence
tgacctcgtgatctgctcgc

SEQ ID NO: 5576 - DNA, 20 bp, Artificial Sequence
  B2M targeting sequence
ggagtttgagaccagcctgg

SEQ ID NO: 5577 - DNA, 20 bp, Artificial Sequence
  B2M targeting sequence
tgatctgctcgccttggcct

SEQ ID NO: 5578 - DNA, 20 bp, Artificial Sequence
  B2M targeting sequence
cgaggtcaggagtttgagac

SEQ ID NO: 5579 - DNA, 20 bp, Artificial Sequence
  B2M targeting sequence
gctcgccttggcctcccaaa

SEQ ID NO: 5580 - DNA, 20 bp, Artificial Sequence
  B2M targeting sequence
ccttggcctcccaaagtgct

SEQ ID NO: 5581 - DNA, 20 bp, Artificial Sequence
  B2M targeting sequence
caaagtgctgggattacagg

SEQ ID NO: 5582 - DNA, 20 bp, Artificial Sequence
  B2M targeting sequence
cagcactttgggaggccaag

SEQ ID NO: 5583 - DNA, 20 bp, Artificial Sequence
  B2M targeting sequence
tctttttactgttttcactt

SEQ ID NO: 5584 - DNA, 20 bp, Artificial Sequence
  B2M targeting sequence
ttttactgttttcacttaga

SEQ ID NO: 5585 - DNA, 20 bp, Artificial Sequence
  B2M targeting sequence
cttagaaaaactgagaggac

SEQ ID NO: 5586 - DNA, 20 bp, Artificial Sequence
  B2M targeting sequence
aagtgaaaacagtaaaaaga

SEQ ID NO: 5587 - DNA, 20 bp, Artificial Sequence
  B2M targeting sequence
gtttttctaagtgaaaacag

SEQ ID NO: 5588 - DNA, 20 bp, Artificial Sequence
  B2M targeting sequence
cagtttttctaagtgaaaac

SEQ ID NO: 5589 - DNA, 20 bp, Artificial Sequence
  B2M targeting sequence
tctcagtttttctaagtgaa

SEQ ID NO: 5590 - DNA, 20 bp, Artificial Sequence
  B2M targeting sequence
gtggcagcaaaagtcctctc

SEQ ID NO: 5591 - DNA, 20 bp, Artificial Sequence
  B2M targeting sequence
ttcagtggcagcaaaagtcc

SEQ ID NO: 5592 - DNA, 20 bp, Artificial Sequence
  B2M targeting sequence
actatgctgtgtcattcagt

SEQ ID NO: 5593 - DNA, 20 bp, Artificial Sequence
  B2M targeting sequence
cgtcatttattatggctcga

SEQ ID NO: 5594 - DNA, 20 bp, Artificial Sequence
  B2M targeting sequence
tcatttattatggctcgaat

SEQ ID NO: 5595 - DNA, 20 bp, Artificial Sequence
  B2M targeting sequence
tttattatggctcgaatgtt

SEQ ID NO: 5596 - DNA, 20 bp, Artificial Sequence
  B2M targeting sequence
aatgtttgtcccttctgaaa

SEQ ID NO: 5597 - DNA, 20 bp, Artificial Sequence
  B2M targeting sequence
agccataataaatgacgaga

SEQ ID NO: 5598 - DNA, 20 bp, Artificial Sequence
  B2M targeting sequence
cttctgaaattcatgttgaa

SEQ ID NO: 5599 - DNA, 20 bp, Artificial Sequence
  B2M targeting sequence
gaaattcatgttgaaactta

SEQ ID NO: 5600 - DNA, 20 bp, Artificial Sequence
  B2M targeting sequence
gaagggacaaacattcgagc

SEQ ID NO: 5601 - DNA, 20 bp, Artificial Sequence
  B2M targeting sequence
tgttgaaacttaatcctggc

SEQ ID NO: 5602 - DNA, 20 bp, Artificial Sequence
  B2M targeting sequence
acatgaatttcagaagggac

SEQ ID NO: 5603 - DNA, 20 bp, Artificial Sequence
  B2M targeting sequence
tggctgggcacagtggctca

SEQ ID NO: 5604 - DNA, 20 bp, Artificial Sequence
  B2M targeting sequence
cacttctaatcccagcattt

SEQ ID NO: 5605 - DNA, 20 bp, Artificial Sequence
  B2M targeting sequence
aatcccagcattttgggagg

SEQ ID NO: 5606 - DNA, 20 bp, Artificial Sequence
  B2M targeting sequence
cagcattttgggaggctgag

SEQ ID NO: 5607 - DNA, 20 bp, Artificial Sequence
  B2M targeting sequence
caaaatgctgggattagaag

SEQ ID NO: 5608 - DNA, 20 bp, Artificial Sequence
  B2M targeting sequence
gcctcccaaaatgctgggat

SEQ ID NO: 5609 - DNA, 20 bp, Artificial Sequence
  B2M targeting sequence
cagcctcccaaaatgctggg

SEQ ID NO: 5610 - DNA, 20 bp, Artificial Sequence
  B2M targeting sequence
agtctcagcctcccaaaatg

SEQ ID NO: 5611 - DNA, 20 bp, Artificial Sequence
  B2M targeting sequence
tccagtctcagcctcccaaa

SEQ ID NO: 5612 - DNA, 20 bp, Artificial Sequence
  B2M targeting sequence
catgagcccaggagtttgag

SEQ ID NO: 5613 - DNA, 20 bp, Artificial Sequence
  B2M targeting sequence
tgcgatcctccagtctcagc

SEQ ID NO: 5614 - DNA, 20 bp, Artificial Sequence
  B2M targeting sequence
tgggctcatgcgatcctcca

SEQ ID NO: 5615 - DNA, 20 bp, Artificial Sequence
  B2M targeting sequence
aactcctgggctcatgcgat

SEQ ID NO: 5616 - DNA, 20 bp, Artificial Sequence
  B2M targeting sequence
caaactcctgggctcatgcg

SEQ ID NO: 5617 - DNA, 20 bp, Artificial Sequence
  B2M targeting sequence
ctatgttgcccaggctggtc

SEQ ID NO: 5618 - DNA, 20 bp, Artificial Sequence
  B2M targeting sequence
tcctctctacaaaatcaaac

SEQ ID NO: 5619 - DNA, 20 bp, Artificial Sequence
  B2M targeting sequence
tctctacaaaatcaaacaaa

SEQ ID NO: 5620 - DNA, 20 bp, Artificial Sequence
  B2M targeting sequence
ctacaaaatcaaacaaacaa

SEQ ID NO: 5621 - DNA, 20 bp, Artificial Sequence
  B2M targeting sequence
acaaaatcaaacaaacaaaa

SEQ ID NO: 5622 - DNA, 20 bp, Artificial Sequence
  B2M targeting sequence
aacaaacaaaaattagctgg

SEQ ID NO: 5623 - DNA, 20 bp, Artificial Sequence
  B2M targeting sequence
cagctacttggaaggcggag

SEQ ID NO: 5624 - DNA, 20 bp, Artificial Sequence
  B2M targeting sequence
aagtagctgggaccacaggt

SEQ ID NO: 5625 - DNA, 20 bp, Artificial Sequence
  B2M targeting sequence
gccttccaagtagctgggac

SEQ ID NO: 5626 - DNA, 20 bp, Artificial Sequence
  B2M targeting sequence
tgcctccgccttccaagtag

SEQ ID NO: 5627 - DNA, 20 bp, Artificial Sequence
  B2M targeting sequence
tcctgcctccgccttccaag

SEQ ID NO: 5628 - DNA, 20 bp, Artificial Sequence
  B2M targeting sequence
aacaatcctcctgcctccgc

SEQ ID NO: 5629 - DNA, 20 bp, Artificial Sequence
  B2M targeting sequence
tgggttcaaacaatcctcct

SEQ ID NO: 5630 - DNA, 20 bp, Artificial Sequence
  B2M targeting sequence
tcctgggttcaaacaatcct

SEQ ID NO: 5631 - DNA, 20 bp, Artificial Sequence
  B2M targeting sequence
taaactcctcctgggttcaa

SEQ ID NO: 5632 - DNA, 20 bp, Artificial Sequence
  B2M targeting sequence
gggcaatatagtgagacctc

SEQ ID NO: 5633 - DNA, 20 bp, Artificial Sequence
  B2M targeting sequence
ctatattgcccagactgctc

SEQ ID NO: 5634 - DNA, 20 bp, Artificial Sequence
  B2M targeting sequence
cactatattgcccagactgc

SEQ ID NO: 5635 - DNA, 20 bp, Artificial Sequence
  B2M targeting sequence
tatctgtctatctatgtatc

SEQ ID NO: 5636 - DNA, 20 bp, Artificial Sequence
  B2M targeting sequence
gtctatctatgtatctatgt

SEQ ID NO: 5637 - DNA, 20 bp, Artificial Sequence
  B2M targeting sequence
atctatgtatctatgtatct

SEQ ID NO: 5638 - DNA, 20 bp, Artificial Sequence
  B2M targeting sequence
atgtatctatgtatctatgt

SEQ ID NO: 5639 - DNA, 20 bp, Artificial Sequence
  B2M targeting sequence
atgtatctatgtatctatgt

SEQ ID NO: 5640 - DNA, 20 bp, Artificial Sequence
  B2M targeting sequence
atgtatctatgtatctatct

SEQ ID NO: 5641 - DNA, 20 bp, Artificial Sequence
  B2M targeting sequence
atgtatctatctatctatct

SEQ ID NO: 5642 - DNA, 20 bp, Artificial Sequence
  B2M targeting sequence
atctatctatctatctatct

SEQ ID NO: 5643 - DNA, 20 bp, Artificial Sequence
  B2M targeting sequence
atctatctatctatctaaaa

SEQ ID NO: 5644 - DNA, 20 bp, Artificial Sequence
  B2M targeting sequence
atctatctatctaaaataaa

SEQ ID NO: 5645 - DNA, 20 bp, Artificial Sequence
  B2M targeting sequence
atctatctaaaataaattaa

SEQ ID NO: 5646 - DNA, 20 bp, Artificial Sequence
  B2M targeting sequence
atctaaaataaattaaatta

SEQ ID NO: 5647 - DNA, 20 bp, Artificial Sequence
  B2M targeting sequence
aaaataaattaaattaaaaa

SEQ ID NO: 5648 - DNA, 20 bp, Artificial Sequence
  B2M targeting sequence
ttattttttattttttaatt

SEQ ID NO: 5649 - DNA, 20 bp, Artificial Sequence
  B2M targeting sequence
ttgcctcattattttttatt

SEQ ID NO: 5650 - DNA, 20 bp, Artificial Sequence
  B2M targeting sequence
tttctttgcctcattatttt

SEQ ID NO: 5651 - DNA, 20 bp, Artificial Sequence
  B2M targeting sequence
tcaatataacagtattaaga

SEQ ID NO: 5652 - DNA, 20 bp, Artificial Sequence
  B2M targeting sequence
atataacagtattaagaagt

SEQ ID NO: 5653 - DNA, 20 bp, Artificial Sequence
  B2M targeting sequence
taatactgttatattgagga

SEQ ID NO: 5654 - DNA, 20 bp, Artificial Sequence
  B2M targeting sequence
taaatgccctacttcttaat

SEQ ID NO: 5655 - DNA, 20 bp, Artificial Sequence
  B2M targeting sequence
cctcttaaatgccctacttc

SEQ ID NO: 5656 - DNA, 20 bp, Artificial Sequence
  B2M targeting sequence
tgagggctccttcatgaatg

SEQ ID NO: 5657 - DNA, 20 bp, Artificial Sequence
  B2M targeting sequence
tgacccagtcacctcttaaa

SEQ ID NO: 5658 - DNA, 20 bp, Artificial Sequence
  B2M targeting sequence
ttcatgaatggattaatgga

SEQ ID NO: 5659 - DNA, 20 bp, Artificial Sequence
  B2M targeting sequence
tgaatggattaatggattaa

SEQ ID NO: 5660 - DNA, 20 bp, Artificial Sequence
  B2M targeting sequence
tgaaggagccctcatgaccc

SEQ ID NO: 5661 - DNA, 20 bp, Artificial Sequence
  B2M targeting sequence
attcatgaaggagccctcat

SEQ ID NO: 5662 - DNA, 20 bp, Artificial Sequence
  B2M targeting sequence
attaatccattcatgaagga

SEQ ID NO: 5663 - DNA, 20 bp, Artificial Sequence
  B2M targeting sequence
tgagaatgggtctgttataa

SEQ ID NO: 5664 - DNA, 20 bp, Artificial Sequence
  B2M targeting sequence
ggataacccattaatccatt

SEQ ID NO: 5665 - DNA, 20 bp, Artificial Sequence
  B2M targeting sequence
caggataacccattaatcca

SEQ ID NO: 5666 - DNA, 20 bp, Artificial Sequence
  B2M targeting sequence
gttataaaagccagtttcgc

SEQ ID NO: 5667 - DNA, 20 bp, Artificial Sequence
  B2M targeting sequence
ctctttctcttgtgcccctc

SEQ ID NO: 5668 - DNA, 20 bp, Artificial Sequence
  B2M targeting sequence
ttctcttgtgcccctctaaa

SEQ ID NO: 5669 - DNA, 20 bp, Artificial Sequence
  B2M targeting sequence
cttgtgcccctctaaatctt

SEQ ID NO: 5670 - DNA, 20 bp, Artificial Sequence
  B2M targeting sequence
tgtgcccctctaaatcttta

SEQ ID NO: 5671 - DNA, 20 bp, Artificial Sequence
  B2M targeting sequence
aaatctttatctttagccat

SEQ ID NO: 5672 - DNA, 20 bp, Artificial Sequence
  B2M targeting sequence
ttatctttagccatgttatg

SEQ ID NO: 5673 - DNA, 20 bp, Artificial Sequence
  B2M targeting sequence
ttagccatgttatgatgcct

SEQ ID NO: 5674 - DNA, 20 bp, Artificial Sequence
  B2M targeting sequence
taacatggctaaagataaag

SEQ ID NO: 5675 - DNA, 20 bp, Artificial Sequence
  B2M targeting sequence
ctgatatctttacccatgtt

SEQ ID NO: 5676 - DNA, 20 bp, Artificial Sequence
  B2M targeting sequence
gatatctttacccatgttat

SEQ ID NO: 5677 - DNA, 20 bp, Artificial Sequence
  B2M targeting sequence
gagaggcatcataacatggc

SEQ ID NO: 5678 - DNA, 20 bp, Artificial Sequence
  B2M targeting sequence
ttacccatgttatgatgcgg

SEQ ID NO: 5679 - DNA, 20 bp, Artificial Sequence
  B2M targeting sequence
taacatgggtaaagatatca

SEQ ID NO: 5680 - DNA, 20 bp, Artificial Sequence
  B2M targeting sequence
gcatcataacatgggtaaag

SEQ ID NO: 5681 - DNA, 20 bp, Artificial Sequence
  B2M targeting sequence
cccaaagcaaaccagataca

SEQ ID NO: 5682 - DNA, 20 bp, Artificial Sequence
  B2M targeting sequence
ggtttgctttgggtgagggc

SEQ ID NO: 5683 - DNA, 20 bp, Artificial Sequence
  B2M targeting sequence
atgttgaacttctcagcctc

SEQ ID NO: 5684 - DNA, 20 bp, Artificial Sequence
  B2M targeting sequence
acattgaggggctgtatctg

SEQ ID NO: 5685 - DNA, 20 bp, Artificial Sequence
  B2M targeting sequence
cagcctcttccatacatttt

SEQ ID NO: 5686 - DNA, 20 bp, Artificial Sequence
  B2M targeting sequence
gcctcttccatacatttttc

SEQ ID NO: 5687 - DNA, 20 bp, Artificial Sequence
  B2M targeting sequence
tccatacatttttcttcctt

SEQ ID NO: 5688 - DNA, 20 bp, Artificial Sequence
  B2M targeting sequence
atacatttttcttcctttct

SEQ ID NO: 5689 - DNA, 20 bp, Artificial Sequence
  B2M targeting sequence
tcctttcttttttttgagat

SEQ ID NO: 5690 - DNA, 20 bp, Artificial Sequence
  B2M targeting sequence
tttcttttttttgagatagg

SEQ ID NO: 5691 - DNA, 20 bp, Artificial Sequence
  B2M targeting sequence
tttttttgagataggatctt

SEQ ID NO: 5692 - DNA, 20 bp, Artificial Sequence
  B2M targeting sequence
aaaaaaagaaaggaagaaaa

SEQ ID NO: 5693 - DNA, 20 bp, Artificial Sequence
  B2M targeting sequence
caaaaaaaagaaaggaagaa

SEQ ID NO: 5694 - DNA, 20 bp, Artificial Sequence
  B2M targeting sequence
tatctcaaaaaaaagaaagg

SEQ ID NO: 5695 - DNA, 20 bp, Artificial Sequence
  B2M targeting sequence
tgctctgccattgtgccatt

SEQ ID NO: 5696 - DNA, 20 bp, Artificial Sequence
  B2M targeting sequence
gccattgtgccattgcagcc

SEQ ID NO: 5697 - DNA, 20 bp, Artificial Sequence
  B2M targeting sequence
aactcttgggctcaagtgat

SEQ ID NO: 5698 - DNA, 20 bp, Artificial Sequence
  B2M targeting sequence
tgggctcaagtgatcctgct

SEQ ID NO: 5699 - DNA, 20 bp, Artificial Sequence
  B2M targeting sequence
agtgatcctgctgcttcagc

SEQ ID NO: 5700 - DNA, 20 bp, Artificial Sequence
  B2M targeting sequence
cttgagcccaagagtttgag

SEQ ID NO: 5701 - DNA, 20 bp, Artificial Sequence
  B2M targeting sequence
tgctgcttcagcatcctgag

SEQ ID NO: 5702 - DNA, 20 bp, Artificial Sequence
  B2M targeting sequence
gcatcctgagtagcggggct

SEQ ID NO: 5703 - DNA, 20 bp, Artificial Sequence
  B2M targeting sequence
tgagtagcggggcttacaga

SEQ ID NO: 5704 - DNA, 20 bp, Artificial Sequence
  B2M targeting sequence
ggatgctgaagcagcaggat

SEQ ID NO: 5705 - DNA, 20 bp, Artificial Sequence
  B2M targeting sequence
gtaagccccgctactcagga

SEQ ID NO: 5706 - DNA, 20 bp, Artificial Sequence
  B2M targeting sequence
ctaatttttttttttttttt

SEQ ID NO: 5707 - DNA, 20 bp, Artificial Sequence
  B2M targeting sequence
aaaaaaaaaaaaaaaattag

SEQ ID NO: 5708 - DNA, 20 bp, Artificial Sequence
  B2M targeting sequence
caaaaaaaaaaaaaaaaatt

SEQ ID NO: 5709 - DNA, 20 bp, Artificial Sequence
  B2M targeting sequence
atctcaaaaaaaaaaaaaaa

SEQ ID NO: 5710 - DNA, 20 bp, Artificial Sequence
  B2M targeting sequence
tgctaggtcacccaggctgg

SEQ ID NO: 5711 - DNA, 20 bp, Artificial Sequence
  B2M targeting sequence
cccaggctggagtgcagtgg

SEQ ID NO: 5712 - DNA, 20 bp, Artificial Sequence
  B2M targeting sequence
agcctgggtgacctagcaag

SEQ ID NO: 5713 - DNA, 20 bp, Artificial Sequence
  B2M targeting sequence
caccactgcactccagcctg

SEQ ID NO: 5714 - DNA, 20 bp, Artificial Sequence
  B2M targeting sequence
cggctcactgcaacctctgc

SEQ ID NO: 5715 - DNA, 20 bp, Artificial Sequence
  B2M targeting sequence
gctcactgcaacctctgcct

SEQ ID NO: 5716 - DNA, 20 bp, Artificial Sequence
  B2M targeting sequence
ctgcaacctctgcctcctgg

SEQ ID NO: 5717 - DNA, 20 bp, Artificial Sequence
  B2M targeting sequence
gcctcctgggttcacaccat

SEQ ID NO: 5718 - DNA, 20 bp, Artificial Sequence
  B2M targeting sequence
tgggttcacaccattctcct

SEQ ID NO: 5719 - DNA, 20 bp, Artificial Sequence
  B2M targeting sequence
caccattctcctgcctcagc

SEQ ID NO: 5720 - DNA, 20 bp, Artificial Sequence
  B2M targeting sequence
cctgcctcagcctcccaagt

SEQ ID NO: 5721 - DNA, 20 bp, Artificial Sequence
  B2M targeting sequence
tgcctcagcctcccaagtag

SEQ ID NO: 5722 - DNA, 20 bp, Artificial Sequence
  B2M targeting sequence
gcctcccaagtagctgggac

SEQ ID NO: 5723 - DNA, 20 bp, Artificial Sequence
  B2M targeting sequence
caagtagctgggactacagg

SEQ ID NO: 5724 - DNA, 20 bp, Artificial Sequence
  B2M targeting sequence
cagctacttgggaggctgag

SEQ ID NO: 5725 - DNA, 20 bp, Artificial Sequence
  B2M targeting sequence
actaaaaatacaaaaaatta

SEQ ID NO: 5726 - DNA, 20 bp, Artificial Sequence
  B2M targeting sequence
ctactaaaaatacaaaaaat

SEQ ID NO: 5727 - DNA, 20 bp, Artificial Sequence
  B2M targeting sequence
ccgtgttagccaggatggtc

SEQ ID NO: 5728 - DNA, 20 bp, Artificial Sequence
  B2M targeting sequence
tggctaacacggtgaaaccc

SEQ ID NO: 5729 - DNA, 20 bp, Artificial Sequence
  B2M targeting sequence
cgatctcctgacctcatgat

SEQ ID NO: 5730 - DNA, 20 bp, Artificial Sequence
  B2M targeting sequence
atctcctgacctcatgatcc

SEQ ID NO: 5731 - DNA, 20 bp, Artificial Sequence
  B2M targeting sequence
agaccatcctggctaacacg

SEQ ID NO: 5732 - DNA, 20 bp, Artificial Sequence
  B2M targeting sequence
cctgacctcatgatccaccc

SEQ ID NO: 5733 - DNA, 20 bp, Artificial Sequence
  B2M targeting sequence
tgacctcatgatccacccat

SEQ ID NO: 5734 - DNA, 20 bp, Artificial Sequence
  B2M targeting sequence
ggagatcgagaccatcctgg

SEQ ID NO: 5735 - DNA, 20 bp, Artificial Sequence
  B2M targeting sequence
tgatccacccatcttggcct

SEQ ID NO: 5736 - DNA, 20 bp, Artificial Sequence
  B2M targeting sequence
tgaggtcaggagatcgagac

SEQ ID NO: 5737 - DNA, 20 bp, Artificial Sequence
  B2M targeting sequence
acccatcttggcctcccaaa

SEQ ID NO: 5738 - DNA, 20 bp, Artificial Sequence
  B2M targeting sequence
tggcctcccaaagtgctggg

SEQ ID NO: 5739 - DNA, 20 bp, Artificial Sequence
  B2M targeting sequence
caaagtgctgggattacagg

SEQ ID NO: 5740 - DNA, 20 bp, Artificial Sequence
  B2M targeting sequence
cagcactttgggaggccaag

SEQ ID NO: 5741 - DNA, 20 bp, Artificial Sequence
  B2M targeting sequence
tgcctgtaatcccagcactt

SEQ ID NO: 5742 - DNA, 20 bp, Artificial Sequence
  B2M targeting sequence
ctagtttttaaaaacttttt

SEQ ID NO: 5743 - DNA, 20 bp, Artificial Sequence
  B2M targeting sequence
acaaaaagtttttaaaaact

SEQ ID NO: 5744 - DNA, 20 bp, Artificial Sequence
  B2M targeting sequence
ctacaaaaagtttttaaaaa

SEQ ID NO: 5745 - DNA, 20 bp, Artificial Sequence
  B2M targeting sequence
gtctctacaaaaagttttta

SEQ ID NO: 5746 - DNA, 20 bp, Artificial Sequence
  B2M targeting sequence
tactatgttgccaaggctgg

SEQ ID NO: 5747 - DNA, 20 bp, Artificial Sequence
  B2M targeting sequence
caaactcctggcctcaagag

SEQ ID NO: 5748 - DNA, 20 bp, Artificial Sequence
  B2M targeting sequence
aactcctggcctcaagagat

SEQ ID NO: 5749 - DNA, 20 bp, Artificial Sequence
  B2M targeting sequence
tggcctcaagagatcctcca

SEQ ID NO: 5750 - DNA, 20 bp, Artificial Sequence
  B2M targeting sequence
agagatcctccagtcttcgg

SEQ ID NO: 5751 - DNA, 20 bp, Artificial Sequence
  B2M targeting sequence
tgaggccaggagtttgagac

SEQ ID NO: 5752 - DNA, 20 bp, Artificial Sequence
  B2M targeting sequence
cttgaggccaggagtttgag

SEQ ID NO: 5753 - DNA, 20 bp, Artificial Sequence
  B2M targeting sequence
tccagtcttcggcctcccaa

SEQ ID NO: 5754 - DNA, 20 bp, Artificial Sequence
  B2M targeting sequence
agtcttcggcctcccaaaaa

SEQ ID NO: 5755 - DNA, 20 bp, Artificial Sequence
  B2M targeting sequence
tcggcctcccaaaaagatgg

SEQ ID NO: 5756 - DNA, 20 bp, Artificial Sequence
  B2M targeting sequence
gcctcccaaaaagatgggat

SEQ ID NO: 5757 - DNA, 20 bp, Artificial Sequence
  B2M targeting sequence
caaaaagatgggattacagg

SEQ ID NO: 5758 - DNA, 20 bp, Artificial Sequence
  B2M targeting sequence
ttttgggaggccgaagactg

SEQ ID NO: 5759 - DNA, 20 bp, Artificial Sequence
  B2M targeting sequence
catctttttgggaggccgaa

SEQ ID NO: 5760 - DNA, 20 bp, Artificial Sequence
  B2M targeting sequence
tgcctgtaatcccatctttt

SEQ ID NO: 5761 - DNA, 20 bp, Artificial Sequence
  B2M targeting sequence
cctggcctcttttttttgta

SEQ ID NO: 5762 - DNA, 20 bp, Artificial Sequence
  B2M targeting sequence
tttttttgtatattacctga

SEQ ID NO: 5763 - DNA, 20 bp, Artificial Sequence
  B2M targeting sequence
ggtaatatacaaaaaaaaga

SEQ ID NO: 5764 - DNA, 20 bp, Artificial Sequence
  B2M targeting sequence
caggtattctgctatagcaa

SEQ ID NO: 5765 - DNA, 20 bp, Artificial Sequence
  B2M targeting sequence
ggtattctgctatagcaaca

SEQ ID NO: 5766 - DNA, 20 bp, Artificial Sequence
  B2M targeting sequence
gctatagcaacagaaagacg

SEQ ID NO: 5767 - DNA, 20 bp, Artificial Sequence
  B2M targeting sequence
gttgctatagcagaatacct

SEQ ID NO: 5768 - DNA, 20 bp, Artificial Sequence
  B2M targeting sequence
ttctgttgctatagcagaat

SEQ ID NO: 5769 - DNA, 20 bp, Artificial Sequence
  B2M targeting sequence
tctttctgttgctatagcag

SEQ ID NO: 5770 - DNA, 20 bp, Artificial Sequence
  B2M targeting sequence
tcgtctttctgttgctatag

SEQ ID NO: 5771 - DNA, 20 bp, Artificial Sequence
  B2M targeting sequence
gtcttcgtctttctgttgct

SEQ ID NO: 5772 - DNA, 20 bp, Artificial Sequence
  B2M targeting sequence
ttagctgtctgcaagtgtgc

SEQ ID NO: 5773 - DNA, 20 bp, Artificial Sequence
  B2M targeting sequence
gcaagtgtgcatgccatttt

SEQ ID NO: 5774 - DNA, 20 bp, Artificial Sequence
  B2M targeting sequence
tcatctgaagagtcagcgag

SEQ ID NO: 5775 - DNA, 20 bp, Artificial Sequence
  B2M targeting sequence
tctgaagagtcagcgagtgt

SEQ ID NO: 5776 - DNA, 20 bp, Artificial Sequence
  B2M targeting sequence
gaagagtcagcgagtgtctt

SEQ ID NO: 5777 - DNA, 20 bp, Artificial Sequence
  B2M targeting sequence
gatgatgaaaatggcatgca

SEQ ID NO: 5778 - DNA, 20 bp, Artificial Sequence
  B2M targeting sequence
tcagatgatgaaaatggcat

SEQ ID NO: 5779 - DNA, 20 bp, Artificial Sequence
  B2M targeting sequence
gcgagtgtcttaggtggagt

SEQ ID NO: 5780 - DNA, 20 bp, Artificial Sequence
  B2M targeting sequence
ctgactcttcagatgatgaa

SEQ ID NO: 5781 - DNA, 20 bp, Artificial Sequence
  B2M targeting sequence
taggtggagtcttgcaaaag

SEQ ID NO: 5782 - DNA, 20 bp, Artificial Sequence
  B2M targeting sequence
acctaagacactcgctgact

SEQ ID NO: 5783 - DNA, 20 bp, Artificial Sequence
  B2M targeting sequence
tgcaaaagcaggccctgagc

SEQ ID NO: 5784 - DNA, 20 bp, Artificial Sequence
  B2M targeting sequence
gggcctgcttttgcaagact

SEQ ID NO: 5785 - DNA, 20 bp, Artificial Sequence
  B2M targeting sequence
ttggctcagggcctgctttt

SEQ ID NO: 5786 - DNA, 20 bp, Artificial Sequence
  B2M targeting sequence
aaatctttggctcagggcct

SEQ ID NO: 5787 - DNA, 20 bp, Artificial Sequence
  B2M targeting sequence
tttgcatccaaatctttggc

SEQ ID NO: 5788 - DNA, 20 bp, Artificial Sequence
  B2M targeting sequence
taacaagtcatttgcatcca

SEQ ID NO: 5789 - DNA, 20 bp, Artificial Sequence
  B2M targeting sequence
tcgagaccgtgccattgcac

SEQ ID NO: 5790 - DNA, 20 bp, Artificial Sequence
  B2M targeting sequence
agaccgtgccattgcactcc

SEQ ID NO: 5791 - DNA, 20 bp, Artificial Sequence
  B2M targeting sequence
aagagccctttcttaacaag

SEQ ID NO: 5792 - DNA, 20 bp, Artificial Sequence
  B2M targeting sequence
cgaagagccctttcttaaca

SEQ ID NO: 5793 - DNA, 20 bp, Artificial Sequence
  B2M targeting sequence
agcccgggcaagaagagtga

SEQ ID NO: 5794 - DNA, 20 bp, Artificial Sequence
  B2M targeting sequence
tgcccgggctggagtgcaat

SEQ ID NO: 5795 - DNA, 20 bp, Artificial Sequence
  B2M targeting sequence
tcttgcccgggctggagtgc

SEQ ID NO: 5796 - DNA, 20 bp, Artificial Sequence
  B2M targeting sequence
ctcttcttgcccgggctgga

SEQ ID NO: 5797 - DNA, 20 bp, Artificial Sequence
  B2M targeting sequence
gtttcaaaaaaaaaaaagtg

SEQ ID NO: 5798 - DNA, 20 bp, Artificial Sequence
  B2M targeting sequence
aaaaaaaaaaagtggggggc

SEQ ID NO: 5799 - DNA, 20 bp, Artificial Sequence
  B2M targeting sequence
taggaaaagaacagtaaagg

SEQ ID NO: 5800 - DNA, 20 bp, Artificial Sequence
  B2M targeting sequence
taggagccccccactttttt

SEQ ID NO: 5801 - DNA, 20 bp, Artificial Sequence
  B2M targeting sequence
tttcctaggagccccccact

SEQ ID NO: 5802 - DNA, 20 bp, Artificial Sequence
  B2M targeting sequence
tttactgttcttttcctagg

SEQ ID NO: 5803 - DNA, 20 bp, Artificial Sequence
  B2M targeting sequence
cccactcctttactgttctt

SEQ ID NO: 5804 - DNA, 20 bp, Artificial Sequence
  B2M targeting sequence
tcccccactcctttactgtt

SEQ ID NO: 5805 - DNA, 20 bp, Artificial Sequence
  B2M targeting sequence
ttcatcccccactcctttac

SEQ ID NO: 5806 - DNA, 20 bp, Artificial Sequence
  B2M targeting sequence
ctgtccttcatcccccactc

SEQ ID NO: 5807 - DNA, 20 bp, Artificial Sequence
  B2M targeting sequence
cattccctgtccttcatccc

SEQ ID NO: 5808 - DNA, 20 bp, Artificial Sequence
  B2M targeting sequence
tcccattccctgtccttcat

SEQ ID NO: 5809 - DNA, 20 bp, Artificial Sequence
  B2M targeting sequence
cttggcttcttcccattccc

SEQ ID NO: 5810 - DNA, 20 bp, Artificial Sequence
  B2M targeting sequence
cgcttggcttcttcccattc

SEQ ID NO: 5811 - DNA, 20 bp, Artificial Sequence
  B2M targeting sequence
tgctctcgcttggcttcttc

SEQ ID NO: 5812 - DNA, 20 bp, Artificial Sequence
  B2M targeting sequence
gaagtcctacactcagcctg

SEQ ID NO: 5813 - DNA, 20 bp, Artificial Sequence
  B2M targeting sequence
gaaatcatgctctcgcttgg

SEQ ID NO: 5814 - DNA, 20 bp, Artificial Sequence
  B2M targeting sequence
tacactcagcctgatcacac

SEQ ID NO: 5815 - DNA, 20 bp, Artificial Sequence
  B2M targeting sequence
gcctgatcacacgggaagct

SEQ ID NO: 5816 - DNA, 20 bp, Artificial Sequence
  B2M targeting sequence
ggctgagtgtaggacttcgg

SEQ ID NO: 5817 - DNA, 20 bp, Artificial Sequence
  B2M targeting sequence
cacgggaagctttagaacaa

SEQ ID NO: 5818 - DNA, 20 bp, Artificial Sequence
  B2M targeting sequence
cgtgtgatcaggctgagtgt

SEQ ID NO: 5819 - DNA, 20 bp, Artificial Sequence
  B2M targeting sequence
aaagcttcccgtgtgatcag

SEQ ID NO: 5820 - DNA, 20 bp, Artificial Sequence
  B2M targeting sequence
ttgttctaaagcttcccgtg

SEQ ID NO: 5821 - DNA, 20 bp, Artificial Sequence
  B2M targeting sequence
gagtttttcctgcctcaaca

SEQ ID NO: 5822 - DNA, 20 bp, Artificial Sequence
  B2M targeting sequence
gaggtgtgttctttgttcta

SEQ ID NO: 5823 - DNA, 20 bp, Artificial Sequence
  B2M targeting sequence
tgcctcaacacaaaggagct

SEQ ID NO: 5824 - DNA, 20 bp, Artificial Sequence
  B2M targeting sequence
acacaaaggagctgggcttt

SEQ ID NO: 5825 - DNA, 20 bp, Artificial Sequence
  B2M targeting sequence
tttgtgttgaggcaggaaaa

SEQ ID NO: 5826 - DNA, 20 bp, Artificial Sequence
  B2M targeting sequence
tcatcagcctgtctttggct

SEQ ID NO: 5827 - DNA, 20 bp, Artificial Sequence
  B2M targeting sequence
tcagcctgtctttggctatc

SEQ ID NO: 5828 - DNA, 20 bp, Artificial Sequence
  B2M targeting sequence
gcctgtctttggctatccag

SEQ ID NO: 5829 - DNA, 20 bp, Artificial Sequence
  B2M targeting sequence
ttggctatccagggttgtgg

SEQ ID NO: 5830 - DNA, 20 bp, Artificial Sequence
  B2M targeting sequence
agggttgtggaacgaggtga

SEQ ID NO: 5831 - DNA, 20 bp, Artificial Sequence
  B2M targeting sequence
acaaccctggatagccaaag

SEQ ID NO: 5832 - DNA, 20 bp, Artificial Sequence
  B2M targeting sequence
ttccacaaccctggatagcc

SEQ ID NO: 5833 - DNA, 20 bp, Artificial Sequence
  B2M targeting sequence
cctcgttccacaaccctgga

SEQ ID NO: 5834 - DNA, 20 bp, Artificial Sequence
  B2M targeting sequence
gaggtacttccggctccctc

SEQ ID NO: 5835 - DNA, 20 bp, Artificial Sequence
  B2M targeting sequence
gagttttatgtttcacctcg

SEQ ID NO: 5836 - DNA, 20 bp, Artificial Sequence
  B2M targeting sequence
ggctccctccagtgtctgag

SEQ ID NO: 5837 - DNA, 20 bp, Artificial Sequence
  B2M targeting sequence
ctccagtgtctgagggtaat

SEQ ID NO: 5838 - DNA, 20 bp, Artificial Sequence
  B2M targeting sequence
agtgtctgagggtaatctgc

SEQ ID NO: 5839 - DNA, 20 bp, Artificial Sequence
  B2M targeting sequence
gagggtaatctgcaggactg

SEQ ID NO: 5840 - DNA, 20 bp, Artificial Sequence
  B2M targeting sequence
gacactggagggagccggaa

SEQ ID NO: 5841 - DNA, 20 bp, Artificial Sequence
  B2M targeting sequence
gcaggactgagggtaattgc

SEQ ID NO: 5842 - DNA, 20 bp, Artificial Sequence
  B2M targeting sequence
tgcagattaccctcagacac

SEQ ID NO: 5843 - DNA, 20 bp, Artificial Sequence
  B2M targeting sequence
gtcctgcagattaccctcag

SEQ ID NO: 5844 - DNA, 20 bp, Artificial Sequence
  B2M targeting sequence
gcaattaccctcagtcctgc

SEQ ID NO: 5845 - DNA, 20 bp, Artificial Sequence
  B2M targeting sequence
gcttttgcatagtttgctgc

SEQ ID NO: 5846 - DNA, 20 bp, Artificial Sequence
  B2M targeting sequence
tcagcttttgcatagtttgc

SEQ ID NO: 5847 - DNA, 20 bp, Artificial Sequence
  B2M targeting sequence
ggctttataagccagtcctc

SEQ ID NO: 5848 - DNA, 20 bp, Artificial Sequence
  B2M targeting sequence
gggtgagtcatgtttcctgt

SEQ ID NO: 5849 - DNA, 20 bp, Artificial Sequence
  B2M targeting sequence
cccagatctggctttataag

SEQ ID NO: 5850 - DNA, 20 bp, Artificial Sequence
  B2M targeting sequence
tgtttcctgtcaacatcctc

SEQ ID NO: 5851 - DNA, 20 bp, Artificial Sequence
  B2M targeting sequence
tgtcaacatcctctgctggg

SEQ ID NO: 5852 - DNA, 20 bp, Artificial Sequence
  B2M targeting sequence
acatcctctgctgggcccat

SEQ ID NO: 5853 - DNA, 20 bp, Artificial Sequence
  B2M targeting sequence
tctgctgggcccataacaca

SEQ ID NO: 5854 - DNA, 20 bp, Artificial Sequence
  B2M targeting sequence
gctgggcccataacacatgc

SEQ ID NO: 5855 - DNA, 20 bp, Artificial Sequence
  B2M targeting sequence
attacaagttcaaagtttct

SEQ ID NO: 5856 - DNA, 20 bp, Artificial Sequence
  B2M targeting sequence
aagtttctaaggggatagca

SEQ ID NO: 5857 - DNA, 20 bp, Artificial Sequence
  B2M targeting sequence
aaggggatagcattacagtg

SEQ ID NO: 5858 - DNA, 20 bp, Artificial Sequence
  B2M targeting sequence
ccttagaaactttgaacttg

SEQ ID NO: 5859 - DNA, 20 bp, Artificial Sequence
  B2M targeting sequence
tacacactgtaatgctatcc

SEQ ID NO: 5860 - DNA, 20 bp, Artificial Sequence
  B2M targeting sequence
aatatcatacacactgtaat

SEQ ID NO: 5861 - DNA, 20 bp, Artificial Sequence
  B2M targeting sequence
gacctgagtttgaatcctaa

SEQ ID NO: 5862 - DNA, 20 bp, Artificial Sequence
  B2M targeting sequence
gagtccaatatcatacacac

SEQ ID NO: 5863 - DNA, 20 bp, Artificial Sequence
  B2M targeting sequence
ggtctgagtccaatatcata

SEQ ID NO: 5864 - DNA, 20 bp, Artificial Sequence
  B2M targeting sequence
aactcaggtctgagtccaat

SEQ ID NO: 5865 - DNA, 20 bp, Artificial Sequence
  B2M targeting sequence
taattccacaaaagaaattg

SEQ ID NO: 5866 - DNA, 20 bp, Artificial Sequence
  B2M targeting sequence
acaaaagaaattggaaaaga

SEQ ID NO: 5867 - DNA, 20 bp, Artificial Sequence
  B2M targeting sequence
tttgtggaattaggattcaa

SEQ ID NO: 5868 - DNA, 20 bp, Artificial Sequence
  B2M targeting sequence
aatttcttttgtggaattag

SEQ ID NO: 5869 - DNA, 20 bp, Artificial Sequence
  B2M targeting sequence
tttccaatttcttttgtgga

SEQ ID NO: 5870 - DNA, 20 bp, Artificial Sequence
  B2M targeting sequence
tattgctgacttgacccttt

SEQ ID NO: 5871 - DNA, 20 bp, Artificial Sequence
  B2M targeting sequence
gcaatatgactcttttccaa

SEQ ID NO: 5872 - DNA, 20 bp, Artificial Sequence
  B2M targeting sequence
agtcagcaatatgactcttt

SEQ ID NO: 5873 - DNA, 20 bp, Artificial Sequence
  B2M targeting sequence
ccatatccataaaatgggat

SEQ ID NO: 5874 - DNA, 20 bp, Artificial Sequence
  B2M targeting sequence
ataaaatgggataattattc

SEQ ID NO: 5875 - DNA, 20 bp, Artificial Sequence
  B2M targeting sequence
cattttatggatatggtgac

SEQ ID NO: 5876 - DNA, 20 bp, Artificial Sequence
  B2M targeting sequence
tatatcataaatttacttat

SEQ ID NO: 5877 - DNA, 20 bp, Artificial Sequence
  B2M targeting sequence
taaatttacttatttattca

SEQ ID NO: 5878 - DNA, 20 bp, Artificial Sequence
  B2M targeting sequence
cttagtcatttgttaaataa

SEQ ID NO: 5879 - DNA, 20 bp, Artificial Sequence
  B2M targeting sequence
tttgttaaataaatatggag

SEQ ID NO: 5880 - DNA, 20 bp, Artificial Sequence
  B2M targeting sequence
atatttatttaacaaatgac

SEQ ID NO: 5881 - DNA, 20 bp, Artificial Sequence
  B2M targeting sequence
actttgtgccgggcactctt

SEQ ID NO: 5882 - DNA, 20 bp, Artificial Sequence
  B2M targeting sequence
ttttagggtggttctgagaa

SEQ ID NO: 5883 - DNA, 20 bp, Artificial Sequence
  B2M targeting sequence
gagaaggggatggcaatgag

SEQ ID NO: 5884 - DNA, 20 bp, Artificial Sequence
  B2M targeting sequence
gaaccaccctaaaaagagtg

SEQ ID NO: 5885 - DNA, 20 bp, Artificial Sequence
  B2M targeting sequence
cagaaccaccctaaaaagag

SEQ ID NO: 5886 - DNA, 20 bp, Artificial Sequence
  B2M targeting sequence
ccttctcagaaccaccctaa

SEQ ID NO: 5887 - DNA, 20 bp, Artificial Sequence
  B2M targeting sequence
ttgccatccccttctcagaa

SEQ ID NO: 5888 - DNA, 20 bp, Artificial Sequence
  B2M targeting sequence
cattgccatccccttctcag

SEQ ID NO: 5889 - DNA, 20 bp, Artificial Sequence
  B2M targeting sequence
ctaagatgcaagactccagg

SEQ ID NO: 5890 - DNA, 20 bp, Artificial Sequence
  B2M targeting sequence
aagatgcaagactccaggca

SEQ ID NO: 5891 - DNA, 20 bp, Artificial Sequence
  B2M targeting sequence
tagagagcccttctcattgc

SEQ ID NO: 5892 - DNA, 20 bp, Artificial Sequence
  B2M targeting sequence
tgcatcttagagagcccttc

SEQ ID NO: 5893 - DNA, 20 bp, Artificial Sequence
  B2M targeting sequence
aggcaactgcttttacttcc

SEQ ID NO: 5894 - DNA, 20 bp, Artificial Sequence
  B2M targeting sequence
agtggttctttattttcaca

SEQ ID NO: 5895 - DNA, 20 bp, Artificial Sequence
  B2M targeting sequence
ttattttcacagctcattag

SEQ ID NO: 5896 - DNA, 20 bp, Artificial Sequence
  B2M targeting sequence
cagctcattagagcaaatta

SEQ ID NO: 5897 - DNA, 20 bp, Artificial Sequence
  B2M targeting sequence
ttagagcaaattaccacagc

SEQ ID NO: 5898 - DNA, 20 bp, Artificial Sequence
  B2M targeting sequence
aatgagctgtgaaaataaag

SEQ ID NO: 5899 - DNA, 20 bp, Artificial Sequence
  B2M targeting sequence
ctgctgtggtaatttgctct

SEQ ID NO: 5900 - DNA, 20 bp, Artificial Sequence
  B2M targeting sequence
ccctgctgtggtaatttgct

SEQ ID NO: 5901 - DNA, 20 bp, Artificial Sequence
  B2M targeting sequence
acctgtatctccctgctgtg

SEQ ID NO: 5902 - DNA, 20 bp, Artificial Sequence
  B2M targeting sequence
cttatccgaaaagcctggca

SEQ ID NO: 5903 - DNA, 20 bp, Artificial Sequence
  B2M targeting sequence
gaaaagcctggcaccagaag

SEQ ID NO: 5904 - DNA, 20 bp, Artificial Sequence
  B2M targeting sequence
gataagggatactcaacctg

SEQ ID NO: 5905 - DNA, 20 bp, Artificial Sequence
  B2M targeting sequence
ggtgccaggcttttcggata

SEQ ID NO: 5906 - DNA, 20 bp, Artificial Sequence
  B2M targeting sequence
aaaatttaaaacacttctgg

SEQ ID NO: 5907 - DNA, 20 bp, Artificial Sequence
  B2M targeting sequence
aaaaaaaatccaaaatttaa

SEQ ID NO: 5908 - DNA, 20 bp, Artificial Sequence
  B2M targeting sequence
aaaaatcaaaaaaaaatcca

SEQ ID NO: 5909 - DNA, 20 bp, Artificial Sequence
  B2M targeting sequence
gttgagcatctctaatgtga

SEQ ID NO: 5910 - DNA, 20 bp, Artificial Sequence
  B2M targeting sequence
actgataattaacaaatatt

SEQ ID NO: 5911 - DNA, 20 bp, Artificial Sequence
  B2M targeting sequence
ctaatgtgaaaatctaaaat

SEQ ID NO: 5912 - DNA, 20 bp, Artificial Sequence
  B2M targeting sequence
aatgtgaaaatctaaaatcc

SEQ ID NO: 5913 - DNA, 20 bp, Artificial Sequence
  B2M targeting sequence
cattagagatgctcaactga

SEQ ID NO: 5914 - DNA, 20 bp, Artificial Sequence
  B2M targeting sequence
aaaatccaaaatgccccagt

SEQ ID NO: 5915 - DNA, 20 bp, Artificial Sequence
  B2M targeting sequence
aaaatgccccagtgaccctt

SEQ ID NO: 5916 - DNA, 20 bp, Artificial Sequence
  B2M targeting sequence
ctggggcattttggatttta

SEQ ID NO: 5917 - DNA, 20 bp, Artificial Sequence
  B2M targeting sequence
tttgagcatcatgttggtgc

SEQ ID NO: 5918 - DNA, 20 bp, Artificial Sequence
  B2M targeting sequence
aaggaaagggtcactggggc

SEQ ID NO: 5919 - DNA, 20 bp, Artificial Sequence
  B2M targeting sequence
tgttggtgctcaaaaagttt

SEQ ID NO: 5920 - DNA, 20 bp, Artificial Sequence
  B2M targeting sequence
aaaagtttgagatgttggag

SEQ ID NO: 5921 - DNA, 20 bp, Artificial Sequence
  B2M targeting sequence
aactttttgagcaccaacat

SEQ ID NO: 5922 - DNA, 20 bp, Artificial Sequence
  B2M targeting sequence
caaactttttgagcaccaac

SEQ ID NO: 5923 - DNA, 20 bp, Artificial Sequence
  B2M targeting sequence
aacatctcaaactttttgag

SEQ ID NO: 5924 - DNA, 20 bp, Artificial Sequence
  B2M targeting sequence
taaatgctccaacatctcaa

SEQ ID NO: 5925 - DNA, 20 bp, Artificial Sequence
  B2M targeting sequence
gatttttggattaaggatac

SEQ ID NO: 5926 - DNA, 20 bp, Artificial Sequence
  B2M targeting sequence
gaaatcctaaatgctccaac

SEQ ID NO: 5927 - DNA, 20 bp, Artificial Sequence
  B2M targeting sequence
aaaaatctgaaatcctaaat

SEQ ID NO: 5928 - DNA, 20 bp, Artificial Sequence
  B2M targeting sequence
ttaatccaaaaatctgaaat

SEQ ID NO: 5929 - DNA, 20 bp, Artificial Sequence
  B2M targeting sequence
ttttgtacaatggaaaactt

SEQ ID NO: 5930 - DNA, 20 bp, Artificial Sequence
  B2M targeting sequence
attgtacaaaatgagtatcc

SEQ ID NO: 5931 - DNA, 20 bp, Artificial Sequence
  B2M targeting sequence
tggcactaatctgatgaaag

SEQ ID NO: 5932 - DNA, 20 bp, Artificial Sequence
  B2M targeting sequence
gatgaaagaagaaactacgg

SEQ ID NO: 5933 - DNA, 20 bp, Artificial Sequence
  B2M targeting sequence
gattagtgccaagaagtttt

SEQ ID NO: 5934 - DNA, 20 bp, Artificial Sequence
  B2M targeting sequence
tcagattagtgccaagaagt

SEQ ID NO: 5935 - DNA, 20 bp, Artificial Sequence
  B2M targeting sequence
ttcatcagattagtgccaag

SEQ ID NO: 5936 - DNA, 20 bp, Artificial Sequence
  B2M targeting sequence
tctttcatcagattagtgcc

SEQ ID NO: 5937 - DNA, 20 bp, Artificial Sequence
  B2M targeting sequence
cgtagtttcttctttcatca

SEQ ID NO: 5938 - DNA, 20 bp, Artificial Sequence
  B2M targeting sequence
cccgtagtttcttctttcat

SEQ ID NO: 5939 - DNA, 20 bp, Artificial Sequence
  B2M targeting sequence
ctttccctaaaaggctttca

SEQ ID NO: 5940 - DNA, 20 bp, Artificial Sequence
  B2M targeting sequence
ctaaaaggctttcagtaaca

SEQ ID NO: 5941 - DNA, 20 bp, Artificial Sequence
  B2M targeting sequence
gtaacaagatggccctgact

SEQ ID NO: 5942 - DNA, 20 bp, Artificial Sequence
  B2M targeting sequence
tgttactgaaagccttttag

SEQ ID NO: 5943 - DNA, 20 bp, Artificial Sequence
  B2M targeting sequence
gggccatcttgttactgaaa

SEQ ID NO: 5944 - DNA, 20 bp, Artificial Sequence
  B2M targeting sequence
ttctggacagttcctccaaa

SEQ ID NO: 5945 - DNA, 20 bp, Artificial Sequence
  B2M targeting sequence
ggacagttcctccaaaggta

SEQ ID NO: 5946 - DNA, 20 bp, Artificial Sequence
  B2M targeting sequence
agaatgagtcagggccatct

SEQ ID NO: 5947 - DNA, 20 bp, Artificial Sequence
  B2M targeting sequence
tccaaaggtaggcctacagg

SEQ ID NO: 5948 - DNA, 20 bp, Artificial Sequence
  B2M targeting sequence
aaaggtaggcctacaggtag

SEQ ID NO: 5949 - DNA, 20 bp, Artificial Sequence
  B2M targeting sequence
acctgtaggcctacctttgg

SEQ ID NO: 5950 - DNA, 20 bp, Artificial Sequence
  B2M targeting sequence
tttctggcagcataggggtt

SEQ ID NO: 5951 - DNA, 20 bp, Artificial Sequence
  B2M targeting sequence
ggcagcataggggttttcca

SEQ ID NO: 5952 - DNA, 20 bp, Artificial Sequence
  B2M targeting sequence
agaatgaaggtgtatttttt

SEQ ID NO: 5953 - DNA, 20 bp, Artificial Sequence
  B2M targeting sequence
ggaaaacccctatgctgcca

SEQ ID NO: 5954 - DNA, 20 bp, Artificial Sequence
  B2M targeting sequence
ttctggaaaacccctatgct

SEQ ID NO: 5955 - DNA, 20 bp, Artificial Sequence
  B2M targeting sequence
gtaaaaaaaaaatacacctt

SEQ ID NO: 5956 - DNA, 20 bp, Artificial Sequence
  B2M targeting sequence
tggcctcagtaaaaaaaaaa

SEQ ID NO: 5957 - DNA, 20 bp, Artificial Sequence
  B2M targeting sequence
cctttcctggcctcagtaaa

SEQ ID NO: 5958 - DNA, 20 bp, Artificial Sequence
  B2M targeting sequence
tcacctttcctggcctcagt

SEQ ID NO: 5959 - DNA, 20 bp, Artificial Sequence
  B2M targeting sequence
cttcacctttcctggcctca

SEQ ID NO: 5960 - DNA, 20 bp, Artificial Sequence
  B2M targeting sequence
ttctcttcacctttcctggc

SEQ ID NO: 5961 - DNA, 20 bp, Artificial Sequence
  B2M targeting sequence
tagtgacgatgcagcaacca

SEQ ID NO: 5962 - DNA, 20 bp, Artificial Sequence
  B2M targeting sequence
ctaggaacccttcattctct

SEQ ID NO: 5963 - DNA, 20 bp, Artificial Sequence
  B2M targeting sequence
tcactaggaacccttcattc

SEQ ID NO: 5964 - DNA, 20 bp, Artificial Sequence
  B2M targeting sequence
tttatgtaatggagccttat

SEQ ID NO: 5965 - DNA, 20 bp, Artificial Sequence
  B2M targeting sequence
attacataaatgacttggtt

SEQ ID NO: 5966 - DNA, 20 bp, Artificial Sequence
  B2M targeting sequence
gacagatttctaggatagaa

SEQ ID NO: 5967 - DNA, 20 bp, Artificial Sequence
  B2M targeting sequence
gataaggctccattacataa

SEQ ID NO: 5968 - DNA, 20 bp, Artificial Sequence
  B2M targeting sequence
gtcagataaggctccattac

SEQ ID NO: 5969 - DNA, 20 bp, Artificial Sequence
  B2M targeting sequence
aggatagaaactcagtatcc

SEQ ID NO: 5970 - DNA, 20 bp, Artificial Sequence
  B2M targeting sequence
tagaaatctgtcagataagg

SEQ ID NO: 5971 - DNA, 20 bp, Artificial Sequence
  B2M targeting sequence
atcctagaaatctgtcagat

SEQ ID NO: 5972 - DNA, 20 bp, Artificial Sequence
  B2M targeting sequence
gtatccaagctcaggcttgg

SEQ ID NO: 5973 - DNA, 20 bp, Artificial Sequence
  B2M targeting sequence
aagctcaggcttggcagact

SEQ ID NO: 5974 - DNA, 20 bp, Artificial Sequence
  B2M targeting sequence
ggcttggcagactgaggtgg

SEQ ID NO: 5975 - DNA, 20 bp, Artificial Sequence
  B2M targeting sequence
gccaagcctgagcttggata

SEQ ID NO: 5976 - DNA, 20 bp, Artificial Sequence
  B2M targeting sequence
gtctgccaagcctgagcttg

SEQ ID NO: 5977 - DNA, 20 bp, Artificial Sequence
  B2M targeting sequence
ccaggattgcagtgtggatt

SEQ ID NO: 5978 - DNA, 20 bp, Artificial Sequence
  B2M targeting sequence
tggggacggtgcccacctca

SEQ ID NO: 5979 - DNA, 20 bp, Artificial Sequence
  B2M targeting sequence
acactgcaatcctggggacg

SEQ ID NO: 5980 - DNA, 20 bp, Artificial Sequence
  B2M targeting sequence
aatccacactgcaatcctgg

SEQ ID NO: 5981 - DNA, 20 bp, Artificial Sequence
  B2M targeting sequence
accccaatcatattcaacag

SEQ ID NO: 5982 - DNA, 20 bp, Artificial Sequence
  B2M targeting sequence
tattcaacagctccctttcc

SEQ ID NO: 5983 - DNA, 20 bp, Artificial Sequence
  B2M targeting sequence
acagctccctttcccccaac

SEQ ID NO: 5984 - DNA, 20 bp, Artificial Sequence
  B2M targeting sequence
ctttcccccaacaacccctt

SEQ ID NO: 5985 - DNA, 20 bp, Artificial Sequence
  B2M targeting sequence
cccaacaacccctttttata

SEQ ID NO: 5986 - DNA, 20 bp, Artificial Sequence
  B2M targeting sequence
ccacaaaacaattgttataa

SEQ ID NO: 5987 - DNA, 20 bp, Artificial Sequence
  B2M targeting sequence
tttactaatatgatcatgaa

SEQ ID NO: 5988 - DNA, 20 bp, Artificial Sequence
  B2M targeting sequence
tattagtaaaagaatcacca

SEQ ID NO: 5989 - DNA, 20 bp, Artificial Sequence
  B2M targeting sequence
tgaaaattaagtaatttagc

SEQ ID NO: 5990 - DNA, 20 bp, Artificial Sequence
  B2M targeting sequence
tgatcatattagtaaaagaa

SEQ ID NO: 5991 - DNA, 20 bp, Artificial Sequence
  B2M targeting sequence
caagctaaattacttaattt

SEQ ID NO: 5992 - DNA, 20 bp, Artificial Sequence
  B2M targeting sequence
agcttggctgcactgctggt

SEQ ID NO: 5993 - DNA, 20 bp, Artificial Sequence
  B2M targeting sequence
ttataccagcagtgcagcca

SEQ ID NO: 5994 - DNA, 20 bp, Artificial Sequence
  B2M targeting sequence
ggcacttctttataccagca

SEQ ID NO: 5995 - DNA, 20 bp, Artificial Sequence
  B2M targeting sequence
taggcagttgcaagtgtctg

SEQ ID NO: 5996 - DNA, 20 bp, Artificial Sequence
  B2M targeting sequence
ctgtgaaccagcggcatgga

SEQ ID NO: 5997 - DNA, 20 bp, Artificial Sequence
  B2M targeting sequence
gtgaaccagcggcatggaag

SEQ ID NO: 5998 - DNA, 20 bp, Artificial Sequence
  B2M targeting sequence
cagagatcctaggcagttgc

SEQ ID NO: 5999 - DNA, 20 bp, Artificial Sequence
  B2M targeting sequence
atgccgctggttcacagaga

SEQ ID NO: 6000 - DNA, 20 bp, Artificial Sequence
  B2M targeting sequence
tccatgccgctggttcacag

SEQ ID NO: 6001 - DNA, 20 bp, Artificial Sequence
  B2M targeting sequence
gtcttccatgccgctggttc

SEQ ID NO: 6002 - DNA, 20 bp, Artificial Sequence
  B2M targeting sequence
cagtcttccatgccgctggt

SEQ ID NO: 6003 - DNA, 20 bp, Artificial Sequence
  B2M targeting sequence
agcgtgcctctcagtcttcc

SEQ ID NO: 6004 - DNA, 20 bp, Artificial Sequence
  B2M targeting sequence
atccagcgtgcctctcagtc

SEQ ID NO: 6005 - DNA, 20 bp, Artificial Sequence
  B2M targeting sequence
gattcaagtatggtattgca

SEQ ID NO: 6006 - DNA, 20 bp, Artificial Sequence
  B2M targeting sequence
gagccatcaatccagcgtgc

SEQ ID NO: 6007 - DNA, 20 bp, Artificial Sequence
  B2M targeting sequence
agtatggtattgcaggttct

SEQ ID NO: 6008 - DNA, 20 bp, Artificial Sequence
  B2M targeting sequence
ggtgtaattttctaaaatgg

SEQ ID NO: 6009 - DNA, 20 bp, Artificial Sequence
  B2M targeting sequence
aaaatggcgaaaatctctag

SEQ ID NO: 6010 - DNA, 20 bp, Artificial Sequence
  B2M targeting sequence
ccattttagaaaattacacc

SEQ ID NO: 6011 - DNA, 20 bp, Artificial Sequence
  B2M targeting sequence
ctaggtaaaactccaaaaat

SEQ ID NO: 6012 - DNA, 20 bp, Artificial Sequence
  B2M targeting sequence
aggtaaaactccaaaaataa

SEQ ID NO: 6013 - DNA, 20 bp, Artificial Sequence
  B2M targeting sequence
aaaaataaaaaaccaacata

SEQ ID NO: 6014 - DNA, 20 bp, Artificial Sequence
  B2M targeting sequence
tcctttgagttacctggtag

SEQ ID NO: 6015 - DNA, 20 bp, Artificial Sequence
  B2M targeting sequence
tttgagttacctggtagtta

SEQ ID NO: 6016 - DNA, 20 bp, Artificial Sequence
  B2M targeting sequence
aaggaagatgtatgttggtt

SEQ ID NO: 6017 - DNA, 20 bp, Artificial Sequence
  B2M targeting sequence
tggaaaattcagtgtatatg

SEQ ID NO: 6018 - DNA, 20 bp, Artificial Sequence
  B2M targeting sequence
aggaatataactaccaggta

SEQ ID NO: 6019 - DNA, 20 bp, Artificial Sequence
  B2M targeting sequence
gtgtatatgagcctgaggta

SEQ ID NO: 6020 - DNA, 20 bp, Artificial Sequence
  B2M targeting sequence
tatacactgaattttccagg

SEQ ID NO: 6021 - DNA, 20 bp, Artificial Sequence
  B2M targeting sequence
ggctcatatacactgaattt

SEQ ID NO: 6022 - DNA, 20 bp, Artificial Sequence
  B2M targeting sequence
actacctcaggctcatatac

SEQ ID NO: 6023 - DNA, 20 bp, Artificial Sequence
  B2M targeting sequence
ataaatactcaagaaataaa

SEQ ID NO: 6024 - DNA, 20 bp, Artificial Sequence
  B2M targeting sequence
agaaataaaaaaataaaaaa

SEQ ID NO: 6025 - DNA, 20 bp, Artificial Sequence
  B2M targeting sequence
tgagtatttattgaccatct

SEQ ID NO: 6026 - DNA, 20 bp, Artificial Sequence
  B2M targeting sequence
tacatgtccttggtgcttgt

SEQ ID NO: 6027 - DNA, 20 bp, Artificial Sequence
  B2M targeting sequence
ttggtgcttgtaagcccaga

SEQ ID NO: 6028 - DNA, 20 bp, Artificial Sequence
  B2M targeting sequence
gggcttacaagcaccaagga

SEQ ID NO: 6029 - DNA, 20 bp, Artificial Sequence
  B2M targeting sequence
aaaaaaaagcctgcatataa

SEQ ID NO: 6030 - DNA, 20 bp, Artificial Sequence
  B2M targeting sequence
gtccaaaaaaaagcctgcat

SEQ ID NO: 6031 - DNA, 20 bp, Artificial Sequence
  B2M targeting sequence
ctgttgcccaggctggagtg

SEQ ID NO: 6032 - DNA, 20 bp, Artificial Sequence
  B2M targeting sequence
gttgcccaggctggagtgaa

SEQ ID NO: 6033 - DNA, 20 bp, Artificial Sequence
  B2M targeting sequence
agcctgggcaacagagactc

SEQ ID NO: 6034 - DNA, 20 bp, Artificial Sequence
  B2M targeting sequence
ctccagcctgggcaacagag

SEQ ID NO: 6035 - DNA, 20 bp, Artificial Sequence
  B2M targeting sequence
ccacttcactccagcctggg

SEQ ID NO: 6036 - DNA, 20 bp, Artificial Sequence
  B2M targeting sequence
cgccacttcactccagcctg

SEQ ID NO: 6037 - DNA, 20 bp, Artificial Sequence
  B2M targeting sequence
gggctcactgcaacctccac

SEQ ID NO: 6038 - DNA, 20 bp, Artificial Sequence
  B2M targeting sequence
ctgcaacctccacctcctgg

SEQ ID NO: 6039 - DNA, 20 bp, Artificial Sequence
  B2M targeting sequence
acctcctgggttcaagcgat

SEQ ID NO: 6040 - DNA, 20 bp, Artificial Sequence
  B2M targeting sequence
tgggttcaagcgatcctcct

SEQ ID NO: 6041 - DNA, 20 bp, Artificial Sequence
  B2M targeting sequence
agcgatcctcctgcctcagc

SEQ ID NO: 6042 - DNA, 20 bp, Artificial Sequence
  B2M targeting sequence
cttgaacccaggaggtggag

SEQ ID NO: 6043 - DNA, 20 bp, Artificial Sequence
  B2M targeting sequence
tcctgcctcagcctcctgag

SEQ ID NO: 6044 - DNA, 20 bp, Artificial Sequence
  B2M targeting sequence
tgcctcagcctcctgagtag

SEQ ID NO: 6045 - DNA, 20 bp, Artificial Sequence
  B2M targeting sequence
gcctcctgagtagctgggat

SEQ ID NO: 6046 - DNA, 20 bp, Artificial Sequence
  B2M targeting sequence
tgagtagctgggattacagg

SEQ ID NO: 6047 - DNA, 20 bp, Artificial Sequence
  B2M targeting sequence
ggaggctgaggcaggaggat

SEQ ID NO: 6048 - DNA, 20 bp, Artificial Sequence
  B2M targeting sequence
cagctactcaggaggctgag

SEQ ID NO: 6049 - DNA, 20 bp, Artificial Sequence
  B2M targeting sequence
gctgatctttgtatttttag

SEQ ID NO: 6050 - DNA, 20 bp, Artificial Sequence
  B2M targeting sequence
gctgagggtggtggcgcgtg

SEQ ID NO: 6051 - DNA, 20 bp, Artificial Sequence
  B2M targeting sequence
ttgtatttttagtagagaag

SEQ ID NO: 6052 - DNA, 20 bp, Artificial Sequence
  B2M targeting sequence
actaaaaatacaaagatcag

SEQ ID NO: 6053 - DNA, 20 bp, Artificial Sequence
  B2M targeting sequence
ctactaaaaatacaaagatc

SEQ ID NO: 6054 - DNA, 20 bp, Artificial Sequence
  B2M targeting sequence
ccatgttggccaggctgatg

SEQ ID NO: 6055 - DNA, 20 bp, Artificial Sequence
  B2M targeting sequence
gcctggccaacatggtgaaa

SEQ ID NO: 6056 - DNA, 20 bp, Artificial Sequence
  B2M targeting sequence
acatcagcctggccaacatg

SEQ ID NO: 6057 - DNA, 20 bp, Artificial Sequence
  B2M targeting sequence
tgacctcaagtgatccgccc

SEQ ID NO: 6058 - DNA, 20 bp, Artificial Sequence
  B2M targeting sequence
ggagttctacatcagcctgg

SEQ ID NO: 6059 - DNA, 20 bp, Artificial Sequence
  B2M targeting sequence
agtgatccgcccacctcggc

SEQ ID NO: 6060 - DNA, 20 bp, Artificial Sequence
  B2M targeting sequence
cttgaggtcaggagttctac

SEQ ID NO: 6061 - DNA, 20 bp, Artificial Sequence
  B2M targeting sequence
gcccacctcggcctcccaaa

SEQ ID NO: 6062 - DNA, 20 bp, Artificial Sequence
  B2M targeting sequence
gcctcccaaagtgttgggat

SEQ ID NO: 6063 - DNA, 20 bp, Artificial Sequence
  B2M targeting sequence
caaagtgttgggattacagg

SEQ ID NO: 6064 - DNA, 20 bp, Artificial Sequence
  B2M targeting sequence
caacactttgggaggccgag

SEQ ID NO: 6065 - DNA, 20 bp, Artificial Sequence
  B2M targeting sequence
cgcctgtaatcccaacactt

SEQ ID NO: 6066 - DNA, 20 bp, Artificial Sequence
  B2M targeting sequence
cagcgcccggctgctttttt

SEQ ID NO: 6067 - DNA, 20 bp, Artificial Sequence
  B2M targeting sequence
gcaagcacacttaatgtata

SEQ ID NO: 6068 - DNA, 20 bp, Artificial Sequence
  B2M targeting sequence
tctgcaagcacacttaatgt

SEQ ID NO: 6069 - DNA, 20 bp, Artificial Sequence
  B2M targeting sequence
cagtcctctgcaagcacact

SEQ ID NO: 6070 - DNA, 20 bp, Artificial Sequence
  B2M targeting sequence
ggccctcggcctcttaataa

SEQ ID NO: 6071 - DNA, 20 bp, Artificial Sequence
  B2M targeting sequence
gcctcttaataaatactcca

SEQ ID NO: 6072 - DNA, 20 bp, Artificial Sequence
  B2M targeting sequence
taataaatactccaagtgac

SEQ ID NO: 6073 - DNA, 20 bp, Artificial Sequence
  B2M targeting sequence
aagtgacttcattggaacaa

SEQ ID NO: 6074 - DNA, 20 bp, Artificial Sequence
  B2M targeting sequence
cttggagtatttattaagag

SEQ ID NO: 6075 - DNA, 20 bp, Artificial Sequence
  B2M targeting sequence
ttggaacaaccactgagaat

SEQ ID NO: 6076 - DNA, 20 bp, Artificial Sequence
  B2M targeting sequence
aatgaagtcacttggagtat

SEQ ID NO: 6077 - DNA, 20 bp, Artificial Sequence
  B2M targeting sequence
gtggttgttccaatgaagtc

SEQ ID NO: 6078 - DNA, 20 bp, Artificial Sequence
  B2M targeting sequence
cagtggttgttccaatgaag

SEQ ID NO: 6079 - DNA, 20 bp, Artificial Sequence
  B2M targeting sequence
cttatctagagagtgggaag

SEQ ID NO: 6080 - DNA, 20 bp, Artificial Sequence
  B2M targeting sequence
agagagtgggaagttgctga

SEQ ID NO: 6081 - DNA, 20 bp, Artificial Sequence
  B2M targeting sequence
agataagtgattctcagtgg

SEQ ID NO: 6082 - DNA, 20 bp, Artificial Sequence
  B2M targeting sequence
ctagataagtgattctcagt

SEQ ID NO: 6083 - DNA, 20 bp, Artificial Sequence
  B2M targeting sequence
cactctctagataagtgatt

SEQ ID NO: 6084 - DNA, 20 bp, Artificial Sequence
  B2M targeting sequence
gcaacttcccactctctaga

SEQ ID NO: 6085 - DNA, 20 bp, Artificial Sequence
  B2M targeting sequence
catcactgcatggggtgggg

SEQ ID NO: 6086 - DNA, 20 bp, Artificial Sequence
  B2M targeting sequence
tcactgcatggggtggggtg

SEQ ID NO: 6087 - DNA, 20 bp, Artificial Sequence
  B2M targeting sequence
ctgcatggggtggggtgagg

SEQ ID NO: 6088 - DNA, 20 bp, Artificial Sequence
  B2M targeting sequence
ccccaccccatgcagtgatg

SEQ ID NO: 6089 - DNA, 20 bp, Artificial Sequence
  B2M targeting sequence
ctcaccccaccccatgcagt

SEQ ID NO: 6090 - DNA, 20 bp, Artificial Sequence
  B2M targeting sequence
cctttctcggaaagcagctg

SEQ ID NO: 6091 - DNA, 20 bp, Artificial Sequence
  B2M targeting sequence
cggaaagcagctggctttga

SEQ ID NO: 6092 - DNA, 20 bp, Artificial Sequence
  B2M targeting sequence
gaaagcagctggctttgaag

SEQ ID NO: 6093 - DNA, 20 bp, Artificial Sequence
  B2M targeting sequence
gagaaaggggaagggcaggg

SEQ ID NO: 6094 - DNA, 20 bp, Artificial Sequence
  B2M targeting sequence
aagccagctgctttccgaga

SEQ ID NO: 6095 - DNA, 20 bp, Artificial Sequence
  B2M targeting sequence
tcaaagccagctgctttccg

SEQ ID NO: 6096 - DNA, 20 bp, Artificial Sequence
  B2M targeting sequence
ttcttcaaagccagctgctt

SEQ ID NO: 6097 - DNA, 20 bp, Artificial Sequence
  B2M targeting sequence
ctttcttcaaagccagctgc

SEQ ID NO: 6098 - DNA, 20 bp, Artificial Sequence
  B2M targeting sequence
tggtttctctttcttcaaag

SEQ ID NO: 6099 - DNA, 20 bp, Artificial Sequence
  B2M targeting sequence
cgtcctggtttctctttctt

SEQ ID NO: 6100 - DNA, 20 bp, Artificial Sequence
  B2M targeting sequence
tgatttctaatctgaaacag

SEQ ID NO: 6101 - DNA, 20 bp, Artificial Sequence
  B2M targeting sequence
ggactttcccgtcctggttt

SEQ ID NO: 6102 - DNA, 20 bp, Artificial Sequence
  B2M targeting sequence
aatctgaaacagcgcttttt

SEQ ID NO: 6103 - DNA, 20 bp, Artificial Sequence
  B2M targeting sequence
gaaacagcgctttttgtcca

SEQ ID NO: 6104 - DNA, 20 bp, Artificial Sequence
  B2M targeting sequence
gattagaaatcaggactttc

SEQ ID NO: 6105 - DNA, 20 bp, Artificial Sequence
  B2M targeting sequence
agagaccggtgacgagcgac

SEQ ID NO: 6106 - DNA, 20 bp, Artificial Sequence
  B2M targeting sequence
ggacaaaaagcgctgtttca

SEQ ID NO: 6107 - DNA, 20 bp, Artificial Sequence
  B2M targeting sequence
ctggacaaaaagcgctgttt

SEQ ID NO: 6108 - DNA, 20 bp, Artificial Sequence
  B2M targeting sequence
ccggtctctggacaaaaagc

SEQ ID NO: 6109 - DNA, 20 bp, Artificial Sequence
  B2M targeting sequence
tcaccggtctctggacaaaa

SEQ ID NO: 6110 - DNA, 20 bp, Artificial Sequence
  B2M targeting sequence
ctcgtcaccggtctctggac

SEQ ID NO: 6111 - DNA, 20 bp, Artificial Sequence
  B2M targeting sequence
ggttttgattgggcagttcg

SEQ ID NO: 6112 - DNA, 20 bp, Artificial Sequence
  B2M targeting sequence
aaacccgagcccagggtcgc

SEQ ID NO: 6113 - DNA, 20 bp, Artificial Sequence
  B2M targeting sequence
gaaactgtaaaagcgaatta

SEQ ID NO: 6114 - DNA, 20 bp, Artificial Sequence
  B2M targeting sequence
gaactgcccaatcaaaaccc

SEQ ID NO: 6115 - DNA, 20 bp, Artificial Sequence
  B2M targeting sequence
cttttacagtttccgaactg

SEQ ID NO: 6116 - DNA, 20 bp, Artificial Sequence
  B2M targeting sequence
cccttttaattcgcttttac

SEQ ID NO: 6117 - DNA, 20 bp, Artificial Sequence
  B2M targeting sequence
agttccgggagtttgcacgc

SEQ ID NO: 6118 - DNA, 20 bp, Artificial Sequence
  B2M targeting sequence
gggagtttgcacgcagacgc

SEQ ID NO: 6119 - DNA, 20 bp, Artificial Sequence
  B2M targeting sequence
cggaactggataggctaaaa

SEQ ID NO: 6120 - DNA, 20 bp, Artificial Sequence
  B2M targeting sequence
gcgtgcaaactcccggaact

SEQ ID NO: 6121 - DNA, 20 bp, Artificial Sequence
  B2M targeting sequence
gcttcgtgaccttggctctg

SEQ ID NO: 6122 - DNA, 20 bp, Artificial Sequence
  B2M targeting sequence
tgaccttggctctgctctgt

SEQ ID NO: 6123 - DNA, 20 bp, Artificial Sequence
  B2M targeting sequence
cgaagcagagcgtctgcgtg

SEQ ID NO: 6124 - DNA, 20 bp, Artificial Sequence
  B2M targeting sequence
gctctgtgggcgccgccccc

SEQ ID NO: 6125 - DNA, 20 bp, Artificial Sequence
  B2M targeting sequence
gtgggcgccgcccccagcct

SEQ ID NO: 6126 - DNA, 20 bp, Artificial Sequence
  B2M targeting sequence
atcgtcgagtaccttctcct

SEQ ID NO: 6127 - DNA, 20 bp, Artificial Sequence
  B2M targeting sequence
tcgagtaccttctcctctgc

SEQ ID NO: 6128 - DNA, 20 bp, Artificial Sequence
  B2M targeting sequence
agtaccttctcctctgcctc

SEQ ID NO: 6129 - DNA, 20 bp, Artificial Sequence
  B2M targeting sequence
acgatggacgcgcccaggct

SEQ ID NO: 6130 - DNA, 20 bp, Artificial Sequence
  B2M targeting sequence
cctctgcctccccctccctc

SEQ ID NO: 6131 - DNA, 20 bp, Artificial Sequence
  B2M targeting sequence
tctgcctccccctccctctg

SEQ ID NO: 6132 - DNA, 20 bp, Artificial Sequence
  B2M targeting sequence
gcctccccctccctctgctt

SEQ ID NO: 6133 - DNA, 20 bp, Artificial Sequence
  B2M targeting sequence
ccctccctctgcttctatct

SEQ ID NO: 6134 - DNA, 20 bp, Artificial Sequence
  B2M targeting sequence
ctctgcttctatctctctcc

SEQ ID NO: 6135 - DNA, 20 bp, Artificial Sequence
  B2M targeting sequence
gcttctatctctctccaatt

SEQ ID NO: 6136 - DNA, 20 bp, Artificial Sequence
  B2M targeting sequence
atctctctccaattgccctc

SEQ ID NO: 6137 - DNA, 20 bp, Artificial Sequence
  B2M targeting sequence
ctctccaattgccctccctg

SEQ ID NO: 6138 - DNA, 20 bp, Artificial Sequence
  B2M targeting sequence
ctccaattgccctccctggc

SEQ ID NO: 6139 - DNA, 20 bp, Artificial Sequence
  B2M targeting sequence
ccaattgccctccctggcct

SEQ ID NO: 6140 - DNA, 20 bp, Artificial Sequence
  B2M targeting sequence
aattgccctccctggcctgc

SEQ ID NO: 6141 - DNA, 20 bp, Artificial Sequence
  B2M targeting sequence
ctggcctgcggccgcccggt

SEQ ID NO: 6142 - DNA, 20 bp, Artificial Sequence
  B2M targeting sequence
tccttcccagcccagtgcag

SEQ ID NO: 6143 - DNA, 20 bp, Artificial Sequence
  B2M targeting sequence
ttcccagcccagtgcagcca

SEQ ID NO: 6144 - DNA, 20 bp, Artificial Sequence
  B2M targeting sequence
cagcccagtgcagccaggca

SEQ ID NO: 6145 - DNA, 20 bp, Artificial Sequence
  B2M targeting sequence
gcttgctcaggtctctgtcc

SEQ ID NO: 6146 - DNA, 20 bp, Artificial Sequence
  B2M targeting sequence
ggtctctgtccgggactggg

SEQ ID NO: 6147 - DNA, 20 bp, Artificial Sequence
  B2M targeting sequence
ctgtccgggactgggaagcc

SEQ ID NO: 6148 - DNA, 20 bp, Artificial Sequence
  B2M targeting sequence
gtccgggactgggaagccac

SEQ ID NO: 6149 - DNA, 20 bp, Artificial Sequence
  B2M targeting sequence
gggactgggaagccacggag

SEQ ID NO: 6150 - DNA, 20 bp, Artificial Sequence
  B2M targeting sequence
cggacagagacctgagcaag

SEQ ID NO: 6151 - DNA, 20 bp, Artificial Sequence
  B2M targeting sequence
cagtcccggacagagacctg

SEQ ID NO: 6152 - DNA, 20 bp, Artificial Sequence
  B2M targeting sequence
gtggcttcccagtcccggac

SEQ ID NO: 6153 - DNA, 20 bp, Artificial Sequence
  B2M targeting sequence
cggccctccgtggcttccca

SEQ ID NO: 6154 - DNA, 20 bp, Artificial Sequence
  B2M targeting sequence
tggagctcaagcttcctact

SEQ ID NO: 6155 - DNA, 20 bp, Artificial Sequence
  B2M targeting sequence
aggagtgtgccactttcccg

SEQ ID NO: 6156 - DNA, 20 bp, Artificial Sequence
  B2M targeting sequence
agcttcctactctctcatcg

SEQ ID NO: 6157 - DNA, 20 bp, Artificial Sequence
  B2M targeting sequence
tactctctcatcgctgaata

SEQ ID NO: 6158 - DNA, 20 bp, Artificial Sequence
  B2M targeting sequence
ctcatcgctgaataactacc

SEQ ID NO: 6159 - DNA, 20 bp, Artificial Sequence
  B2M targeting sequence
catcgctgaataactaccgg

SEQ ID NO: 6160 - DNA, 20 bp, Artificial Sequence
  B2M targeting sequence
tcgctgaataactaccgggc

SEQ ID NO: 6161 - DNA, 20 bp, Artificial Sequence
  B2M targeting sequence
ctgaataactaccgggcagg

SEQ ID NO: 6162 - DNA, 20 bp, Artificial Sequence
  B2M targeting sequence
gcgatgagagagtaggaagc

SEQ ID NO: 6163 - DNA, 20 bp, Artificial Sequence
  B2M targeting sequence
tgcccggtagttattcagcg

SEQ ID NO: 6164 - DNA, 20 bp, Artificial Sequence
  B2M targeting sequence
acccagtcctgcccggtagt

SEQ ID NO: 6165 - DNA, 20 bp, Artificial Sequence
  B2M targeting sequence
gttccacccagtcctgcccg

SEQ ID NO: 6166 - DNA, 20 bp, Artificial Sequence
  B2M targeting sequence
ttgatgggctgctgggtgga

SEQ ID NO: 6167 - DNA, 20 bp, Artificial Sequence
  B2M targeting sequence
atgacctaaatatgctgtct

SEQ ID NO: 6168 - DNA, 20 bp, Artificial Sequence
  B2M targeting sequence
acccagcagcccatcaatga

SEQ ID NO: 6169 - DNA, 20 bp, Artificial Sequence
  B2M targeting sequence
atccacccagcagcccatca

SEQ ID NO: 6170 - DNA, 20 bp, Artificial Sequence
  B2M targeting sequence
agctccatccacccagcagc

SEQ ID NO: 6171 - DNA, 20 bp, Artificial Sequence
  B2M targeting sequence
ctttccagctccatccaccc

SEQ ID NO: 6172 - DNA, 20 bp, Artificial Sequence
  B2M targeting sequence
ggggctgcccaggttccttc

SEQ ID NO: 6173 - DNA, 20 bp, Artificial Sequence
  B2M targeting sequence
ttccgagggctcgcttttcc

SEQ ID NO: 6174 - DNA, 20 bp, Artificial Sequence
  B2M targeting sequence
gagggctcgcttttcctggg

SEQ ID NO: 6175 - DNA, 20 bp, Artificial Sequence
  B2M targeting sequence
gaaggaacctgggcagcccc

SEQ ID NO: 6176 - DNA, 20 bp, Artificial Sequence
  B2M targeting sequence
cttttcctgggcagagcggg

SEQ ID NO: 6177 - DNA, 20 bp, Artificial Sequence
  B2M targeting sequence
tgggcagagcgggaaagagg

SEQ ID NO: 6178 - DNA, 20 bp, Artificial Sequence
  B2M targeting sequence
gcccaggaaaagcgagccct

SEQ ID NO: 6179 - DNA, 20 bp, Artificial Sequence
  B2M targeting sequence
cgctctgcccaggaaaagcg

SEQ ID NO: 6180 - DNA, 20 bp, Artificial Sequence
  B2M targeting sequence
ttcccgctctgcccaggaaa

SEQ ID NO: 6181 - DNA, 20 bp, Artificial Sequence
  B2M targeting sequence
tctttcccgctctgcccagg

SEQ ID NO: 6182 - DNA, 20 bp, Artificial Sequence
  B2M targeting sequence
cgaaacgcaaatagtcgaga

SEQ ID NO: 6183 - DNA, 20 bp, Artificial Sequence
  B2M targeting sequence
cgaccggcctgcccctcctc

SEQ ID NO: 6184 - DNA, 20 bp, Artificial Sequence
  B2M targeting sequence
agaatagcgatccggggaga

SEQ ID NO: 6185 - DNA, 20 bp, Artificial Sequence
  B2M targeting sequence
actatttgcgtttcgcgacc

SEQ ID NO: 6186 - DNA, 20 bp, Artificial Sequence
  B2M targeting sequence
cgactatttgcgtttcgcga

SEQ ID NO: 6187 - DNA, 20 bp, Artificial Sequence
  B2M targeting sequence
ctattctcgactatttgcgt

SEQ ID NO: 6188 - DNA, 20 bp, Artificial Sequence
  B2M targeting sequence
ggggagaagcaggtgtctgt

SEQ ID NO: 6189 - DNA, 20 bp, Artificial Sequence
  B2M targeting sequence
ccggatcgctattctcgact

SEQ ID NO: 6190 - DNA, 20 bp, Artificial Sequence
  B2M targeting sequence
ccccggatcgctattctcga

SEQ ID NO: 6191 - DNA, 20 bp, Artificial Sequence
  B2M targeting sequence
gtggggcccaagagaagtac

SEQ ID NO: 6192 - DNA, 20 bp, Artificial Sequence
  B2M targeting sequence
tgggccccacagacacctgc

SEQ ID NO: 6193 - DNA, 20 bp, Artificial Sequence
  B2M targeting sequence
cttgggccccacagacacct

SEQ ID NO: 6194 - DNA, 20 bp, Artificial Sequence
  B2M targeting sequence
cggtaagtaggccggtgcat

SEQ ID NO: 6195 - DNA, 20 bp, Artificial Sequence
  B2M targeting sequence
gtaagtaggccggtgcatgc

SEQ ID NO: 6196 - DNA, 20 bp, Artificial Sequence
  B2M targeting sequence
cctgcatgcaccggcctact

SEQ ID NO: 6197 - DNA, 20 bp, Artificial Sequence
  B2M targeting sequence
gcgctcccctgcatgcaccg

SEQ ID NO: 6198 - DNA, 20 bp, Artificial Sequence
  B2M targeting sequence
ctggggtccgcccgttttcc

SEQ ID NO: 6199 - DNA, 20 bp, Artificial Sequence
  B2M targeting sequence
ggggtccgcccgttttcctg

SEQ ID NO: 6200 - DNA, 20 bp, Artificial Sequence
  B2M targeting sequence
gcccgttttcctgctgggct

SEQ ID NO: 6201 - DNA, 20 bp, Artificial Sequence
  B2M targeting sequence
tgctgggcttctcatttcct

SEQ ID NO: 6202 - DNA, 20 bp, Artificial Sequence
  B2M targeting sequence
catttcctcactaggttcta

SEQ ID NO: 6203 - DNA, 20 bp, Artificial Sequence
  B2M targeting sequence
tttcctcactaggttctacg

SEQ ID NO: 6204 - DNA, 20 bp, Artificial Sequence
  B2M targeting sequence
tcactaggttctacggtttg

SEQ ID NO: 6205 - DNA, 20 bp, Artificial Sequence
  B2M targeting sequence
ctaggttctacggtttgccg

SEQ ID NO: 6206 - DNA, 20 bp, Artificial Sequence
  B2M targeting sequence
acggtttgccgatctaaatc

SEQ ID NO: 6207 - DNA, 20 bp, Artificial Sequence
  B2M targeting sequence
gcaaaccgtagaacctagtg

SEQ ID NO: 6208 - DNA, 20 bp, Artificial Sequence
  B2M targeting sequence
aaatccagttcgtgtcctat

SEQ ID NO: 6209 - DNA, 20 bp, Artificial Sequence
  B2M targeting sequence
agttcgtgtcctattgtatt

SEQ ID NO: 6210 - DNA, 20 bp, Artificial Sequence
  B2M targeting sequence
tgtcctattgtattgtgtaa

SEQ ID NO: 6211 - DNA, 20 bp, Artificial Sequence
  B2M targeting sequence
tattgtattgtgtaacattt

SEQ ID NO: 6212 - DNA, 20 bp, Artificial Sequence
  B2M targeting sequence
ttgtttattgagatatagtt

SEQ ID NO: 6213 - DNA, 20 bp, Artificial Sequence
  B2M targeting sequence
ataaacaaagatgtaagctg

SEQ ID NO: 6214 - DNA, 20 bp, Artificial Sequence
  B2M targeting sequence
caataaacaaagatgtaagc

SEQ ID NO: 6215 - DNA, 20 bp, Artificial Sequence
  B2M targeting sequence
caaaccatacaattaacata

SEQ ID NO: 6216 - DNA, 20 bp, Artificial Sequence
  B2M targeting sequence
gtgggttttagtatattcac

SEQ ID NO: 6217 - DNA, 20 bp, Artificial Sequence
  B2M targeting sequence
cagggttgtgtaaccacctc

SEQ ID NO: 6218 - DNA, 20 bp, Artificial Sequence
  B2M targeting sequence
attttaggacattttcgtca

SEQ ID NO: 6219 - DNA, 20 bp, Artificial Sequence
  B2M targeting sequence
taaaattgaggtggttacac

SEQ ID NO: 6220 - DNA, 20 bp, Artificial Sequence
  B2M targeting sequence
tcactcccaaaagaaatttt

SEQ ID NO: 6221 - DNA, 20 bp, Artificial Sequence
  B2M targeting sequence
ctcccaaaagaaattttgta

SEQ ID NO: 6222 - DNA, 20 bp, Artificial Sequence
  B2M targeting sequence
caaaagaaattttgtaccag

SEQ ID NO: 6223 - DNA, 20 bp, Artificial Sequence
  B2M targeting sequence
tttgggagtgacgaaaatgt

SEQ ID NO: 6224 - DNA, 20 bp, Artificial Sequence
  B2M targeting sequence
gtgtcactcccatttctccc

SEQ ID NO: 6225 - DNA, 20 bp, Artificial Sequence
  B2M targeting sequence
ctcccatttctcccaaaccc

SEQ ID NO: 6226 - DNA, 20 bp, Artificial Sequence
  B2M targeting sequence
catttctcccaaacccctag

SEQ ID NO: 6227 - DNA, 20 bp, Artificial Sequence
  B2M targeting sequence
cccaaacccctagtcctagg

SEQ ID NO: 6228 - DNA, 20 bp, Artificial Sequence
  B2M targeting sequence
caaacccctagtcctaggaa

SEQ ID NO: 6229 - DNA, 20 bp, Artificial Sequence
  B2M targeting sequence
taggaaaccaccaatctttc

SEQ ID NO: 6230 - DNA, 20 bp, Artificial Sequence
  B2M targeting sequence
taggactaggggtttgggag

SEQ ID NO: 6231 - DNA, 20 bp, Artificial Sequence
  B2M targeting sequence
ttctgtctctatgggtttgc

SEQ ID NO: 6232 - DNA, 20 bp, Artificial Sequence
  B2M targeting sequence
gtctctatgggtttgcctat

SEQ ID NO: 6233 - DNA, 20 bp, Artificial Sequence
  B2M targeting sequence
ctatgggtttgcctattagt

SEQ ID NO: 6234 - DNA, 20 bp, Artificial Sequence
  B2M targeting sequence
atgggtttgcctattagtat

SEQ ID NO: 6235 - DNA, 20 bp, Artificial Sequence
  B2M targeting sequence
tagaaacagaaacatataat

SEQ ID NO: 6236 - DNA, 20 bp, Artificial Sequence
  B2M targeting sequence
atgaaatactaataggcaaa

SEQ ID NO: 6237 - DNA, 20 bp, Artificial Sequence
  B2M targeting sequence
gtttctatgaaatactaata

SEQ ID NO: 6238 - DNA, 20 bp, Artificial Sequence
  B2M targeting sequence
tttgtaactggcttctgttt

SEQ ID NO: 6239 - DNA, 20 bp, Artificial Sequence
  B2M targeting sequence
gttttcaaaggtcgtcatat

SEQ ID NO: 6240 - DNA, 20 bp, Artificial Sequence
  B2M targeting sequence
aaggtcgtcatattgtagca

SEQ ID NO: 6241 - DNA, 20 bp, Artificial Sequence
  B2M targeting sequence
tcatattgtagcaaggatca

SEQ ID NO: 6242 - DNA, 20 bp, Artificial Sequence
  B2M targeting sequence
tattgtagcaaggatcagtt

SEQ ID NO: 6243 - DNA, 20 bp, Artificial Sequence
  B2M targeting sequence
ttgctacaatatgacgacct

SEQ ID NO: 6244 - DNA, 20 bp, Artificial Sequence
  B2M targeting sequence
gttcttcattcctatttatt

SEQ ID NO: 6245 - DNA, 20 bp, Artificial Sequence
  B2M targeting sequence
tcattcctatttattgatga

SEQ ID NO: 6246 - DNA, 20 bp, Artificial Sequence
  B2M targeting sequence
ttcctatttattgatgaata

SEQ ID NO: 6247 - DNA, 20 bp, Artificial Sequence
  B2M targeting sequence
tatttattgatgaatattac

SEQ ID NO: 6248 - DNA, 20 bp, Artificial Sequence
  B2M targeting sequence
ataaataggaatgaagaact

SEQ ID NO: 6249 - DNA, 20 bp, Artificial Sequence
  B2M targeting sequence
tcaataaataggaatgaaga

SEQ ID NO: 6250 - DNA, 20 bp, Artificial Sequence
  B2M targeting sequence
actgtatagatatactaagt

SEQ ID NO: 6251 - DNA, 20 bp, Artificial Sequence
  B2M targeting sequence
atacagtagagtaatattca

SEQ ID NO: 6252 - DNA, 20 bp, Artificial Sequence
  B2M targeting sequence
atctatagttaatgggcatt

SEQ ID NO: 6253 - DNA, 20 bp, Artificial Sequence
  B2M targeting sequence
atagttaatgggcatttgga

SEQ ID NO: 6254 - DNA, 20 bp, Artificial Sequence
  B2M targeting sequence
aaatgcccattaactataga

SEQ ID NO: 6255 - DNA, 20 bp, Artificial Sequence
  B2M targeting sequence
actcttcggctactgagaat

SEQ ID NO: 6256 - DNA, 20 bp, Artificial Sequence
  B2M targeting sequence
tcggctactgagaataaaat

SEQ ID NO: 6257 - DNA, 20 bp, Artificial Sequence
  B2M targeting sequence
gctactgagaataaaatgtg

SEQ ID NO: 6258 - DNA, 20 bp, Artificial Sequence
  B2M targeting sequence
gtagccgaagagtggaaaca

SEQ ID NO: 6259 - DNA, 20 bp, Artificial Sequence
  B2M targeting sequence
cagtagccgaagagtggaaa

SEQ ID NO: 6260 - DNA, 20 bp, Artificial Sequence
  B2M targeting sequence
atattcatgtataaattttt

SEQ ID NO: 6261 - DNA, 20 bp, Artificial Sequence
  B2M targeting sequence
tgtataaatttttggtgtgg

SEQ ID NO: 6262 - DNA, 20 bp, Artificial Sequence
  B2M targeting sequence
acaccaaaaatttatacatg

SEQ ID NO: 6263 - DNA, 20 bp, Artificial Sequence
  B2M targeting sequence
atgtccacaccaaaaattta

SEQ ID NO: 6264 - DNA, 20 bp, Artificial Sequence
  B2M targeting sequence
attctcttgagtatatatgc

SEQ ID NO: 6265 - DNA, 20 bp, Artificial Sequence
  B2M targeting sequence
cttgagtatatatgcaggag

SEQ ID NO: 6266 - DNA, 20 bp, Artificial Sequence
  B2M targeting sequence
tgagtatatatgcaggagtg

SEQ ID NO: 6267 - DNA, 20 bp, Artificial Sequence
  B2M targeting sequence
agagaattgaaaatctatgt

SEQ ID NO: 6268 - DNA, 20 bp, Artificial Sequence
  B2M targeting sequence
tgcatatatactcaagagaa

SEQ ID NO: 6269 - DNA, 20 bp, Artificial Sequence
  B2M targeting sequence
actcctgcatatatactcaa

SEQ ID NO: 6270 - DNA, 20 bp, Artificial Sequence
  B2M targeting sequence
cccagcaattccactcctgc

SEQ ID NO: 6271 - DNA, 20 bp, Artificial Sequence
  B2M targeting sequence
atgtttaatcttttaaggaa

SEQ ID NO: 6272 - DNA, 20 bp, Artificial Sequence
  B2M targeting sequence
tttaaggaactactaggctg

SEQ ID NO: 6273 - DNA, 20 bp, Artificial Sequence
  B2M targeting sequence
ttaaaagattaaacatagag

SEQ ID NO: 6274 - DNA, 20 bp, Artificial Sequence
  B2M targeting sequence
ccaaagctgaatgtaccatt

SEQ ID NO: 6275 - DNA, 20 bp, Artificial Sequence
  B2M targeting sequence
aaagctgaatgtaccattgt

SEQ ID NO: 6276 - DNA, 20 bp, Artificial Sequence
  B2M targeting sequence
gctttggagaacagcctagt

SEQ ID NO: 6277 - DNA, 20 bp, Artificial Sequence
  B2M targeting sequence
tacacaatggtacattcagc

SEQ ID NO: 6278 - DNA, 20 bp, Artificial Sequence
  B2M targeting sequence
catacacaatggtacattca

SEQ ID NO: 6279 - DNA, 20 bp, Artificial Sequence
  B2M targeting sequence
aatttttctacatcctcacc

SEQ ID NO: 6280 - DNA, 20 bp, Artificial Sequence
  B2M targeting sequence
acatcctcaccaatactttt

SEQ ID NO: 6281 - DNA, 20 bp, Artificial Sequence
  B2M targeting sequence
tcaccaatacttttaatctt

SEQ ID NO: 6282 - DNA, 20 bp, Artificial Sequence
  B2M targeting sequence
ccaatacttttaatcttttt

SEQ ID NO: 6283 - DNA, 20 bp, Artificial Sequence
  B2M targeting sequence
ttttttattataaccattct

SEQ ID NO: 6284 - DNA, 20 bp, Artificial Sequence
  B2M targeting sequence
agtggatacgaaatggtatc

SEQ ID NO: 6285 - DNA, 20 bp, Artificial Sequence
  B2M targeting sequence
actagaatggttataataaa

SEQ ID NO: 6286 - DNA, 20 bp, Artificial Sequence
  B2M targeting sequence
tatccactagaatggttata

SEQ ID NO: 6287 - DNA, 20 bp, Artificial Sequence
  B2M targeting sequence
ctttatggttttgatttgta

SEQ ID NO: 6288 - DNA, 20 bp, Artificial Sequence
  B2M targeting sequence
ttatggttttgatttgtatt

SEQ ID NO: 6289 - DNA, 20 bp, Artificial Sequence
  B2M targeting sequence
aaaccataaagagataccat

SEQ ID NO: 6290 - DNA, 20 bp, Artificial Sequence
  B2M targeting sequence
ctaatgactatgcattattt

SEQ ID NO: 6291 - DNA, 20 bp, Artificial Sequence
  B2M targeting sequence
ttagggaaatacaaatcaaa

SEQ ID NO: 6292 - DNA, 20 bp, Artificial Sequence
  B2M targeting sequence
ttgtaaaaattaattagctt

SEQ ID NO: 6293 - DNA, 20 bp, Artificial Sequence
  B2M targeting sequence
cagcatgtaaatctttgtaa

SEQ ID NO: 6294 - DNA, 20 bp, Artificial Sequence
  B2M targeting sequence
aaatcacagcatgtaaatct

SEQ ID NO: 6295 - DNA, 20 bp, Artificial Sequence
  B2M targeting sequence
aggtcacatgctcaaaagtc

SEQ ID NO: 6296 - DNA, 20 bp, Artificial Sequence
  B2M targeting sequence
catgctcaaaagtcacagag

SEQ ID NO: 6297 - DNA, 20 bp, Artificial Sequence
  B2M targeting sequence
aaagtcacagagcctagacc

SEQ ID NO: 6298 - DNA, 20 bp, Artificial Sequence
  B2M targeting sequence
cagagcctagacccaaacca

SEQ ID NO: 6299 - DNA, 20 bp, Artificial Sequence
  B2M targeting sequence
gtgacttttgagcatgtgac

SEQ ID NO: 6300 - DNA, 20 bp, Artificial Sequence
  B2M targeting sequence
aggctctgtgacttttgagc

SEQ ID NO: 6301 - DNA, 20 bp, Artificial Sequence
  B2M targeting sequence
atggctaatgctcgaactcc

SEQ ID NO: 6302 - DNA, 20 bp, Artificial Sequence
  B2M targeting sequence
aactccatcctctctttcct

SEQ ID NO: 6303 - DNA, 20 bp, Artificial Sequence
  B2M targeting sequence
agcattagccatagaaaggc

SEQ ID NO: 6304 - DNA, 20 bp, Artificial Sequence
  B2M targeting sequence
atcctctctttcctagaagg

SEQ ID NO: 6305 - DNA, 20 bp, Artificial Sequence
  B2M targeting sequence
tctctttcctagaaggcaat

SEQ ID NO: 6306 - DNA, 20 bp, Artificial Sequence
  B2M targeting sequence
ctttcctagaaggcaatctg

SEQ ID NO: 6307 - DNA, 20 bp, Artificial Sequence
  B2M targeting sequence
ttcctagaaggcaatctggg

SEQ ID NO: 6308 - DNA, 20 bp, Artificial Sequence
  B2M targeting sequence
tagaaggcaatctgggataa

SEQ ID NO: 6309 - DNA, 20 bp, Artificial Sequence
  B2M targeting sequence
aggaaagagaggatggagtt

SEQ ID NO: 6310 - DNA, 20 bp, Artificial Sequence
  B2M targeting sequence
gggataaatttttcagaact

SEQ ID NO: 6311 - DNA, 20 bp, Artificial Sequence
  B2M targeting sequence
cagattgccttctaggaaag

SEQ ID NO: 6312 - DNA, 20 bp, Artificial Sequence
  B2M targeting sequence
gaactccatttgttgcctct

SEQ ID NO: 6313 - DNA, 20 bp, Artificial Sequence
  B2M targeting sequence
gaaaaatttatcccagattg

SEQ ID NO: 6314 - DNA, 20 bp, Artificial Sequence
  B2M targeting sequence
atttgttgcctctgttagaa

SEQ ID NO: 6315 - DNA, 20 bp, Artificial Sequence
  B2M targeting sequence
gttagaaagaaaacactggg

SEQ ID NO: 6316 - DNA, 20 bp, Artificial Sequence
  B2M targeting sequence
aacagaggcaacaaatggag

SEQ ID NO: 6317 - DNA, 20 bp, Artificial Sequence
  B2M targeting sequence
ttctaacagaggcaacaaat

SEQ ID NO: 6318 - DNA, 20 bp, Artificial Sequence
  B2M targeting sequence
tgcccagtgttttctttcta

SEQ ID NO: 6319 - DNA, 20 bp, Artificial Sequence
  B2M targeting sequence
tcttgcccagtgttttcttt

SEQ ID NO: 6320 - DNA, 20 bp, Artificial Sequence
  B2M targeting sequence
acttgcaggttcatcttgcc

SEQ ID NO: 6321 - DNA, 20 bp, Artificial Sequence
  B2M targeting sequence
tatttgcttttaggagtatg

SEQ ID NO: 6322 - DNA, 20 bp, Artificial Sequence
  B2M targeting sequence
taaaagcaaataagaaataa

SEQ ID NO: 6323 - DNA, 20 bp, Artificial Sequence
  B2M targeting sequence
ttacatactcctaaaagcaa

SEQ ID NO: 6324 - DNA, 20 bp, Artificial Sequence
  B2M targeting sequence
ccttacatactcctaaaagc

SEQ ID NO: 6325 - DNA, 20 bp, Artificial Sequence
  B2M targeting sequence
cccgtttttactttataaaa

SEQ ID NO: 6326 - DNA, 20 bp, Artificial Sequence
  B2M targeting sequence
cgtttttactttataaaaaa

SEQ ID NO: 6327 - DNA, 20 bp, Artificial Sequence
  B2M targeting sequence
ttttttataaagtaaaaacg

SEQ ID NO: 6328 - DNA, 20 bp, Artificial Sequence
  B2M targeting sequence
ctcattttttataaagtaaa

SEQ ID NO: 6329 - DNA, 20 bp, Artificial Sequence
  B2M targeting sequence
tgcctgtgatcccagcactt

SEQ ID NO: 6330 - DNA, 20 bp, Artificial Sequence
  B2M targeting sequence
caggcatgagccacagcgct

SEQ ID NO: 6331 - DNA, 20 bp, Artificial Sequence
  B2M targeting sequence
cagcactttgggagaccgag

SEQ ID NO: 6332 - DNA, 20 bp, Artificial Sequence
  B2M targeting sequence
caaagtgctgggatcacagg

SEQ ID NO: 6333 - DNA, 20 bp, Artificial Sequence
  B2M targeting sequence
cccaaagtgctgggatcaca

SEQ ID NO: 6334 - DNA, 20 bp, Artificial Sequence
  B2M targeting sequence
gtctcccaaagtgctgggat

SEQ ID NO: 6335 - DNA, 20 bp, Artificial Sequence
  B2M targeting sequence
gcctgcctcggtctcccaaa

SEQ ID NO: 6336 - DNA, 20 bp, Artificial Sequence
  B2M targeting sequence
cctgaggtcaggagtttgat

SEQ ID NO: 6337 - DNA, 20 bp, Artificial Sequence
  B2M targeting sequence
ggtgatctgcctgcctcggt

SEQ ID NO: 6338 - DNA, 20 bp, Artificial Sequence
  B2M targeting sequence
ggagtttgatatcagcctga

SEQ ID NO: 6339 - DNA, 20 bp, Artificial Sequence
  B2M targeting sequence
tgacctcaggtgatctgcct

SEQ ID NO: 6340 - DNA, 20 bp, Artificial Sequence
  B2M targeting sequence
aactcctgacctcaggtgat

SEQ ID NO: 6341 - DNA, 20 bp, Artificial Sequence
  B2M targeting sequence
gcctgaccaacatggcaaaa

SEQ ID NO: 6342 - DNA, 20 bp, Artificial Sequence
  B2M targeting sequence
ggctgatatcaaactcctga

SEQ ID NO: 6343 - DNA, 20 bp, Artificial Sequence
  B2M targeting sequence
ctgctaaaaatacaaaaatt

SEQ ID NO: 6344 - DNA, 20 bp, Artificial Sequence
  B2M targeting sequence
gctaaaaatacaaaaattag

SEQ ID NO: 6345 - DNA, 20 bp, Artificial Sequence
  B2M targeting sequence
agctatatgggaggctgagg

SEQ ID NO: 6346 - DNA, 20 bp, Artificial Sequence
  B2M targeting sequence
catatagctggaattacagg

SEQ ID NO: 6347 - DNA, 20 bp, Artificial Sequence
  B2M targeting sequence
gcctcccatatagctggaat

SEQ ID NO: 6348 - DNA, 20 bp, Artificial Sequence
  B2M targeting sequence
tgcctcagcctcccatatag

SEQ ID NO: 6349 - DNA, 20 bp, Artificial Sequence
  B2M targeting sequence
agcaatgttcatgcctcagc

SEQ ID NO: 6350 - DNA, 20 bp, Artificial Sequence
  B2M targeting sequence
ccggggttcaagcaatgttc

SEQ ID NO: 6351 - DNA, 20 bp, Artificial Sequence
  B2M targeting sequence
ccccggggttcaagcaatgt

SEQ ID NO: 6352 - DNA, 20 bp, Artificial Sequence
  B2M targeting sequence
gtctccccggggttcaagca

SEQ ID NO: 6353 - DNA, 20 bp, Artificial Sequence
  B2M targeting sequence
ctgcaacctccgtctccccg

SEQ ID NO: 6354 - DNA, 20 bp, Artificial Sequence
  B2M targeting sequence
tggctcactgcaacctccgt

SEQ ID NO: 6355 - DNA, 20 bp, Artificial Sequence
  B2M targeting sequence
agcctgggtgacagagtgag

SEQ ID NO: 6356 - DNA, 20 bp, Artificial Sequence
  B2M targeting sequence
cccaggctggagtgcagtgg

SEQ ID NO: 6357 - DNA, 20 bp, Artificial Sequence
  B2M targeting sequence
gtcacccaggctggagtgca

SEQ ID NO: 6358 - DNA, 20 bp, Artificial Sequence
  B2M targeting sequence
ctctgtcacccaggctggag

SEQ ID NO: 6359 - DNA, 20 bp, Artificial Sequence
  B2M targeting sequence
ttctcaaaaaaaaaaaaaag

SEQ ID NO: 6360 - DNA, 20 bp, Artificial Sequence
  B2M targeting sequence
caaaaaaaaaaaaaaggaaa

SEQ ID NO: 6361 - DNA, 20 bp, Artificial Sequence
  B2M targeting sequence
aaaaaaaaaaaaaggaaaga

SEQ ID NO: 6362 - DNA, 20 bp, Artificial Sequence
  B2M targeting sequence
ttttttttttttttgagaaa

SEQ ID NO: 6363 - DNA, 20 bp, Artificial Sequence
  B2M targeting sequence
ttccttttttttttttttga

SEQ ID NO: 6364 - DNA, 20 bp, Artificial Sequence
  B2M targeting sequence
ctttcctttttttttttttt

SEQ ID NO: 6365 - DNA, 20 bp, Artificial Sequence
  B2M targeting sequence
taattgaagtagtaaccctt

SEQ ID NO: 6366 - DNA, 20 bp, Artificial Sequence
  B2M targeting sequence
attaagagctttctctttcc

SEQ ID NO: 6367 - DNA, 20 bp, Artificial Sequence
  B2M targeting sequence
tgggtgttcaatgatattgt

SEQ ID NO: 6368 - DNA, 20 bp, Artificial Sequence
  B2M targeting sequence
atgatattgtgcttctcttc

SEQ ID NO: 6369 - DNA, 20 bp, Artificial Sequence
  B2M targeting sequence
ttgaacacccaagaaagggt

SEQ ID NO: 6370 - DNA, 20 bp, Artificial Sequence
  B2M targeting sequence
cttcatgtaagtgcccctta

SEQ ID NO: 6371 - DNA, 20 bp, Artificial Sequence
  B2M targeting sequence
tcatgtaagtgccccttaga

SEQ ID NO: 6372 - DNA, 20 bp, Artificial Sequence
  B2M targeting sequence
tgtaagtgccccttagattc

SEQ ID NO: 6373 - DNA, 20 bp, Artificial Sequence
  B2M targeting sequence
aaggggcacttacatgaaga

SEQ ID NO: 6374 - DNA, 20 bp, Artificial Sequence
  B2M targeting sequence
tcctcctcactaccatcagg

SEQ ID NO: 6375 - DNA, 20 bp, Artificial Sequence
  B2M targeting sequence
tcctcactaccatcaggtca

SEQ ID NO: 6376 - DNA, 20 bp, Artificial Sequence
  B2M targeting sequence
tcactaccatcaggtcatag

SEQ ID NO: 6377 - DNA, 20 bp, Artificial Sequence
  B2M targeting sequence
ctaccatcaggtcatagaat

SEQ ID NO: 6378 - DNA, 20 bp, Artificial Sequence
  B2M targeting sequence
ggtcatagaatagggagggg

SEQ ID NO: 6379 - DNA, 20 bp, Artificial Sequence
  B2M targeting sequence
tagaatagggaggggcactc

SEQ ID NO: 6380 - DNA, 20 bp, Artificial Sequence
  B2M targeting sequence
atgacctgatggtagtgagg

SEQ ID NO: 6381 - DNA, 20 bp, Artificial Sequence
  B2M targeting sequence
ctattctatgacctgatggt

SEQ ID NO: 6382 - DNA, 20 bp, Artificial Sequence
  B2M targeting sequence
gtttcaacagcagtggcctc

SEQ ID NO: 6383 - DNA, 20 bp, Artificial Sequence
  B2M targeting sequence
acagcagtggcctccaaatt

SEQ ID NO: 6384 - DNA, 20 bp, Artificial Sequence
  B2M targeting sequence
aaattttgttcaaatgcata

SEQ ID NO: 6385 - DNA, 20 bp, Artificial Sequence
  B2M targeting sequence
aatgcataactataaaaagt

SEQ ID NO: 6386 - DNA, 20 bp, Artificial Sequence
  B2M targeting sequence
ctatatatagctatacattt

SEQ ID NO: 6387 - DNA, 20 bp, Artificial Sequence
  B2M targeting sequence
atatatagctatacatttta

SEQ ID NO: 6388 - DNA, 20 bp, Artificial Sequence
  B2M targeting sequence
gtcttgatttagacattact

SEQ ID NO: 6389 - DNA, 20 bp, Artificial Sequence
  B2M targeting sequence
tgatttagacattactaaag

SEQ ID NO: 6390 - DNA, 20 bp, Artificial Sequence
  B2M targeting sequence
agactgatagtagtgtatgt

SEQ ID NO: 6391 - DNA, 20 bp, Artificial Sequence
  B2M targeting sequence
aaatcaagactgatagtagt

SEQ ID NO: 6392 - DNA, 20 bp, Artificial Sequence
  B2M targeting sequence
ctcattttttttcagttaaa

SEQ ID NO: 6393 - DNA, 20 bp, Artificial Sequence
  B2M targeting sequence
cattttttttcagttaaaaa

SEQ ID NO: 6394 - DNA, 20 bp, Artificial Sequence
  B2M targeting sequence
ttttttttcagttaaaaatt

SEQ ID NO: 6395 - DNA, 20 bp, Artificial Sequence
  B2M targeting sequence
gttaaaaattcagattgaac

SEQ ID NO: 6396 - DNA, 20 bp, Artificial Sequence
  B2M targeting sequence
gattgaactatcttacaaat

SEQ ID NO: 6397 - DNA, 20 bp, Artificial Sequence
  B2M targeting sequence
gaatttttaactgaaaaaaa

SEQ ID NO: 6398 - DNA, 20 bp, Artificial Sequence
  B2M targeting sequence
atctgaatttttaactgaaa

SEQ ID NO: 6399 - DNA, 20 bp, Artificial Sequence
  B2M targeting sequence
tacaaatggctcccagaaga

SEQ ID NO: 6400 - DNA, 20 bp, Artificial Sequence
  B2M targeting sequence
cagaagatccactccctgtg

SEQ ID NO: 6401 - DNA, 20 bp, Artificial Sequence
  B2M targeting sequence
gggagccatttgtaagatag

SEQ ID NO: 6402 - DNA, 20 bp, Artificial Sequence
  B2M targeting sequence
tctgggagccatttgtaaga

SEQ ID NO: 6403 - DNA, 20 bp, Artificial Sequence
  B2M targeting sequence
actccctgtgggaacacagc

SEQ ID NO: 6404 - DNA, 20 bp, Artificial Sequence
  B2M targeting sequence
ctgtgggaacacagcagttg

SEQ ID NO: 6405 - DNA, 20 bp, Artificial Sequence
  B2M targeting sequence
cacagggagtggatcttctg

SEQ ID NO: 6406 - DNA, 20 bp, Artificial Sequence
  B2M targeting sequence
acaactgctgtgttcccaca

SEQ ID NO: 6407 - DNA, 20 bp, Artificial Sequence
  B2M targeting sequence
cttccacaactgctgtgttc

SEQ ID NO: 6408 - DNA, 20 bp, Artificial Sequence
  B2M targeting sequence
tcacttccacaactgctgtg

SEQ ID NO: 6409 - DNA, 20 bp, Artificial Sequence
  B2M targeting sequence
tgtcttcacttccacaactg

SEQ ID NO: 6410 - DNA, 20 bp, Artificial Sequence
  B2M targeting sequence
agtcctgtcttcacttccac

SEQ ID NO: 6411 - DNA, 20 bp, Artificial Sequence
  B2M targeting sequence
gggtccagtcctgtcttcac

SEQ ID NO: 6412 - DNA, 20 bp, Artificial Sequence
  B2M targeting sequence
aatatgtggggaaatctgac

SEQ ID NO: 6413 - DNA, 20 bp, Artificial Sequence
  B2M targeting sequence
ccacatatttgaacccttat

SEQ ID NO: 6414 - DNA, 20 bp, Artificial Sequence
  B2M targeting sequence
gacctctaaattcttataag

SEQ ID NO: 6415 - DNA, 20 bp, Artificial Sequence
  B2M targeting sequence
gatttccccacatatttgaa

SEQ ID NO: 6416 - DNA, 20 bp, Artificial Sequence
  B2M targeting sequence
aaattcttataagtcagaga

SEQ ID NO: 6417 - DNA, 20 bp, Artificial Sequence
  B2M targeting sequence
tataagtcagagagtgactg

SEQ ID NO: 6418 - DNA, 20 bp, Artificial Sequence
  B2M targeting sequence
gagagtgactgaacaacagc

SEQ ID NO: 6419 - DNA, 20 bp, Artificial Sequence
  B2M targeting sequence
gacttataagaatttagagg

SEQ ID NO: 6420 - DNA, 20 bp, Artificial Sequence
  B2M targeting sequence
ctgacttataagaatttaga

SEQ ID NO: 6421 - DNA, 20 bp, Artificial Sequence
  B2M targeting sequence
ctctctgacttataagaatt

SEQ ID NO: 6422 - DNA, 20 bp, Artificial Sequence
  B2M targeting sequence
gtcactctctgacttataag

SEQ ID NO: 6423 - DNA, 20 bp, Artificial Sequence
  B2M targeting sequence
ctgctgttgttcagtcactc

SEQ ID NO: 6424 - DNA, 20 bp, Artificial Sequence
  B2M targeting sequence
cactgctgttgttcagtcac

SEQ ID NO: 6425 - DNA, 20 bp, Artificial Sequence
  B2M targeting sequence
aagagttttaatatctgctg

SEQ ID NO: 6426 - DNA, 20 bp, Artificial Sequence
  B2M targeting sequence
atgtctcactgctgttgttc

SEQ ID NO: 6427 - DNA, 20 bp, Artificial Sequence
  B2M targeting sequence
tcgatgtctcactgctgttg

SEQ ID NO: 6428 - DNA, 20 bp, Artificial Sequence
  B2M targeting sequence
gctgtaaaccttggcacaga

SEQ ID NO: 6429 - DNA, 20 bp, Artificial Sequence
  B2M targeting sequence
gtgccaaggtttacagcaga

SEQ ID NO: 6430 - DNA, 20 bp, Artificial Sequence
  B2M targeting sequence
tttacttctctaagactgaa

SEQ ID NO: 6431 - DNA, 20 bp, Artificial Sequence
  B2M targeting sequence
ctaagactgaatccaaaaag

SEQ ID NO: 6432 - DNA, 20 bp, Artificial Sequence
  B2M targeting sequence
aagactgaatccaaaaagca

SEQ ID NO: 6433 - DNA, 20 bp, Artificial Sequence
  B2M targeting sequence
tagagaagtaaatgatctgt

SEQ ID NO: 6434 - DNA, 20 bp, Artificial Sequence
  B2M targeting sequence
gtcttagagaagtaaatgat

SEQ ID NO: 6435 - DNA, 20 bp, Artificial Sequence
  B2M targeting sequence
aaaaagcacaatggaatact

SEQ ID NO: 6436 - DNA, 20 bp, Artificial Sequence
  B2M targeting sequence
attgtgctttttggattcag

SEQ ID NO: 6437 - DNA, 20 bp, Artificial Sequence
  B2M targeting sequence
gcttattatagtattccatt

SEQ ID NO: 6438 - DNA, 20 bp, Artificial Sequence
  B2M targeting sequence
cagcttattatagtattcca

SEQ ID NO: 6439 - DNA, 20 bp, Artificial Sequence
  B2M targeting sequence
ccatgctgtctcagcttatt

SEQ ID NO: 6440 - DNA, 20 bp, Artificial Sequence
  B2M targeting sequence
agacaagcctgagcattccc

SEQ ID NO: 6441 - DNA, 20 bp, Artificial Sequence
  B2M targeting sequence
ggaattcaccatgctgtctc

SEQ ID NO: 6442 - DNA, 20 bp, Artificial Sequence
  B2M targeting sequence
ggcttgtctggaattcacca

SEQ ID NO: 6443 - DNA, 20 bp, Artificial Sequence
  B2M targeting sequence
ctatagccagagaaggaggc

SEQ ID NO: 6444 - DNA, 20 bp, Artificial Sequence
  B2M targeting sequence
ggctatagggaatgctcagg

SEQ ID NO: 6445 - DNA, 20 bp, Artificial Sequence
  B2M targeting sequence
ctggctatagggaatgctca

SEQ ID NO: 6446 - DNA, 20 bp, Artificial Sequence
  B2M targeting sequence
ttctctggctatagggaatg

SEQ ID NO: 6447 - DNA, 20 bp, Artificial Sequence
  B2M targeting sequence
aaggctatgttaggtgttgg

SEQ ID NO: 6448 - DNA, 20 bp, Artificial Sequence
  B2M targeting sequence
gcatccaaggctatgttagg

SEQ ID NO: 6449 - DNA, 20 bp, Artificial Sequence
  B2M targeting sequence
gttctgcatccaaggctatg

SEQ ID NO: 6450 - DNA, 20 bp, Artificial Sequence
  B2M targeting sequence
atcagttctgcatccaaggc

SEQ ID NO: 6451 - DNA, 20 bp, Artificial Sequence
  B2M targeting sequence
ccaagttctatcagttctgc

SEQ ID NO: 6452 - DNA, 20 bp, Artificial Sequence
  B2M targeting sequence
ctttccccaagttctatcag

SEQ ID NO: 6453 - DNA, 20 bp, Artificial Sequence
  B2M targeting sequence
tcactttccccaagttctat

SEQ ID NO: 6454 - DNA, 20 bp, Artificial Sequence
  B2M targeting sequence
actacttcatcactttcccc

SEQ ID NO: 6455 - DNA, 20 bp, Artificial Sequence
  B2M targeting sequence
cctgtgaatctctagcacct

SEQ ID NO: 6456 - DNA, 20 bp, Artificial Sequence
  B2M targeting sequence
caggtgaggtcaactacttc

SEQ ID NO: 6457 - DNA, 20 bp, Artificial Sequence
  B2M targeting sequence
ctagcacctgtagtgattga

SEQ ID NO: 6458 - DNA, 20 bp, Artificial Sequence
  B2M targeting sequence
agcacctgtagtgattgacc

SEQ ID NO: 6459 - DNA, 20 bp, Artificial Sequence
  B2M targeting sequence
ctacaggtgctagagattca

SEQ ID NO: 6460 - DNA, 20 bp, Artificial Sequence
  B2M targeting sequence
atcactacaggtgctagaga

SEQ ID NO: 6461 - DNA, 20 bp, Artificial Sequence
  B2M targeting sequence
ccgtgactctgtagtgatta

SEQ ID NO: 6462 - DNA, 20 bp, Artificial Sequence
  B2M targeting sequence
cggtgagttaggtcaatcac

SEQ ID NO: 6463 - DNA, 20 bp, Artificial Sequence
  B2M targeting sequence
gtagtgattattgaacaaag

SEQ ID NO: 6464 - DNA, 20 bp, Artificial Sequence
  B2M targeting sequence
ctacagagtcacggtgagtt

SEQ ID NO: 6465 - DNA, 20 bp, Artificial Sequence
  B2M targeting sequence
ataatcactacagagtcacg

SEQ ID NO: 6466 - DNA, 20 bp, Artificial Sequence
  B2M targeting sequence
tttgttcaataatcactaca

SEQ ID NO: 6467 - DNA, 20 bp, Artificial Sequence
  B2M targeting sequence
tcctttgttcaataatcact

SEQ ID NO: 6468 - DNA, 20 bp, Artificial Sequence
  B2M targeting sequence
tggcctcctcctttgttcaa

SEQ ID NO: 6469 - DNA, 20 bp, Artificial Sequence
  B2M targeting sequence
aagaccacactggcagttgt

SEQ ID NO: 6470 - DNA, 20 bp, Artificial Sequence
  B2M targeting sequence
tggagtggccttgtgtttgc

SEQ ID NO: 6471 - DNA, 20 bp, Artificial Sequence
  B2M targeting sequence
ccacacaactgccagtgtgg

SEQ ID NO: 6472 - DNA, 20 bp, Artificial Sequence
  B2M targeting sequence
ttgttcaccacacaactgcc

SEQ ID NO: 6473 - DNA, 20 bp, Artificial Sequence
  B2M targeting sequence
tcattgttcaccacacaact

SEQ ID NO: 6474 - DNA, 20 bp, Artificial Sequence
  B2M targeting sequence
tcatcattgttcaccacaca

SEQ ID NO: 6475 - DNA, 20 bp, Artificial Sequence
  B2M targeting sequence
ctcctcatcattgttcacca

SEQ ID NO: 6476 - DNA, 20 bp, Artificial Sequence
  B2M targeting sequence
ctccctcctcatcattgttc

SEQ ID NO: 6477 - DNA, 20 bp, Artificial Sequence
  B2M targeting sequence
cttttcactccctcctcatc

SEQ ID NO: 6478 - DNA, 20 bp, Artificial Sequence
  B2M targeting sequence
gtcccttttcactccctcct

SEQ ID NO: 6479 - DNA, 20 bp, Artificial Sequence
  B2M targeting sequence
ctgtcccttttcactccctc

SEQ ID NO: 6480 - DNA, 20 bp, Artificial Sequence
  B2M targeting sequence
ctgcaaaaaaattttttttg

SEQ ID NO: 6481 - DNA, 20 bp, Artificial Sequence
  B2M targeting sequence
tatactacctggttatattc

SEQ ID NO: 6482 - DNA, 20 bp, Artificial Sequence
  B2M targeting sequence
gtgtcaagtttgcatggatg

SEQ ID NO: 6483 - DNA, 20 bp, Artificial Sequence
  B2M targeting sequence
agtttgcatggatggatgct

SEQ ID NO: 6484 - DNA, 20 bp, Artificial Sequence
  B2M targeting sequence
atgcaaacttgacactgaat

SEQ ID NO: 6485 - DNA, 20 bp, Artificial Sequence
  B2M targeting sequence
atccatgcaaacttgacact

SEQ ID NO: 6486 - DNA, 20 bp, Artificial Sequence
  B2M targeting sequence
gagattgaacttagtataca

SEQ ID NO: 6487 - DNA, 20 bp, Artificial Sequence
  B2M targeting sequence
gagcatccatccatgcaaac

SEQ ID NO: 6488 - DNA, 20 bp, Artificial Sequence
  B2M targeting sequence
ctgagcatccatccatgcaa

SEQ ID NO: 6489 - DNA, 20 bp, Artificial Sequence
  B2M targeting sequence
atctctgagcatccatccat

SEQ ID NO: 6490 - DNA, 20 bp, Artificial Sequence
  B2M targeting sequence
actctatagaatgtggccac

SEQ ID NO: 6491 - DNA, 20 bp, Artificial Sequence
  B2M targeting sequence
atagaatgtggccacatctg

SEQ ID NO: 6492 - DNA, 20 bp, Artificial Sequence
  B2M targeting sequence
atagagtagatgtgttgtat

SEQ ID NO: 6493 - DNA, 20 bp, Artificial Sequence
  B2M targeting sequence
gtagtcagtgcttctgcact

SEQ ID NO: 6494 - DNA, 20 bp, Artificial Sequence
  B2M targeting sequence
gtgcttctgcacttccttta

SEQ ID NO: 6495 - DNA, 20 bp, Artificial Sequence
  B2M targeting sequence
gcacttcctttacacatact

SEQ ID NO: 6496 - DNA, 20 bp, Artificial Sequence
  B2M targeting sequence
tttacacatactaacactgc

SEQ ID NO: 6497 - DNA, 20 bp, Artificial Sequence
  B2M targeting sequence
aacaaactgggcagtgttag

SEQ ID NO: 6498 - DNA, 20 bp, Artificial Sequence
  B2M targeting sequence
gcctccatcagtatcactgc

SEQ ID NO: 6499 - DNA, 20 bp, Artificial Sequence
  B2M targeting sequence
atcagtatcactgcagttat

SEQ ID NO: 6500 - DNA, 20 bp, Artificial Sequence
  B2M targeting sequence
gtatcactgcagttatatat

SEQ ID NO: 6501 - DNA, 20 bp, Artificial Sequence
  B2M targeting sequence
ctgcagttatatatgatgta

SEQ ID NO: 6502 - DNA, 20 bp, Artificial Sequence
  B2M targeting sequence
tatataactgcagtgatact

SEQ ID NO: 6503 - DNA, 20 bp, Artificial Sequence
  B2M targeting sequence
agacagatcctgtggctgga

SEQ ID NO: 6504 - DNA, 20 bp, Artificial Sequence
  B2M targeting sequence
tgagcaataaggcatacatc

SEQ ID NO: 6505 - DNA, 20 bp, Artificial Sequence
  B2M targeting sequence
gtcttgagcaataaggcata

SEQ ID NO: 6506 - DNA, 20 bp, Artificial Sequence
  B2M targeting sequence
tgtggctggatttttccatg

SEQ ID NO: 6507 - DNA, 20 bp, Artificial Sequence
  B2M targeting sequence
agccacaggatctgtcttga

SEQ ID NO: 6508 - DNA, 20 bp, Artificial Sequence
  B2M targeting sequence
atgtctttgtgcaggaacta

SEQ ID NO: 6509 - DNA, 20 bp, Artificial Sequence
  B2M targeting sequence
ttgtgcaggaactatgggtt

SEQ ID NO: 6510 - DNA, 20 bp, Artificial Sequence
  B2M targeting sequence
tgcacaaagacatggaaaaa

SEQ ID NO: 6511 - DNA, 20 bp, Artificial Sequence
  B2M targeting sequence
aatgctctgagcttaaaaat

SEQ ID NO: 6512 - DNA, 20 bp, Artificial Sequence
  B2M targeting sequence
gagcttaaaaatactgattt

SEQ ID NO: 6513 - DNA, 20 bp, Artificial Sequence
  B2M targeting sequence
gagcattggatgccaacaac

SEQ ID NO: 6514 - DNA, 20 bp, Artificial Sequence
  B2M targeting sequence
gtatttttaagctcagagca

SEQ ID NO: 6515 - DNA, 20 bp, Artificial Sequence
  B2M targeting sequence
gcagtatataagaaactctt

SEQ ID NO: 6516 - DNA, 20 bp, Artificial Sequence
  B2M targeting sequence
tatatactgcagatagcaat

SEQ ID NO: 6517 - DNA, 20 bp, Artificial Sequence
  B2M targeting sequence
ttgatttctcatatgctctg

SEQ ID NO: 6518 - DNA, 20 bp, Artificial Sequence
  B2M targeting sequence
aagagtttcttatatactgc

SEQ ID NO: 6519 - DNA, 20 bp, Artificial Sequence
  B2M targeting sequence
catatgctctgagactgctt

SEQ ID NO: 6520 - DNA, 20 bp, Artificial Sequence
  B2M targeting sequence
tatgctctgagactgctttt

SEQ ID NO: 6521 - DNA, 20 bp, Artificial Sequence
  B2M targeting sequence
gagactgctttttgtttcct

SEQ ID NO: 6522 - DNA, 20 bp, Artificial Sequence
  B2M targeting sequence
gagcatatgagaaatcaaag

SEQ ID NO: 6523 - DNA, 20 bp, Artificial Sequence
  B2M targeting sequence
cagagcatatgagaaatcaa

SEQ ID NO: 6524 - DNA, 20 bp, Artificial Sequence
  B2M targeting sequence
tttggttttatgcttcagct

SEQ ID NO: 6525 - DNA, 20 bp, Artificial Sequence
  B2M targeting sequence
gctctggacttcagttgcca

SEQ ID NO: 6526 - DNA, 20 bp, Artificial Sequence
  B2M targeting sequence
ggacttcagttgccagagtg

SEQ ID NO: 6527 - DNA, 20 bp, Artificial Sequence
  B2M targeting sequence
agagctgaagcataaaacca

SEQ ID NO: 6528 - DNA, 20 bp, Artificial Sequence
  B2M targeting sequence
gttgccagagtgtgccagat

SEQ ID NO: 6529 - DNA, 20 bp, Artificial Sequence
  B2M targeting sequence
ggcaactgaagtccagagct

SEQ ID NO: 6530 - DNA, 20 bp, Artificial Sequence
  B2M targeting sequence
ggcacactctggcaactgaa

SEQ ID NO: 6531 - DNA, 20 bp, Artificial Sequence
  B2M targeting sequence
tccttaaagcaactttccct

SEQ ID NO: 6532 - DNA, 20 bp, Artificial Sequence
  B2M targeting sequence
ttaaagcaactttccctttc

SEQ ID NO: 6533 - DNA, 20 bp, Artificial Sequence
  B2M targeting sequence
ctttcttatagtcatcaatt

SEQ ID NO: 6534 - DNA, 20 bp, Artificial Sequence
  B2M targeting sequence
tatagtcatcaatttttagt

SEQ ID NO: 6535 - DNA, 20 bp, Artificial Sequence
  B2M targeting sequence
tcaatttttagttggccaca

SEQ ID NO: 6536 - DNA, 20 bp, Artificial Sequence
  B2M targeting sequence
atttttagttggccacatgt

SEQ ID NO: 6537 - DNA, 20 bp, Artificial Sequence
  B2M targeting sequence
acatgtggccaactaaaaat

SEQ ID NO: 6538 - DNA, 20 bp, Artificial Sequence
  B2M targeting sequence
ggaccacataaataaagaca

SEQ ID NO: 6539 - DNA, 20 bp, Artificial Sequence
  B2M targeting sequence
agaatgtccacatgtggcca

SEQ ID NO: 6540 - DNA, 20 bp, Artificial Sequence
  B2M targeting sequence
ttatttatgtggtccagaat

SEQ ID NO: 6541 - DNA, 20 bp, Artificial Sequence
  B2M targeting sequence
agggtgttgtctttatttat

SEQ ID NO: 6542 - DNA, 20 bp, Artificial Sequence
  B2M targeting sequence
ctagggtgttgtctttattt

SEQ ID NO: 6543 - DNA, 20 bp, Artificial Sequence
  B2M targeting sequence
ccatctctagggtgttgtct

SEQ ID NO: 6544 - DNA, 20 bp, Artificial Sequence
  B2M targeting sequence
taagccccctaattgactga

SEQ ID NO: 6545 - DNA, 20 bp, Artificial Sequence
  B2M targeting sequence
attagggggcttaggatttt

SEQ ID NO: 6546 - DNA, 20 bp, Artificial Sequence
  B2M targeting sequence
gtcaattagggggcttagga

SEQ ID NO: 6547 - DNA, 20 bp, Artificial Sequence
  B2M targeting sequence
attcagtcaattagggggct

SEQ ID NO: 6548 - DNA, 20 bp, Artificial Sequence
  B2M targeting sequence
tgaccaaagtgaccccagaa

SEQ ID NO: 6549 - DNA, 20 bp, Artificial Sequence
  B2M targeting sequence
agaggggttccattcagtca

SEQ ID NO: 6550 - DNA, 20 bp, Artificial Sequence
  B2M targeting sequence
ctttggtcaagaggggttcc

SEQ ID NO: 6551 - DNA, 20 bp, Artificial Sequence
  B2M targeting sequence
ggggtcactttggtcaagag

SEQ ID NO: 6552 - DNA, 20 bp, Artificial Sequence
  B2M targeting sequence
gttttaaggtttttctgggg

SEQ ID NO: 6553 - DNA, 20 bp, Artificial Sequence
  B2M targeting sequence
tggccatgacgggatgggag

SEQ ID NO: 6554 - DNA, 20 bp, Artificial Sequence
  B2M targeting sequence
tggccaggaactcagtttta

SEQ ID NO: 6555 - DNA, 20 bp, Artificial Sequence
  B2M targeting sequence
cgtcatggccaggaactcag

SEQ ID NO: 6556 - DNA, 20 bp, Artificial Sequence
  B2M targeting sequence
catcccgtcatggccaggaa

SEQ ID NO: 6557 - DNA, 20 bp, Artificial Sequence
  B2M targeting sequence
gacacgcttcattatatctc

SEQ ID NO: 6558 - DNA, 20 bp, Artificial Sequence
  B2M targeting sequence
gacctcccatcccgtcatgg

SEQ ID NO: 6559 - DNA, 20 bp, Artificial Sequence
  B2M targeting sequence
ttatatctccgtctctttta

SEQ ID NO: 6560 - DNA, 20 bp, Artificial Sequence
  B2M targeting sequence
ccgtctcttttatggtttag

SEQ ID NO: 6561 - DNA, 20 bp, Artificial Sequence
  B2M targeting sequence
gtctcttttatggtttagac

SEQ ID NO: 6562 - DNA, 20 bp, Artificial Sequence
  B2M targeting sequence
cttttatggtttagacacaa

SEQ ID NO: 6563 - DNA, 20 bp, Artificial Sequence
  B2M targeting sequence
tttatggtttagacacaaca

SEQ ID NO: 6564 - DNA, 20 bp, Artificial Sequence
  B2M targeting sequence
aaaccataaaagagacggag

SEQ ID NO: 6565 - DNA, 20 bp, Artificial Sequence
  B2M targeting sequence
gttgttgtgtctaaaccata

SEQ ID NO: 6566 - DNA, 20 bp, Artificial Sequence
  B2M targeting sequence
aaataaagatcataaggctg

SEQ ID NO: 6567 - DNA, 20 bp, Artificial Sequence
  B2M targeting sequence
ttattttgacattaatgctg

SEQ ID NO: 6568 - DNA, 20 bp, Artificial Sequence
  B2M targeting sequence
taaggctgacagaatagacc

SEQ ID NO: 6569 - DNA, 20 bp, Artificial Sequence
  B2M targeting sequence
gccttatgatctttattttg

SEQ ID NO: 6570 - DNA, 20 bp, Artificial Sequence
  B2M targeting sequence
gtcagccttatgatctttat

SEQ ID NO: 6571 - DNA, 20 bp, Artificial Sequence
  B2M targeting sequence
attctgtcagccttatgatc

SEQ ID NO: 6572 - DNA, 20 bp, Artificial Sequence
  B2M targeting sequence
atggaataaaaattgtttct

SEQ ID NO: 6573 - DNA, 20 bp, Artificial Sequence
  B2M targeting sequence
attgaggactagttgctctc

SEQ ID NO: 6574 - DNA, 20 bp, Artificial Sequence
  B2M targeting sequence
agctgaagttttcttttcct

SEQ ID NO: 6575 - DNA, 20 bp, Artificial Sequence
  B2M targeting sequence
gctagaaacaatttttattc

SEQ ID NO: 6576 - DNA, 20 bp, Artificial Sequence
  B2M targeting sequence
tttcctgacatcatgcttgt

SEQ ID NO: 6577 - DNA, 20 bp, Artificial Sequence
  B2M targeting sequence
tgacatcatgcttgttcctg

SEQ ID NO: 6578 - DNA, 20 bp, Artificial Sequence
  B2M targeting sequence
ggaaaagaaaacttcagcta

SEQ ID NO: 6579 - DNA, 20 bp, Artificial Sequence
  B2M targeting sequence
tgcttgttcctgcaaatcca

SEQ ID NO: 6580 - DNA, 20 bp, Artificial Sequence
  B2M targeting sequence
tgcaaatccacgatgtccaa

SEQ ID NO: 6581 - DNA, 20 bp, Artificial Sequence
  B2M targeting sequence
acgatgtccaatcagggtat

SEQ ID NO: 6582 - DNA, 20 bp, Artificial Sequence
  B2M targeting sequence
tggatttgcaggaacaagca

SEQ ID NO: 6583 - DNA, 20 bp, Artificial Sequence
  B2M targeting sequence
aatcagggtatctcaaacaa

SEQ ID NO: 6584 - DNA, 20 bp, Artificial Sequence
  B2M targeting sequence
gggtatctcaaacaacattg

SEQ ID NO: 6585 - DNA, 20 bp, Artificial Sequence
  B2M targeting sequence
caaacaacattgcgcctggc

SEQ ID NO: 6586 - DNA, 20 bp, Artificial Sequence
  B2M targeting sequence
aacaacattgcgcctggcaa

SEQ ID NO: 6587 - DNA, 20 bp, Artificial Sequence
  B2M targeting sequence
attgccaggcgcaatgttgt

SEQ ID NO: 6588 - DNA, 20 bp, Artificial Sequence
  B2M targeting sequence
cctcagagtaaaagaaagca

SEQ ID NO: 6589 - DNA, 20 bp, Artificial Sequence
  B2M targeting sequence
gagtaaaagaaagcaggtaa

SEQ ID NO: 6590 - DNA, 20 bp, Artificial Sequence
  B2M targeting sequence
gaggtgagttccattgccag

SEQ ID NO: 6591 - DNA, 20 bp, Artificial Sequence
  B2M targeting sequence
tttactctgaggtgagttcc

SEQ ID NO: 6592 - DNA, 20 bp, Artificial Sequence
  B2M targeting sequence
ttacctgctttcttttactc

SEQ ID NO: 6593 - DNA, 20 bp, Artificial Sequence
  B2M targeting sequence
attggtattagtcattacct

SEQ ID NO: 6594 - DNA, 20 bp, Artificial Sequence
  B2M targeting sequence
ttatccagaagtaattagcc

SEQ ID NO: 6595 - DNA, 20 bp, Artificial Sequence
  B2M targeting sequence
agaagtaattagccttacag

SEQ ID NO: 6596 - DNA, 20 bp, Artificial Sequence
  B2M targeting sequence
ggataatgaagtaatggtaa

SEQ ID NO: 6597 - DNA, 20 bp, Artificial Sequence
  B2M targeting sequence
gtaaggctaattacttctgg

SEQ ID NO: 6598 - DNA, 20 bp, Artificial Sequence
  B2M targeting sequence
ccttcagatcataaaagtat

SEQ ID NO: 6599 - DNA, 20 bp, Artificial Sequence
  B2M targeting sequence
ttcagatcataaaagtatta

SEQ ID NO: 6600 - DNA, 20 bp, Artificial Sequence
  B2M targeting sequence
gatcataaaagtattacact

SEQ ID NO: 6601 - DNA, 20 bp, Artificial Sequence
  B2M targeting sequence
gaaggagaaagcaaatattt

SEQ ID NO: 6602 - DNA, 20 bp, Artificial Sequence
  B2M targeting sequence
taaaagtattacactaaaaa

SEQ ID NO: 6603 - DNA, 20 bp, Artificial Sequence
  B2M targeting sequence
aaaacttaactcctccattt

SEQ ID NO: 6604 - DNA, 20 bp, Artificial Sequence
  B2M targeting sequence
tccatttctgacctggataa

SEQ ID NO: 6605 - DNA, 20 bp, Artificial Sequence
  B2M targeting sequence
atttctgacctggataagat

SEQ ID NO: 6606 - DNA, 20 bp, Artificial Sequence
  B2M targeting sequence
gacctggataagatggcaga

SEQ ID NO: 6607 - DNA, 20 bp, Artificial Sequence
  B2M targeting sequence
gaaatggaggagttaagttt

SEQ ID NO: 6608 - DNA, 20 bp, Artificial Sequence
  B2M targeting sequence
aggtcagaaatggaggagtt

SEQ ID NO: 6609 - DNA, 20 bp, Artificial Sequence
  B2M targeting sequence
tatccaggtcagaaatggag

SEQ ID NO: 6610 - DNA, 20 bp, Artificial Sequence
  B2M targeting sequence
gccatcttatccaggtcaga

SEQ ID NO: 6611 - DNA, 20 bp, Artificial Sequence
  B2M targeting sequence
tgccctctctagtcctctcc

SEQ ID NO: 6612 - DNA, 20 bp, Artificial Sequence
  B2M targeting sequence
ctagtcctctccacaatgca

SEQ ID NO: 6613 - DNA, 20 bp, Artificial Sequence
  B2M targeting sequence
agtcctctccacaatgcaca

SEQ ID NO: 6614 - DNA, 20 bp, Artificial Sequence
  B2M targeting sequence
tctccacaatgcacaatagc

SEQ ID NO: 6615 - DNA, 20 bp, Artificial Sequence
  B2M targeting sequence
ccacaatgcacaatagcaaa

SEQ ID NO: 6616 - DNA, 20 bp, Artificial Sequence
  B2M targeting sequence
acaatgcacaatagcaaact

SEQ ID NO: 6617 - DNA, 20 bp, Artificial Sequence
  B2M targeting sequence
acagtttgctattgtgcatt

SEQ ID NO: 6618 - DNA, 20 bp, Artificial Sequence
  B2M targeting sequence
ctacagtttgctattgtgca

SEQ ID NO: 6619 - DNA, 20 bp, Artificial Sequence
  B2M targeting sequence
gtgggtctttctccctgtgt

SEQ ID NO: 6620 - DNA, 20 bp, Artificial Sequence
  B2M targeting sequence
ttctccctgtgtgcggagag

SEQ ID NO: 6621 - DNA, 20 bp, Artificial Sequence
  B2M targeting sequence
ccctgtgtgcggagaggaga

SEQ ID NO: 6622 - DNA, 20 bp, Artificial Sequence
  B2M targeting sequence
ctgtgtgcggagaggagaga

SEQ ID NO: 6623 - DNA, 20 bp, Artificial Sequence
  B2M targeting sequence
gcacacagggagaaagaccc

SEQ ID NO: 6624 - DNA, 20 bp, Artificial Sequence
  B2M targeting sequence
ccgcacacagggagaaagac

SEQ ID NO: 6625 - DNA, 20 bp, Artificial Sequence
  B2M targeting sequence
tctccgcacacagggagaaa

SEQ ID NO: 6626 - DNA, 20 bp, Artificial Sequence
  B2M targeting sequence
cctctccgcacacagggaga

SEQ ID NO: 6627 - DNA, 20 bp, Artificial Sequence
  B2M targeting sequence
ctcctctccgcacacaggga

SEQ ID NO: 6628 - DNA, 20 bp, Artificial Sequence
  B2M targeting sequence
tagaaataaagacacaagac

SEQ ID NO: 6629 - DNA, 20 bp, Artificial Sequence
  B2M targeting sequence
atgatctctcctctccgcac

SEQ ID NO: 6630 - DNA, 20 bp, Artificial Sequence
  B2M targeting sequence
ttatttctatgatctctcct

SEQ ID NO: 6631 - DNA, 20 bp, Artificial Sequence
  B2M targeting sequence
tgtgtctttatttctatgat

SEQ ID NO: 6632 - DNA, 20 bp, Artificial Sequence
  B2M targeting sequence
ttgtcttgtgtctttatttc

SEQ ID NO: 6633 - DNA, 20 bp, Artificial Sequence
  B2M targeting sequence
ctttgtcttgtgtctttatt

SEQ ID NO: 6634 - DNA, 20 bp, Artificial Sequence
  B2M targeting sequence
tctctttgtcttgtgtcttt

SEQ ID NO: 6635 - DNA, 20 bp, Artificial Sequence
  B2M targeting sequence
tttcttctctttgtcttgtg

SEQ ID NO: 6636 - DNA, 20 bp, Artificial Sequence
  B2M targeting sequence
cccgggcccagctgtctttt

SEQ ID NO: 6637 - DNA, 20 bp, Artificial Sequence
  B2M targeting sequence
tggtggtagtggtcccccgg

SEQ ID NO: 6638 - DNA, 20 bp, Artificial Sequence
  B2M targeting sequence
gcgtcttggtggtagtggtc

SEQ ID NO: 6639 - DNA, 20 bp, Artificial Sequence
  B2M targeting sequence
ctgcgtcttggtggtagtgg

SEQ ID NO: 6640 - DNA, 20 bp, Artificial Sequence
  B2M targeting sequence
ctaccagtctctgcgtcttg

SEQ ID NO: 6641 - DNA, 20 bp, Artificial Sequence
  B2M targeting sequence
gggtcactaccagtctctgc

SEQ ID NO: 6642 - DNA, 20 bp, Artificial Sequence
  B2M targeting sequence
gccaggcattcggggtcact

SEQ ID NO: 6643 - DNA, 20 bp, Artificial Sequence
  B2M targeting sequence
aataaataacagctcagcca

SEQ ID NO: 6644 - DNA, 20 bp, Artificial Sequence
  B2M targeting sequence
ttaccctgccccttttgctt

SEQ ID NO: 6645 - DNA, 20 bp, Artificial Sequence
  B2M targeting sequence
cactctttaccctgcccctt

SEQ ID NO: 6646 - DNA, 20 bp, Artificial Sequence
  B2M targeting sequence
tctccaatgattgataaggt

SEQ ID NO: 6647 - DNA, 20 bp, Artificial Sequence
  B2M targeting sequence
ccaatgattgataaggtcac

SEQ ID NO: 6648 - DNA, 20 bp, Artificial Sequence
  B2M targeting sequence
aatgattgataaggtcacgt

SEQ ID NO: 6649 - DNA, 20 bp, Artificial Sequence
  B2M targeting sequence
ttggagatgactcacactct

SEQ ID NO: 6650 - DNA, 20 bp, Artificial Sequence
  B2M targeting sequence
atcattggagatgactcaca

SEQ ID NO: 6651 - DNA, 20 bp, Artificial Sequence
  B2M targeting sequence
cgtgagtcatgtgtccaccg

SEQ ID NO: 6652 - DNA, 20 bp, Artificial Sequence
  B2M targeting sequence
cgtgaccttatcaatcattg

SEQ ID NO: 6653 - DNA, 20 bp, Artificial Sequence
  B2M targeting sequence
tgtgtccaccggacaggggg

SEQ ID NO: 6654 - DNA, 20 bp, Artificial Sequence
  B2M targeting sequence
accggacagggggcccttcc

SEQ ID NO: 6655 - DNA, 20 bp, Artificial Sequence
  B2M targeting sequence
ggtggacacatgactcacgt

SEQ ID NO: 6656 - DNA, 20 bp, Artificial Sequence
  B2M targeting sequence
ctgttaggtagcccaggcag

SEQ ID NO: 6657 - DNA, 20 bp, Artificial Sequence
  B2M targeting sequence
gcctgggctacctaacaggg

SEQ ID NO: 6658 - DNA, 20 bp, Artificial Sequence
  B2M targeting sequence
ctgcctgggctacctaacag

SEQ ID NO: 6659 - DNA, 20 bp, Artificial Sequence
  B2M targeting sequence
ctctgcctgggctacctaac

SEQ ID NO: 6660 - DNA, 20 bp, Artificial Sequence
  B2M targeting sequence
ctctctgcctgggctaccta

SEQ ID NO: 6661 - DNA, 20 bp, Artificial Sequence
  B2M targeting sequence
ctctctctgcctgggctacc

SEQ ID NO: 6662 - DNA, 20 bp, Artificial Sequence
  B2M targeting sequence
ctctctctctgcctgggcta

SEQ ID NO: 6663 - DNA, 20 bp, Artificial Sequence
  B2M targeting sequence
ttatttcttctatgctcttt

SEQ ID NO: 6664 - DNA, 20 bp, Artificial Sequence
  B2M targeting sequence
tctatgctcttttcagaaag

SEQ ID NO: 6665 - DNA, 20 bp, Artificial Sequence
  B2M targeting sequence
atgctcttttcagaaagatc

SEQ ID NO: 6666 - DNA, 20 bp, Artificial Sequence
  B2M targeting sequence
tttcagaaagatcaaagact

SEQ ID NO: 6667 - DNA, 20 bp, Artificial Sequence
  B2M targeting sequence
gaaagatcaaagactaatac

SEQ ID NO: 6668 - DNA, 20 bp, Artificial Sequence
  B2M targeting sequence
gaaaagagcatagaagaaat

SEQ ID NO: 6669 - DNA, 20 bp, Artificial Sequence
  B2M targeting sequence
ttctgaaaagagcatagaag

SEQ ID NO: 6670 - DNA, 20 bp, Artificial Sequence
  B2M targeting sequence
aagactaatactttcactaa

SEQ ID NO: 6671 - DNA, 20 bp, Artificial Sequence
  B2M targeting sequence
ttgatctttctgaaaagagc

SEQ ID NO: 6672 - DNA, 20 bp, Artificial Sequence
  B2M targeting sequence
ctaattttgccactgcgatc

SEQ ID NO: 6673 - DNA, 20 bp, Artificial Sequence
  B2M targeting sequence
cagtggcaaaattagtgaaa

SEQ ID NO: 6674 - DNA, 20 bp, Artificial Sequence
  B2M targeting sequence
agagggcggagccaggtgta

SEQ ID NO: 6675 - DNA, 20 bp, Artificial Sequence
  B2M targeting sequence
agatcgcagtggcaaaatta

SEQ ID NO: 6676 - DNA, 20 bp, Artificial Sequence
  B2M targeting sequence
gccctctagatcgcagtggc

SEQ ID NO: 6677 - DNA, 20 bp, Artificial Sequence
  B2M targeting sequence
gtacacctggctccgccctc

SEQ ID NO: 6678 - DNA, 20 bp, Artificial Sequence
  B2M targeting sequence
actctgtacacctggctccg

SEQ ID NO: 6679 - DNA, 20 bp, Artificial Sequence
  B2M targeting sequence
tgttccactctgtacacctg

SEQ ID NO: 6680 - DNA, 20 bp, Artificial Sequence
  B2M targeting sequence
ctttcatgttccactctgta

SEQ ID NO: 6681 - DNA, 20 bp, Artificial Sequence
  B2M targeting sequence
tgtttcactttcatgttcca

SEQ ID NO: 6682 - DNA, 20 bp, Artificial Sequence
  B2M targeting sequence
cctgtttcactttcatgttc

SEQ ID NO: 6683 - DNA, 20 bp, Artificial Sequence
  B2M targeting sequence
ctctcctgtttcactttcat

SEQ ID NO: 6684 - DNA, 20 bp, Artificial Sequence
  B2M targeting sequence
gcggtcactctcctgtttca

SEQ ID NO: 6685 - DNA, 20 bp, Artificial Sequence
  B2M targeting sequence
cagggagacggttaggcctc

SEQ ID NO: 6686 - DNA, 20 bp, Artificial Sequence
  B2M targeting sequence
ctgtgatgctgtgtttcagc

SEQ ID NO: 6687 - DNA, 20 bp, Artificial Sequence
  B2M targeting sequence
ccctgtgatgctgtgtttca

SEQ ID NO: 6688 - DNA, 20 bp, Artificial Sequence
  B2M targeting sequence
ggataactgcgggtgggcct

SEQ ID NO: 6689 - DNA, 20 bp, Artificial Sequence
  B2M targeting sequence
ggaggcctaaccgtctccct

SEQ ID NO: 6690 - DNA, 20 bp, Artificial Sequence
  B2M targeting sequence
ggcccacccgcagttatccg

SEQ ID NO: 6691 - DNA, 20 bp, Artificial Sequence
  B2M targeting sequence
acaagaggtggtggagcaga

SEQ ID NO: 6692 - DNA, 20 bp, Artificial Sequence
  B2M targeting sequence
tgtggagtcaggcccacccg

SEQ ID NO: 6693 - DNA, 20 bp, Artificial Sequence
  B2M targeting sequence
accacctcttgtggagtcag

SEQ ID NO: 6694 - DNA, 20 bp, Artificial Sequence
  B2M targeting sequence
gctccaccacctcttgtgga

SEQ ID NO: 6695 - DNA, 20 bp, Artificial Sequence
  B2M targeting sequence
tctctaactcccccggggaa

SEQ ID NO: 6696 - DNA, 20 bp, Artificial Sequence
  B2M targeting sequence
ctaactcccccggggaaagg

SEQ ID NO: 6697 - DNA, 20 bp, Artificial Sequence
  B2M targeting sequence
aactcccccggggaaaggga

SEQ ID NO: 6698 - DNA, 20 bp, Artificial Sequence
  B2M targeting sequence
cccggggaaagggagactcc

SEQ ID NO: 6699 - DNA, 20 bp, Artificial Sequence
  B2M targeting sequence
ccgggggagttagagaagac

SEQ ID NO: 6700 - DNA, 20 bp, Artificial Sequence
  B2M targeting sequence
ctttccccgggggagttaga

SEQ ID NO: 6701 - DNA, 20 bp, Artificial Sequence
  B2M targeting sequence
ccctttccccgggggagtta

SEQ ID NO: 6702 - DNA, 20 bp, Artificial Sequence
  B2M targeting sequence
ctttcccggtctgctaagta

SEQ ID NO: 6703 - DNA, 20 bp, Artificial Sequence
  B2M targeting sequence
cggtctgctaagtaacgggt

SEQ ID NO: 6704 - DNA, 20 bp, Artificial Sequence
  B2M targeting sequence
gctaagtaacgggtgctttt

SEQ ID NO: 6705 - DNA, 20 bp, Artificial Sequence
  B2M targeting sequence
aggcactgacgctaccgcta

SEQ ID NO: 6706 - DNA, 20 bp, Artificial Sequence
  B2M targeting sequence
gtgcctagaaaaagcacccg

SEQ ID NO: 6707 - DNA, 20 bp, Artificial Sequence
  B2M targeting sequence
agcggtagcgtcagtgccta

SEQ ID NO: 6708 - DNA, 20 bp, Artificial Sequence
  B2M targeting sequence
gctaggcaaccggcgtcttc

SEQ ID NO: 6709 - DNA, 20 bp, Artificial Sequence
  B2M targeting sequence
tcccaggcgctggcgttacc

SEQ ID NO: 6710 - DNA, 20 bp, Artificial Sequence
  B2M targeting sequence
caggcgctggcgttaccgct

SEQ ID NO: 6711 - DNA, 20 bp, Artificial Sequence
  B2M targeting sequence
agcggtaacgccagcgcctg

SEQ ID NO: 6712 - DNA, 20 bp, Artificial Sequence
  B2M targeting sequence
ttggtctagcggtaacgcca

SEQ ID NO: 6713 - DNA, 20 bp, Artificial Sequence
  B2M targeting sequence
agtggccccgtccgggcata

SEQ ID NO: 6714 - DNA, 20 bp, Artificial Sequence
  B2M targeting sequence
gggcataacagaaggctcac

SEQ ID NO: 6715 - DNA, 20 bp, Artificial Sequence
  B2M targeting sequence
gttatgcccggacggggcca

SEQ ID NO: 6716 - DNA, 20 bp, Artificial Sequence
  B2M targeting sequence
cacttgtcttccggtcactt

SEQ ID NO: 6717 - DNA, 20 bp, Artificial Sequence
  B2M targeting sequence
tccggtcacttctcacagtg

SEQ ID NO: 6718 - DNA, 20 bp, Artificial Sequence
  B2M targeting sequence
ggtcacttctcacagtgtcc

SEQ ID NO: 6719 - DNA, 20 bp, Artificial Sequence
  B2M targeting sequence
cttctcacagtgtcccttca

SEQ ID NO: 6720 - DNA, 20 bp, Artificial Sequence
  B2M targeting sequence
cacagtgtcccttcagctcc

SEQ ID NO: 6721 - DNA, 20 bp, Artificial Sequence
  B2M targeting sequence
cagtgtcccttcagctccta

SEQ ID NO: 6722 - DNA, 20 bp, Artificial Sequence
  B2M targeting sequence
cttcagctcctatctctgta

SEQ ID NO: 6723 - DNA, 20 bp, Artificial Sequence
  B2M targeting sequence
gctcctatctctgtatggcc

SEQ ID NO: 6724 - DNA, 20 bp, Artificial Sequence
  B2M targeting sequence
tatctctgtatggcctggtt

SEQ ID NO: 6725 - DNA, 20 bp, Artificial Sequence
  B2M targeting sequence
ctgtatggcctggtttttcc

SEQ ID NO: 6726 - DNA, 20 bp, Artificial Sequence
  B2M targeting sequence
gtatggcctggtttttccta

SEQ ID NO: 6727 - DNA, 20 bp, Artificial Sequence
  B2M targeting sequence
taggttatgattgtagagtg

SEQ ID NO: 6728 - DNA, 20 bp, Artificial Sequence
  B2M targeting sequence
taacctaggaaaaaccaggc

SEQ ID NO: 6729 - DNA, 20 bp, Artificial Sequence
  B2M targeting sequence
acaatcataacctaggaaaa

SEQ ID NO: 6730 - DNA, 20 bp, Artificial Sequence
  B2M targeting sequence
ctctacaatcataacctagg

SEQ ID NO: 6731 - DNA, 20 bp, Artificial Sequence
  B2M targeting sequence
tcactctacaatcataacct

SEQ ID NO: 6732 - DNA, 20 bp, Artificial Sequence
  B2M targeting sequence
aatattataataatcttcac

SEQ ID NO: 6733 - DNA, 20 bp, Artificial Sequence
  B2M targeting sequence
ttattccaatattataataa

SEQ ID NO: 6734 - DNA, 20 bp, Artificial Sequence
  B2M targeting sequence
ttagtttgtagcaattactc

SEQ ID NO: 6735 - DNA, 20 bp, Artificial Sequence
  B2M targeting sequence
ttaatcattagtttgtagca

SEQ ID NO: 6736 - DNA, 20 bp, Artificial Sequence
  B2M targeting sequence
tatataatcatatctatgat

SEQ ID NO: 6737 - DNA, 20 bp, Artificial Sequence
  B2M targeting sequence
tatctatgatctatatctag

SEQ ID NO: 6738 - DNA, 20 bp, Artificial Sequence
  B2M targeting sequence
atgatctatatctagtataa

SEQ ID NO: 6739 - DNA, 20 bp, Artificial Sequence
  B2M targeting sequence
tagatatgattatatatgaa

SEQ ID NO: 6740 - DNA, 20 bp, Artificial Sequence
  B2M targeting sequence
atatctagtataactattct

SEQ ID NO: 6741 - DNA, 20 bp, Artificial Sequence
  B2M targeting sequence
agtataactattcttatttt

SEQ ID NO: 6742 - DNA, 20 bp, Artificial Sequence
  B2M targeting sequence
tattttatttattttcttta

SEQ ID NO: 6743 - DNA, 20 bp, Artificial Sequence
  B2M targeting sequence
ttattatactggaacagctt

SEQ ID NO: 6744 - DNA, 20 bp, Artificial Sequence
  B2M targeting sequence
agtataataaagaaaataaa

SEQ ID NO: 6745 - DNA, 20 bp, Artificial Sequence
  B2M targeting sequence
gtctcttgccttggctcctg

SEQ ID NO: 6746 - DNA, 20 bp, Artificial Sequence
  B2M targeting sequence
cttgccttggctcctgggtg

SEQ ID NO: 6747 - DNA, 20 bp, Artificial Sequence
  B2M targeting sequence
tgccttggctcctgggtggc

SEQ ID NO: 6748 - DNA, 20 bp, Artificial Sequence
  B2M targeting sequence
tgggtggcttgccgcccaca

SEQ ID NO: 6749 - DNA, 20 bp, Artificial Sequence
  B2M targeting sequence
agagacaatgaaaggggaac

SEQ ID NO: 6750 - DNA, 20 bp, Artificial Sequence
  B2M targeting sequence
tgagttatttttgcaatgtt

SEQ ID NO: 6751 - DNA, 20 bp, Artificial Sequence
  B2M targeting sequence
cttgagttatttttgcaatg

SEQ ID NO: 6752 - DNA, 20 bp, Artificial Sequence
  B2M targeting sequence
ttgtctcttgagttattttt

SEQ ID NO: 6753 - DNA, 20 bp, Artificial Sequence
  B2M targeting sequence
cctttcattgtctcttgagt

SEQ ID NO: 6754 - DNA, 20 bp, Artificial Sequence
  B2M targeting sequence
gagaggtagaagacgagggt

SEQ ID NO: 6755 - DNA, 20 bp, Artificial Sequence
  B2M targeting sequence
gagttcccctttcattgtct

SEQ ID NO: 6756 - DNA, 20 bp, Artificial Sequence
  B2M targeting sequence
cagagttcccctttcattgt

SEQ ID NO: 6757 - DNA, 20 bp, Artificial Sequence
  B2M targeting sequence
acctctcagagttccccttt

SEQ ID NO: 6758 - DNA, 20 bp, Artificial Sequence
  B2M targeting sequence
tctacctctcagagttcccc

SEQ ID NO: 6759 - DNA, 20 bp, Artificial Sequence
  B2M targeting sequence
tcttctacctctcagagttc

SEQ ID NO: 6760 - DNA, 20 bp, Artificial Sequence
  B2M targeting sequence
gtttgagaccccaggcagga

SEQ ID NO: 6761 - DNA, 20 bp, Artificial Sequence
  B2M targeting sequence
aaccgatgcaccctcgtctt

SEQ ID NO: 6762 - DNA, 20 bp, Artificial Sequence
  B2M targeting sequence
caaaccgatgcaccctcgtc

SEQ ID NO: 6763 - DNA, 20 bp, Artificial Sequence
  B2M targeting sequence
tgcctggggtctcaaaccga

SEQ ID NO: 6764 - DNA, 20 bp, Artificial Sequence
  B2M targeting sequence
agtcctgcctggggtctcaa

SEQ ID NO: 6765 - DNA, 20 bp, Artificial Sequence
  B2M targeting sequence
ccagtcctgcctggggtctc

SEQ ID NO: 6766 - DNA, 20 bp, Artificial Sequence
  B2M targeting sequence
cttctccagtcctgcctggg

SEQ ID NO: 6767 - DNA, 20 bp, Artificial Sequence
  B2M targeting sequence
gggcatcctatgtccttcca

SEQ ID NO: 6768 - DNA, 20 bp, Artificial Sequence
  B2M targeting sequence
tatgtccttccaacctacaa

SEQ ID NO: 6769 - DNA, 20 bp, Artificial Sequence
  B2M targeting sequence
ttccaacctacaaaagaggt

SEQ ID NO: 6770 - DNA, 20 bp, Artificial Sequence
  B2M targeting sequence
aacctacaaaagaggtgatc

SEQ ID NO: 6771 - DNA, 20 bp, Artificial Sequence
  B2M targeting sequence
tttgtaggttggaaggacat

SEQ ID NO: 6772 - DNA, 20 bp, Artificial Sequence
  B2M targeting sequence
cctcttttgtaggttggaag

SEQ ID NO: 6773 - DNA, 20 bp, Artificial Sequence
  B2M targeting sequence
aggtcaagcattttctgatc

SEQ ID NO: 6774 - DNA, 20 bp, Artificial Sequence
  B2M targeting sequence
agcattttctgatctgagcc

SEQ ID NO: 6775 - DNA, 20 bp, Artificial Sequence
  B2M targeting sequence
gatctgagcctagcaacaga

SEQ ID NO: 6776 - DNA, 20 bp, Artificial Sequence
  B2M targeting sequence
gaaaatgcttgacctggatc

SEQ ID NO: 6777 - DNA, 20 bp, Artificial Sequence
  B2M targeting sequence
gagcctagcaacagaaggca

SEQ ID NO: 6778 - DNA, 20 bp, Artificial Sequence
  B2M targeting sequence
gatcagaaaatgcttgacct

SEQ ID NO: 6779 - DNA, 20 bp, Artificial Sequence
  B2M targeting sequence
gttgctaggctcagatcaga

SEQ ID NO: 6780 - DNA, 20 bp, Artificial Sequence
  B2M targeting sequence
cccccacattgaataggagt

SEQ ID NO: 6781 - DNA, 20 bp, Artificial Sequence
  B2M targeting sequence
cccacattgaataggagtct

SEQ ID NO: 6782 - DNA, 20 bp, Artificial Sequence
  B2M targeting sequence
atgtgggggagaccttagcc

SEQ ID NO: 6783 - DNA, 20 bp, Artificial Sequence
  B2M targeting sequence
tattcaatgtgggggagacc

SEQ ID NO: 6784 - DNA, 20 bp, Artificial Sequence
  B2M targeting sequence
acctataccaccacctgagc

SEQ ID NO: 6785 - DNA, 20 bp, Artificial Sequence
  B2M targeting sequence
ggtggtggtataggtagact

SEQ ID NO: 6786 - DNA, 20 bp, Artificial Sequence
  B2M targeting sequence
attctgtgtagtaggtttaa

SEQ ID NO: 6787 - DNA, 20 bp, Artificial Sequence
  B2M targeting sequence
gtgtagtaggtttaagcacc

SEQ ID NO: 6788 - DNA, 20 bp, Artificial Sequence
  B2M targeting sequence
tcccagtggagtctatccat

SEQ ID NO: 6789 - DNA, 20 bp, Artificial Sequence
  B2M targeting sequence
cagtggagtctatccatcag

SEQ ID NO: 6790 - DNA, 20 bp, Artificial Sequence
  B2M targeting sequence
actgggaagaggtgcttaaa

SEQ ID NO: 6791 - DNA, 20 bp, Artificial Sequence
  B2M targeting sequence
atccatcagacctttcctga

SEQ ID NO: 6792 - DNA, 20 bp, Artificial Sequence
  B2M targeting sequence
atcagacctttcctgaataa

SEQ ID NO: 6793 - DNA, 20 bp, Artificial Sequence
  B2M targeting sequence
gacctttcctgaataaccag

SEQ ID NO: 6794 - DNA, 20 bp, Artificial Sequence
  B2M targeting sequence
gatggatagactccactggg

SEQ ID NO: 6795 - DNA, 20 bp, Artificial Sequence
  B2M targeting sequence
tgaataaccaggtactgagg

SEQ ID NO: 6796 - DNA, 20 bp, Artificial Sequence
  B2M targeting sequence
ggaaaggtctgatggataga

SEQ ID NO: 6797 - DNA, 20 bp, Artificial Sequence
  B2M targeting sequence
gtacctggttattcaggaaa

SEQ ID NO: 6798 - DNA, 20 bp, Artificial Sequence
  B2M targeting sequence
tgcctcagtacctggttatt

SEQ ID NO: 6799 - DNA, 20 bp, Artificial Sequence
  B2M targeting sequence
tttcctggctcctgccacat

SEQ ID NO: 6800 - DNA, 20 bp, Artificial Sequence
  B2M targeting sequence
tggctcctgccacatggctt

SEQ ID NO: 6801 - DNA, 20 bp, Artificial Sequence
  B2M targeting sequence
tgccacatggcttcctgcct

SEQ ID NO: 6802 - DNA, 20 bp, Artificial Sequence
  B2M targeting sequence
tgcctcactggcattcagcc

SEQ ID NO: 6803 - DNA, 20 bp, Artificial Sequence
  B2M targeting sequence
ctggcattcagccgtgttgg

SEQ ID NO: 6804 - DNA, 20 bp, Artificial Sequence
  B2M targeting sequence
gccgtgttggtctccagctt

SEQ ID NO: 6805 - DNA, 20 bp, Artificial Sequence
  B2M targeting sequence
ccagcttgttcctggctgct

SEQ ID NO: 6806 - DNA, 20 bp, Artificial Sequence
  B2M targeting sequence
agcttgttcctggctgctag

SEQ ID NO: 6807 - DNA, 20 bp, Artificial Sequence
  B2M targeting sequence
tggctgctagaaggggagat

SEQ ID NO: 6808 - DNA, 20 bp, Artificial Sequence
  B2M targeting sequence
agcagccaggaacaagctgg

SEQ ID NO: 6809 - DNA, 20 bp, Artificial Sequence
  B2M targeting sequence
ccttctagcagccaggaaca

SEQ ID NO: 6810 - DNA, 20 bp, Artificial Sequence
  B2M targeting sequence
ccccttctagcagccaggaa

SEQ ID NO: 6811 - DNA, 20 bp, Artificial Sequence
  B2M targeting sequence
gctgttctctgtggagttag

SEQ ID NO: 6812 - DNA, 20 bp, Artificial Sequence
  B2M targeting sequence
ctgtggagttagtgtctggg

SEQ ID NO: 6813 - DNA, 20 bp, Artificial Sequence
  B2M targeting sequence
gtggagttagtgtctgggct

SEQ ID NO: 6814 - DNA, 20 bp, Artificial Sequence
  B2M targeting sequence
acagagaacagcagaaatct

SEQ ID NO: 6815 - DNA, 20 bp, Artificial Sequence
  B2M targeting sequence
gggctcaggcagggggtctg

SEQ ID NO: 6816 - DNA, 20 bp, Artificial Sequence
  B2M targeting sequence
ggcagggggtctgccagggt

SEQ ID NO: 6817 - DNA, 20 bp, Artificial Sequence
  B2M targeting sequence
gccagggtttctagtttggt

SEQ ID NO: 6818 - DNA, 20 bp, Artificial Sequence
  B2M targeting sequence
agtttggtctctgattcgct

SEQ ID NO: 6819 - DNA, 20 bp, Artificial Sequence
  B2M targeting sequence
ctgattcgctggtatgggtc

SEQ ID NO: 6820 - DNA, 20 bp, Artificial Sequence
  B2M targeting sequence
gattcgctggtatgggtcac

SEQ ID NO: 6821 - DNA, 20 bp, Artificial Sequence
  B2M targeting sequence
gagaccaaactagaaaccct

SEQ ID NO: 6822 - DNA, 20 bp, Artificial Sequence
  B2M targeting sequence
ctggtatgggtcactcccca

SEQ ID NO: 6823 - DNA, 20 bp, Artificial Sequence
  B2M targeting sequence
ctccccagattcagacggag

SEQ ID NO: 6824 - DNA, 20 bp, Artificial Sequence
  B2M targeting sequence
ccagattcagacggagttta

SEQ ID NO: 6825 - DNA, 20 bp, Artificial Sequence
  B2M targeting sequence
ggggagtgacccataccagc

SEQ ID NO: 6826 - DNA, 20 bp, Artificial Sequence
  B2M targeting sequence
gacggagtttaaatccaatt

SEQ ID NO: 6827 - DNA, 20 bp, Artificial Sequence
  B2M targeting sequence
gaatctggggagtgacccat

SEQ ID NO: 6828 - DNA, 20 bp, Artificial Sequence
  B2M targeting sequence
gtctgaatctggggagtgac

SEQ ID NO: 6829 - DNA, 20 bp, Artificial Sequence
  B2M targeting sequence
aattgtaactttgatgtgta

SEQ ID NO: 6830 - DNA, 20 bp, Artificial Sequence
  B2M targeting sequence
aagttacaattggatttaaa

SEQ ID NO: 6831 - DNA, 20 bp, Artificial Sequence
  B2M targeting sequence
caggtattgctacacatcaa

SEQ ID NO: 6832 - DNA, 20 bp, Artificial Sequence
  B2M targeting sequence
cctgtaaatctgctttctat

SEQ ID NO: 6833 - DNA, 20 bp, Artificial Sequence
  B2M targeting sequence
gctttctattttctgcaaac

SEQ ID NO: 6834 - DNA, 20 bp, Artificial Sequence
  B2M targeting sequence
attttctgcaaacatggagg

SEQ ID NO: 6835 - DNA, 20 bp, Artificial Sequence
  B2M targeting sequence
gcaaacatggaggccattgc

SEQ ID NO: 6836 - DNA, 20 bp, Artificial Sequence
  B2M targeting sequence
atgtttgcagaaaatagaaa

SEQ ID NO: 6837 - DNA, 20 bp, Artificial Sequence
  B2M targeting sequence
atacagcaatggcctccatg

SEQ ID NO: 6838 - DNA, 20 bp, Artificial Sequence
  B2M targeting sequence
aaatacactgtcaatacagc

SEQ ID NO: 6839 - DNA, 20 bp, Artificial Sequence
  B2M targeting sequence
cctacacagggctgggtatc

SEQ ID NO: 6840 - DNA, 20 bp, Artificial Sequence
  B2M targeting sequence
gcatgaagatgaaccatcta

SEQ ID NO: 6841 - DNA, 20 bp, Artificial Sequence
  B2M targeting sequence
tgcagatacccagccctgtg

SEQ ID NO: 6842 - DNA, 20 bp, Artificial Sequence
  B2M targeting sequence
tcatgcagatacccagccct

SEQ ID NO: 6843 - DNA, 20 bp, Artificial Sequence
  B2M targeting sequence
tcttcatgcagatacccagc

SEQ ID NO: 6844 - DNA, 20 bp, Artificial Sequence
  B2M targeting sequence
aaaccatcccaaaacctcag

SEQ ID NO: 6845 - DNA, 20 bp, Artificial Sequence
  B2M targeting sequence
caaaacctcaggataactat

SEQ ID NO: 6846 - DNA, 20 bp, Artificial Sequence
  B2M targeting sequence
ggataactatttgtcctcaa

SEQ ID NO: 6847 - DNA, 20 bp, Artificial Sequence
  B2M targeting sequence
tgaggttttgggatggttta

SEQ ID NO: 6848 - DNA, 20 bp, Artificial Sequence
  B2M targeting sequence
tcaattattcctacctgtct

SEQ ID NO: 6849 - DNA, 20 bp, Artificial Sequence
  B2M targeting sequence
attattcctacctgtctccc

SEQ ID NO: 6850 - DNA, 20 bp, Artificial Sequence
  B2M targeting sequence
tacctgtctccctttccttt

SEQ ID NO: 6851 - DNA, 20 bp, Artificial Sequence
  B2M targeting sequence
ccctttcctttacaacagaa

SEQ ID NO: 6852 - DNA, 20 bp, Artificial Sequence
  B2M targeting sequence
ctttcctttacaacagaaaa

SEQ ID NO: 6853 - DNA, 20 bp, Artificial Sequence
  B2M targeting sequence
tttacaacagaaaagtgcta

SEQ ID NO: 6854 - DNA, 20 bp, Artificial Sequence
  B2M targeting sequence
gttgtaaaggaaagggagac

SEQ ID NO: 6855 - DNA, 20 bp, Artificial Sequence
  B2M targeting sequence
ttaaccaacaggttttactt

SEQ ID NO: 6856 - DNA, 20 bp, Artificial Sequence
  B2M targeting sequence
cattccaggggaaatttttg

SEQ ID NO: 6857 - DNA, 20 bp, Artificial Sequence
  B2M targeting sequence
aggggaaatttttgccaata

SEQ ID NO: 6858 - DNA, 20 bp, Artificial Sequence
  B2M targeting sequence
cctggaatgtgacaagtaaa

SEQ ID NO: 6859 - DNA, 20 bp, Artificial Sequence
  B2M targeting sequence
agatactaatgacatttgtg

SEQ ID NO: 6860 - DNA, 20 bp, Artificial Sequence
  B2M targeting sequence
agaagggcattacttattgg

SEQ ID NO: 6861 - DNA, 20 bp, Artificial Sequence
  B2M targeting sequence
ttagtatctagaagggcatt

SEQ ID NO: 6862 - DNA, 20 bp, Artificial Sequence
  B2M targeting sequence
catggtttgttttcccccaa

SEQ ID NO: 6863 - DNA, 20 bp, Artificial Sequence
  B2M targeting sequence
cccaatccacaaattctatg

SEQ ID NO: 6864 - DNA, 20 bp, Artificial Sequence
  B2M targeting sequence
acaaattctatgtttagcaa

SEQ ID NO: 6865 - DNA, 20 bp, Artificial Sequence
  B2M targeting sequence
atgtttagcaataaaaattt

SEQ ID NO: 6866 - DNA, 20 bp, Artificial Sequence
  B2M targeting sequence
agcacaacagtagacactat

SEQ ID NO: 6867 - DNA, 20 bp, Artificial Sequence
  B2M targeting sequence
actgttgtgctagacaaatt

SEQ ID NO: 6868 - DNA, 20 bp, Artificial Sequence
  B2M targeting sequence
atagtgtctactgttgtgct

SEQ ID NO: 6869 - DNA, 20 bp, Artificial Sequence
  B2M targeting sequence
atatttatttttccatagtg

SEQ ID NO: 6870 - DNA, 20 bp, Artificial Sequence
  B2M targeting sequence
gctccatatttatttttcca

SEQ ID NO: 6871 - DNA, 20 bp, Artificial Sequence
  B2M targeting sequence
tctgctccatatttattttt

SEQ ID NO: 6872 - DNA, 20 bp, Artificial Sequence
  B2M targeting sequence
gtcttctgctccatatttat

SEQ ID NO: 6873 - DNA, 20 bp, Artificial Sequence
  B2M targeting sequence
tgaggcattcccatccttga

SEQ ID NO: 6874 - DNA, 20 bp, Artificial Sequence
  B2M targeting sequence
ggattagtcagtcttctgct

SEQ ID NO: 6875 - DNA, 20 bp, Artificial Sequence
  B2M targeting sequence
catccttgatgaggaggcaa

SEQ ID NO: 6876 - DNA, 20 bp, Artificial Sequence
  B2M targeting sequence
ttgatgaggaggcaaaatag

SEQ ID NO: 6877 - DNA, 20 bp, Artificial Sequence
  B2M targeting sequence
aggatgggaatgcctcagga

SEQ ID NO: 6878 - DNA, 20 bp, Artificial Sequence
  B2M targeting sequence
tcaaggatgggaatgcctca

SEQ ID NO: 6879 - DNA, 20 bp, Artificial Sequence
  B2M targeting sequence
tcatcaaggatgggaatgcc

SEQ ID NO: 6880 - DNA, 20 bp, Artificial Sequence
  B2M targeting sequence
tgaaaaacaactagagatgg

SEQ ID NO: 6881 - DNA, 20 bp, Artificial Sequence
  B2M targeting sequence
tgactattttgcctcctcat

SEQ ID NO: 6882 - DNA, 20 bp, Artificial Sequence
  B2M targeting sequence
agttgtttttcatgactatt

SEQ ID NO: 6883 - DNA, 20 bp, Artificial Sequence
  B2M targeting sequence
ctagttgtttttcatgacta

SEQ ID NO: 6884 - DNA, 20 bp, Artificial Sequence
  B2M targeting sequence
atctctagttgtttttcatg

SEQ ID NO: 6885 - DNA, 20 bp, Artificial Sequence
  B2M targeting sequence
cagcactttgggaggccaag

SEQ ID NO: 6886 - DNA, 20 bp, Artificial Sequence
  B2M targeting sequence
caaagtgctgcgattacagg

SEQ ID NO: 6887 - DNA, 20 bp, Artificial Sequence
  B2M targeting sequence
tgccttggcctcccaaagtg

SEQ ID NO: 6888 - DNA, 20 bp, Artificial Sequence
  B2M targeting sequence
tcctgccttggcctcccaaa

SEQ ID NO: 6889 - DNA, 20 bp, Artificial Sequence
  B2M targeting sequence
agcaatcctcctgccttggc

SEQ ID NO: 6890 - DNA, 20 bp, Artificial Sequence
  B2M targeting sequence
aacccccaggctcaagcaat

SEQ ID NO: 6891 - DNA, 20 bp, Artificial Sequence
  B2M targeting sequence
caaacccccaggctcaagca

SEQ ID NO: 6892 - DNA, 20 bp, Artificial Sequence
  B2M targeting sequence
ccaggctagtctcaaacccc

SEQ ID NO: 6893 - DNA, 20 bp, Artificial Sequence
  B2M targeting sequence
aatccccaggctagtctcaa

SEQ ID NO: 6894 - DNA, 20 bp, Artificial Sequence
  B2M targeting sequence
caaatccccaggctagtctc

SEQ ID NO: 6895 - DNA, 20 bp, Artificial Sequence
  B2M targeting sequence
tggaaaaaccctgtctctgc

SEQ ID NO: 6896 - DNA, 20 bp, Artificial Sequence
  B2M targeting sequence
atgatgcccaggttagtctc

SEQ ID NO: 6897 - DNA, 20 bp, Artificial Sequence
  B2M targeting sequence
ctgcaaaaacaaaaacaaaa

SEQ ID NO: 6898 - DNA, 20 bp, Artificial Sequence
  B2M targeting sequence
gcaaaaacaaaaacaaaaat

SEQ ID NO: 6899 - DNA, 20 bp, Artificial Sequence
  B2M targeting sequence
cccaggcatggtggcatgca

SEQ ID NO: 6900 - DNA, 20 bp, Artificial Sequence
  B2M targeting sequence
cagcgacttgtaaagcagtc

SEQ ID NO: 6901 - DNA, 20 bp, Artificial Sequence
  B2M targeting sequence
ctgggactataggtgcatgc

SEQ ID NO: 6902 - DNA, 20 bp, Artificial Sequence
  B2M targeting sequence
agggtcaacatagcaatctc

SEQ ID NO: 6903 - DNA, 20 bp, Artificial Sequence
  B2M targeting sequence
acatagcaatctcactgtct

SEQ ID NO: 6904 - DNA, 20 bp, Artificial Sequence
  B2M targeting sequence
cactgtctaaggtgttatcc

SEQ ID NO: 6905 - DNA, 20 bp, Artificial Sequence
  B2M targeting sequence
ctgtctaaggtgttatccag

SEQ ID NO: 6906 - DNA, 20 bp, Artificial Sequence
  B2M targeting sequence
aaggtgttatccagagttct

SEQ ID NO: 6907 - DNA, 20 bp, Artificial Sequence
  B2M targeting sequence
agagttctttgtctcatgac

SEQ ID NO: 6908 - DNA, 20 bp, Artificial Sequence
  B2M targeting sequence
ggataacaccttagacagtg

SEQ ID NO: 6909 - DNA, 20 bp, Artificial Sequence
  B2M targeting sequence
ttgtctcatgaccaggaaaa

SEQ ID NO: 6910 - DNA, 20 bp, Artificial Sequence
  B2M targeting sequence
catgaccaggaaaattaagg

SEQ ID NO: 6911 - DNA, 20 bp, Artificial Sequence
  B2M targeting sequence
tgaccaggaaaattaaggag

SEQ ID NO: 6912 - DNA, 20 bp, Artificial Sequence
  B2M targeting sequence
tgagacaaagaactctggat

SEQ ID NO: 6913 - DNA, 20 bp, Artificial Sequence
  B2M targeting sequence
tggtcatgagacaaagaact

SEQ ID NO: 6914 - DNA, 20 bp, Artificial Sequence
  B2M targeting sequence
ttaattttcctggtcatgag

SEQ ID NO: 6915 - DNA, 20 bp, Artificial Sequence
  B2M targeting sequence
acactccttaattttcctgg

SEQ ID NO: 6916 - DNA, 20 bp, Artificial Sequence
  B2M targeting sequence
tggtgtccacactccttaat

SEQ ID NO: 6917 - DNA, 20 bp, Artificial Sequence
  B2M targeting sequence
ctcttggtgtccacactcct

SEQ ID NO: 6918 - DNA, 20 bp, Artificial Sequence
  B2M targeting sequence
aacctcactcttggtgtcca

SEQ ID NO: 6919 - DNA, 20 bp, Artificial Sequence
  B2M targeting sequence
ttccaacctcactcttggtg

SEQ ID NO: 6920 - DNA, 20 bp, Artificial Sequence
  B2M targeting sequence
cttattaaactttcgttcca

SEQ ID NO: 6921 - DNA, 20 bp, Artificial Sequence
  B2M targeting sequence
ttcacttattaaactttcgt

SEQ ID NO: 6922 - DNA, 20 bp, Artificial Sequence
  B2M targeting sequence
tctttcacttattaaacttt

SEQ ID NO: 6923 - DNA, 20 bp, Artificial Sequence
  B2M targeting sequence
cagcagcagcgggggtggag

SEQ ID NO: 6924 - DNA, 20 bp, Artificial Sequence
  B2M targeting sequence
gcagcagcgggggtggaggg

SEQ ID NO: 6925 - DNA, 20 bp, Artificial Sequence
  B2M targeting sequence
acccccgctgctgctgagag

SEQ ID NO: 6926 - DNA, 20 bp, Artificial Sequence
  B2M targeting sequence
ctccacccccgctgctgctg

SEQ ID NO: 6927 - DNA, 20 bp, Artificial Sequence
  B2M targeting sequence
tttgctgccccctccctcca

SEQ ID NO: 6928 - DNA, 20 bp, Artificial Sequence
  B2M targeting sequence
cagttgaatacaaaggtttt

SEQ ID NO: 6929 - DNA, 20 bp, Artificial Sequence
  B2M targeting sequence
actgtgaaacagcaaccctc

SEQ ID NO: 6930 - DNA, 20 bp, Artificial Sequence
  B2M targeting sequence
tataaaaacctttgtattca

SEQ ID NO: 6931 - DNA, 20 bp, Artificial Sequence
  B2M targeting sequence
cttatctatgtagctgccta

SEQ ID NO: 6932 - DNA, 20 bp, Artificial Sequence
  B2M targeting sequence
atgtagctgcctacgtaact

SEQ ID NO: 6933 - DNA, 20 bp, Artificial Sequence
  B2M targeting sequence
cttatctgtgtagctgcgtg

SEQ ID NO: 6934 - DNA, 20 bp, Artificial Sequence
  B2M targeting sequence
gtgtagctgcgtgtgtagct

SEQ ID NO: 6935 - DNA, 20 bp, Artificial Sequence
  B2M targeting sequence
cttatctgtgcagctgtgag

SEQ ID NO: 6936 - DNA, 20 bp, Artificial Sequence
  B2M targeting sequence
gtgcagctgtgagcatgtct

SEQ ID NO: 6937 - DNA, 20 bp, Artificial Sequence
  B2M targeting sequence
cagctgcacagataagggaa

SEQ ID NO: 6938 - DNA, 20 bp, Artificial Sequence
  B2M targeting sequence
taggcaagcacagggtgcag

SEQ ID NO: 6939 - DNA, 20 bp, Artificial Sequence
  B2M targeting sequence
cttttctcagcaactgcgag

SEQ ID NO: 6940 - DNA, 20 bp, Artificial Sequence
  B2M targeting sequence
tttctcagcaactgcgagta

SEQ ID NO: 6941 - DNA, 20 bp, Artificial Sequence
  B2M targeting sequence
cagcaactgcgagtatgttt

SEQ ID NO: 6942 - DNA, 20 bp, Artificial Sequence
  B2M targeting sequence
gcaactgcgagtatgtttta

SEQ ID NO: 6943 - DNA, 20 bp, Artificial Sequence
  B2M targeting sequence
cagttgctgagaaaagagaa

SEQ ID NO: 6944 - DNA, 20 bp, Artificial Sequence
  B2M targeting sequence
catggagcccaccatgtaca

SEQ ID NO: 6945 - DNA, 20 bp, Artificial Sequence
  B2M targeting sequence
atgggaacttgcaagggggt

SEQ ID NO: 6946 - DNA, 20 bp, Artificial Sequence
  B2M targeting sequence
ggcatgtacatggtgggctc

SEQ ID NO: 6947 - DNA, 20 bp, Artificial Sequence
  B2M targeting sequence
ccttttcaggcatgtacatg

SEQ ID NO: 6948 - DNA, 20 bp, Artificial Sequence
  B2M targeting sequence
tccccttttcaggcatgtac

SEQ ID NO: 6949 - DNA, 20 bp, Artificial Sequence
  B2M targeting sequence
tgggagcccactgattaccc

SEQ ID NO: 6950 - DNA, 20 bp, Artificial Sequence
  B2M targeting sequence
caggaaaaagtttcctcccc

SEQ ID NO: 6951 - DNA, 20 bp, Artificial Sequence
  B2M targeting sequence
gtgggctcccaggaaaaagt

SEQ ID NO: 6952 - DNA, 20 bp, Artificial Sequence
  B2M targeting sequence
ggtaatcagtgggctcccag

SEQ ID NO: 6953 - DNA, 20 bp, Artificial Sequence
  B2M targeting sequence
tcgggtaatcagtgggctcc

SEQ ID NO: 6954 - DNA, 20 bp, Artificial Sequence
  B2M targeting sequence
gttcttcgggtaatcagtgg

SEQ ID NO: 6955 - DNA, 20 bp, Artificial Sequence
  B2M targeting sequence
atgtttggccttgcttcctt

SEQ ID NO: 6956 - DNA, 20 bp, Artificial Sequence
  B2M targeting sequence
ttatctgtgcctgcagcttg

SEQ ID NO: 6957 - DNA, 20 bp, Artificial Sequence
  B2M targeting sequence
gtgcctgcagcttgattttt

SEQ ID NO: 6958 - DNA, 20 bp, Artificial Sequence
  B2M targeting sequence
agctgcaggcacagataagg

SEQ ID NO: 6959 - DNA, 20 bp, Artificial Sequence
  B2M targeting sequence
aggctgctcttttgttggaa

SEQ ID NO: 6960 - DNA, 20 bp, Artificial Sequence
  B2M targeting sequence
tttgttggaaagcatttcac

SEQ ID NO: 6961 - DNA, 20 bp, Artificial Sequence
  B2M targeting sequence
aacaaaagagcagcctggaa

SEQ ID NO: 6962 - DNA, 20 bp, Artificial Sequence
  B2M targeting sequence
ccaaggacctgccctaactg

SEQ ID NO: 6963 - DNA, 20 bp, Artificial Sequence
  B2M targeting sequence
ttggtgaaatgctttccaac

SEQ ID NO: 6964 - DNA, 20 bp, Artificial Sequence
  B2M targeting sequence
ttctcgttcctcatctccca

SEQ ID NO: 6965 - DNA, 20 bp, Artificial Sequence
  B2M targeting sequence
cgttcctcatctcccacctc

SEQ ID NO: 6966 - DNA, 20 bp, Artificial Sequence
  B2M targeting sequence
ttcctcatctcccacctcag

SEQ ID NO: 6967 - DNA, 20 bp, Artificial Sequence
  B2M targeting sequence
tcatctcccacctcaggagt

SEQ ID NO: 6968 - DNA, 20 bp, Artificial Sequence
  B2M targeting sequence
tctcccacctcaggagtgga

SEQ ID NO: 6969 - DNA, 20 bp, Artificial Sequence
  B2M targeting sequence
cccacctcaggagtggagac

SEQ ID NO: 6970 - DNA, 20 bp, Artificial Sequence
  B2M targeting sequence
cacctcaggagtggagactc

SEQ ID NO: 6971 - DNA, 20 bp, Artificial Sequence
  B2M targeting sequence
ggagtggagactctaactgc

SEQ ID NO: 6972 - DNA, 20 bp, Artificial Sequence
  B2M targeting sequence
tgaggtgggagatgaggaac

SEQ ID NO: 6973 - DNA, 20 bp, Artificial Sequence
  B2M targeting sequence
actcctgaggtgggagatga

SEQ ID NO: 6974 - DNA, 20 bp, Artificial Sequence
  B2M targeting sequence
ccactcctgaggtgggagat

SEQ ID NO: 6975 - DNA, 20 bp, Artificial Sequence
  B2M targeting sequence
aactgctgttagggaggtag

SEQ ID NO: 6976 - DNA, 20 bp, Artificial Sequence
  B2M targeting sequence
ctaacagcagttagagtctc

SEQ ID NO: 6977 - DNA, 20 bp, Artificial Sequence
  B2M targeting sequence
ccctacctccctaacagcag

SEQ ID NO: 6978 - DNA, 20 bp, Artificial Sequence
  B2M targeting sequence
ctctggctactttctgctgg

SEQ ID NO: 6979 - DNA, 20 bp, Artificial Sequence
  B2M targeting sequence
ctggctactttctgctggag

SEQ ID NO: 6980 - DNA, 20 bp, Artificial Sequence
  B2M targeting sequence
ggctactttctgctggaggt

SEQ ID NO: 6981 - DNA, 20 bp, Artificial Sequence
  B2M targeting sequence
gctggaggtgggggttgtgt

SEQ ID NO: 6982 - DNA, 20 bp, Artificial Sequence
  B2M targeting sequence
agcagaaagtagccagagag

SEQ ID NO: 6983 - DNA, 20 bp, Artificial Sequence
  B2M targeting sequence
cccacacaacccccacctcc

SEQ ID NO: 6984 - DNA, 20 bp, Artificial Sequence
  B2M targeting sequence
ttctggggcttatctaaggg

SEQ ID NO: 6985 - DNA, 20 bp, Artificial Sequence
  B2M targeting sequence
ggggcttatctaagggtcct

SEQ ID NO: 6986 - DNA, 20 bp, Artificial Sequence
  B2M targeting sequence
aagggtcctcagaagaaagg

SEQ ID NO: 6987 - DNA, 20 bp, Artificial Sequence
  B2M targeting sequence
tcagaagaaaggtgtgtcta

SEQ ID NO: 6988 - DNA, 20 bp, Artificial Sequence
  B2M targeting sequence
gaagaaaggtgtgtctatgt

SEQ ID NO: 6989 - DNA, 20 bp, Artificial Sequence
  B2M targeting sequence
gaggacccttagataagccc

SEQ ID NO: 6990 - DNA, 20 bp, Artificial Sequence
  B2M targeting sequence
tctgaggacccttagataag

SEQ ID NO: 6991 - DNA, 20 bp, Artificial Sequence
  B2M targeting sequence
atgtgtggttccatttgcat

SEQ ID NO: 6992 - DNA, 20 bp, Artificial Sequence
  B2M targeting sequence
atttgcatcaccatttggag

SEQ ID NO: 6993 - DNA, 20 bp, Artificial Sequence
  B2M targeting sequence
ccatttggagtttgataacc

SEQ ID NO: 6994 - DNA, 20 bp, Artificial Sequence
  B2M targeting sequence
aaatggtgatgcaaatggaa

SEQ ID NO: 6995 - DNA, 20 bp, Artificial Sequence
  B2M targeting sequence
aactccaaatggtgatgcaa

SEQ ID NO: 6996 - DNA, 20 bp, Artificial Sequence
  B2M targeting sequence
aggcgagaaaaaacaatgtg

SEQ ID NO: 6997 - DNA, 20 bp, Artificial Sequence
  B2M targeting sequence
cctagaggttatcaaactcc

SEQ ID NO: 6998 - DNA, 20 bp, Artificial Sequence
  B2M targeting sequence
cgcctagaggttatcaaact

SEQ ID NO: 6999 - DNA, 20 bp, Artificial Sequence
  B2M targeting sequence
aataacccacattgtttttt

SEQ ID NO: 7000 - DNA, 20 bp, Artificial Sequence
  B2M targeting sequence
tctaataacccacattgttt

SEQ ID NO: 7001 - DNA, 20 bp, Artificial Sequence
  B2M targeting sequence
aaacaagacaagggggtaag

SEQ ID NO: 7002 - DNA, 20 bp, Artificial Sequence
  B2M targeting sequence
tgttttgatatatgtcttct

SEQ ID NO: 7003 - DNA, 20 bp, Artificial Sequence
  B2M targeting sequence
tacccccttgtcttgttttg

SEQ ID NO: 7004 - DNA, 20 bp, Artificial Sequence
  B2M targeting sequence
aaaatcccaaagctgacaat

SEQ ID NO: 7005 - DNA, 20 bp, Artificial Sequence
  B2M targeting sequence
caaagctgacaatgtgccca

SEQ ID NO: 7006 - DNA, 20 bp, Artificial Sequence
  B2M targeting sequence
gctttgggatttttgagctt

SEQ ID NO: 7007 - DNA, 20 bp, Artificial Sequence
  B2M targeting sequence
gggcacattgtcagctttgg

SEQ ID NO: 7008 - DNA, 20 bp, Artificial Sequence
  B2M targeting sequence
tggcaggcataactatagct

SEQ ID NO: 7009 - DNA, 20 bp, Artificial Sequence
  B2M targeting sequence
catgcacccaaatcttggca

SEQ ID NO: 7010 - DNA, 20 bp, Artificial Sequence
  B2M targeting sequence
cttggtcttattttcccaaa

SEQ ID NO: 7011 - DNA, 20 bp, Artificial Sequence
  B2M targeting sequence
tattttcccaaacaaggaaa

SEQ ID NO: 7012 - DNA, 20 bp, Artificial Sequence
  B2M targeting sequence
caaacaaggaaacctctgag

SEQ ID NO: 7013 - DNA, 20 bp, Artificial Sequence
  B2M targeting sequence
ttgtttgggaaaataagacc

SEQ ID NO: 7014 - DNA, 20 bp, Artificial Sequence
  B2M targeting sequence
gagttatgggctgcccattc

SEQ ID NO: 7015 - DNA, 20 bp, Artificial Sequence
  B2M targeting sequence
gaggtttccttgtttgggaa

SEQ ID NO: 7016 - DNA, 20 bp, Artificial Sequence
  B2M targeting sequence
ttcccatcatctggcaggat

SEQ ID NO: 7017 - DNA, 20 bp, Artificial Sequence
  B2M targeting sequence
catcatctggcaggatttgc

SEQ ID NO: 7018 - DNA, 20 bp, Artificial Sequence
  B2M targeting sequence
tctggcaggatttgcaggat

SEQ ID NO: 7019 - DNA, 20 bp, Artificial Sequence
  B2M targeting sequence
ggcaggatttgcaggataat

SEQ ID NO: 7020 - DNA, 20 bp, Artificial Sequence
  B2M targeting sequence
tgccagatgatgggaatgaa

SEQ ID NO: 7021 - DNA, 20 bp, Artificial Sequence
  B2M targeting sequence
tgcaaatcctgccagatgat

SEQ ID NO: 7022 - DNA, 20 bp, Artificial Sequence
  B2M targeting sequence
gaattaaaatattgatccag

SEQ ID NO: 7023 - DNA, 20 bp, Artificial Sequence
  B2M targeting sequence
gagcaattatcctgcaaatc

SEQ ID NO: 7024 - DNA, 20 bp, Artificial Sequence
  B2M targeting sequence
atattttaattctgagcaat

SEQ ID NO: 7025 - DNA, 20 bp, Artificial Sequence
  B2M targeting sequence
agattttttatattactgat

SEQ ID NO: 7026 - DNA, 20 bp, Artificial Sequence
  B2M targeting sequence
ggatcaatattttaattctg

SEQ ID NO: 7027 - DNA, 20 bp, Artificial Sequence
  B2M targeting sequence
gtaatataaaaaatctggat

SEQ ID NO: 7028 - DNA, 20 bp, Artificial Sequence
  B2M targeting sequence
cttttgtttcttctgagttg

SEQ ID NO: 7029 - DNA, 20 bp, Artificial Sequence
  B2M targeting sequence
tttgtttcttctgagttgca

SEQ ID NO: 7030 - DNA, 20 bp, Artificial Sequence
  B2M targeting sequence
tctgagttgcagccagagat

SEQ ID NO: 7031 - DNA, 20 bp, Artificial Sequence
  B2M targeting sequence
gagttgcagccagagatcgc

SEQ ID NO: 7032 - DNA, 20 bp, Artificial Sequence
  B2M targeting sequence
gaagaaacaaaagagatcag

SEQ ID NO: 7033 - DNA, 20 bp, Artificial Sequence
  B2M targeting sequence
ggctgcaactcagaagaaac

SEQ ID NO: 7034 - DNA, 20 bp, Artificial Sequence
  B2M targeting sequence
ctggctgcaactcagaagaa

SEQ ID NO: 7035 - DNA, 20 bp, Artificial Sequence
  B2M targeting sequence
ctgattggttcacaggaata

SEQ ID NO: 7036 - DNA, 20 bp, Artificial Sequence
  B2M targeting sequence
gcgatctctggctgcaactc

SEQ ID NO: 7037 - DNA, 20 bp, Artificial Sequence
  B2M targeting sequence
caggaataagcatggttagt

SEQ ID NO: 7038 - DNA, 20 bp, Artificial Sequence
  B2M targeting sequence
tgtgaaccaatcagcgatct

SEQ ID NO: 7039 - DNA, 20 bp, Artificial Sequence
  B2M targeting sequence
aaaatgtaggctaagttttt

SEQ ID NO: 7040 - DNA, 20 bp, Artificial Sequence
  B2M targeting sequence
ttagttttaagtttttactt

SEQ ID NO: 7041 - DNA, 20 bp, Artificial Sequence
  B2M targeting sequence
cattagttttaagtttttac

SEQ ID NO: 7042 - DNA, 20 bp, Artificial Sequence
  B2M targeting sequence
aatctcattagttttaagtt

SEQ ID NO: 7043 - DNA, 20 bp, Artificial Sequence
  B2M targeting sequence
attaaattctaatctcatta

SEQ ID NO: 7044 - DNA, 20 bp, Artificial Sequence
  B2M targeting sequence
tacatttgtccattaaattc

SEQ ID NO: 7045 - DNA, 20 bp, Artificial Sequence
  B2M targeting sequence
aaacttatcatacatttgtc

SEQ ID NO: 7046 - DNA, 20 bp, Artificial Sequence
  B2M targeting sequence
cttgccagtcctcacttttg

SEQ ID NO: 7047 - DNA, 20 bp, Artificial Sequence
  B2M targeting sequence
tgccagtcctcacttttgtc

SEQ ID NO: 7048 - DNA, 20 bp, Artificial Sequence
  B2M targeting sequence
tcacttttgtcaaaaacaaa

SEQ ID NO: 7049 - DNA, 20 bp, Artificial Sequence
  B2M targeting sequence
cttttgtcaaaaacaaatca

SEQ ID NO: 7050 - DNA, 20 bp, Artificial Sequence
  B2M targeting sequence
aaaacaaatcacagtaagac

SEQ ID NO: 7051 - DNA, 20 bp, Artificial Sequence
  B2M targeting sequence
cagtaagactgagttgtttg

SEQ ID NO: 7052 - DNA, 20 bp, Artificial Sequence
  B2M targeting sequence
tactgtgatttgtttttgac

SEQ ID NO: 7053 - DNA, 20 bp, Artificial Sequence
  B2M targeting sequence
gtcttactgtgatttgtttt

SEQ ID NO: 7054 - DNA, 20 bp, Artificial Sequence
  B2M targeting sequence
tatacttggcctgattattt

SEQ ID NO: 7055 - DNA, 20 bp, Artificial Sequence
  B2M targeting sequence
ggccaagtataagactaaag

SEQ ID NO: 7056 - DNA, 20 bp, Artificial Sequence
  B2M targeting sequence
tgctgtactttatgcaaata

SEQ ID NO: 7057 - DNA, 20 bp, Artificial Sequence
  B2M targeting sequence
acataggcttttaaaattgg

SEQ ID NO: 7058 - DNA, 20 bp, Artificial Sequence
  B2M targeting sequence
aagccaattttaaaagccta

SEQ ID NO: 7059 - DNA, 20 bp, Artificial Sequence
  B2M targeting sequence
tcaaagccaattttaaaagc

SEQ ID NO: 7060 - DNA, 20 bp, Artificial Sequence
  B2M targeting sequence
gttttgcgaggaacttcaga

SEQ ID NO: 7061 - DNA, 20 bp, Artificial Sequence
  B2M targeting sequence
caaaacagagtttcatcaaa

SEQ ID NO: 7062 - DNA, 20 bp, Artificial Sequence
  B2M targeting sequence
tcgcaaaacagagtttcatc

SEQ ID NO: 7063 - DNA, 20 bp, Artificial Sequence
  B2M targeting sequence
gataggacttttcttttttt

SEQ ID NO: 7064 - DNA, 20 bp, Artificial Sequence
  B2M targeting sequence
gaagttcctcgcaaaacaga

SEQ ID NO: 7065 - DNA, 20 bp, Artificial Sequence
  B2M targeting sequence
tatctgaagttcctcgcaaa

SEQ ID NO: 7066 - DNA, 20 bp, Artificial Sequence
  B2M targeting sequence
ttttttttgagacggagtct

SEQ ID NO: 7067 - DNA, 20 bp, Artificial Sequence
  B2M targeting sequence
aaaaaaaagaaaagtcctat

SEQ ID NO: 7068 - DNA, 20 bp, Artificial Sequence
  B2M targeting sequence
caaaaaaaaagaaaagtcct

SEQ ID NO: 7069 - DNA, 20 bp, Artificial Sequence
  B2M targeting sequence
gtctcaaaaaaaaagaaaag

SEQ ID NO: 7070 - DNA, 20 bp, Artificial Sequence
  B2M targeting sequence
cgcactctcgcccaggctgg

SEQ ID NO: 7071 - DNA, 20 bp, Artificial Sequence
  B2M targeting sequence
cactctcgcccaggctggag

SEQ ID NO: 7072 - DNA, 20 bp, Artificial Sequence
  B2M targeting sequence
cgcccaggctggagtgcagt

SEQ ID NO: 7073 - DNA, 20 bp, Artificial Sequence
  B2M targeting sequence
cccaggctggagtgcagtgg

SEQ ID NO: 7074 - DNA, 20 bp, Artificial Sequence
  B2M targeting sequence
agcctgggcgagagtgcgag

SEQ ID NO: 7075 - DNA, 20 bp, Artificial Sequence
  B2M targeting sequence
ggctcactgcaagctctgcc

SEQ ID NO: 7076 - DNA, 20 bp, Artificial Sequence
  B2M targeting sequence
ctgcaagctctgcctcctgg

SEQ ID NO: 7077 - DNA, 20 bp, Artificial Sequence
  B2M targeting sequence
gcctcctgggttcatgccat

SEQ ID NO: 7078 - DNA, 20 bp, Artificial Sequence
  B2M targeting sequence
tgggttcatgccattctcct

SEQ ID NO: 7079 - DNA, 20 bp, Artificial Sequence
  B2M targeting sequence
tgccattctcctgcctcagc

SEQ ID NO: 7080 - DNA, 20 bp, Artificial Sequence
  B2M targeting sequence
cctgcctcagcctcctgagt

SEQ ID NO: 7081 - DNA, 20 bp, Artificial Sequence
  B2M targeting sequence
tgcctcagcctcctgagtag

SEQ ID NO: 7082 - DNA, 20 bp, Artificial Sequence
  B2M targeting sequence
gcctcctgagtagctgggac

SEQ ID NO: 7083 - DNA, 20 bp, Artificial Sequence
  B2M targeting sequence
tgagtagctgggactacagg

SEQ ID NO: 7084 - DNA, 20 bp, Artificial Sequence
  B2M targeting sequence
ggaggctgaggcaggagaat

SEQ ID NO: 7085 - DNA, 20 bp, Artificial Sequence
  B2M targeting sequence
cagctactcaggaggctgag

SEQ ID NO: 7086 - RNA, 20 nt, Artificial Sequence
  TRAC targeting sequence
aaacaaagcaauaugauagg

SEQ ID NO: 7087 - RNA, 20 nt, Artificial Sequence
  TRAC targeting sequence
agugcugucaaaacaaagca

SEQ ID NO: 7088 - RNA, 20 nt, Artificial Sequence
  TRAC targeting sequence
guucuagugcugucaaaaca

SEQ ID NO: 7089 - RNA, 20 nt, Artificial Sequence
  TRAC targeting sequence
cuguucuagugcugucaaaa

SEQ ID NO: 7090 - RNA, 20 nt, Artificial Sequence
  TRAC targeting sequence
aaggcaaacaagaccagugu

SEQ ID NO: 7091 - RNA, 20 nt, Artificial Sequence
  TRAC targeting sequence
uguuugccuuugaucucugu

SEQ ID NO: 7092 - RNA, 20 nt, Artificial Sequence
  TRAC targeting sequence
ugugagcccugaggagaggu

SEQ ID NO: 7093 - RNA, 20 nt, Artificial Sequence
  TRAC targeting sequence
caagacacuggucuuguuug

SEQ ID NO: 7094 - RNA, 20 nt, Artificial Sequence
  TRAC targeting sequence
gggcucacaagacacugguc

SEQ ID NO: 7095 - RNA, 20 nt, Artificial Sequence
  TRAC targeting sequence
ucagggcucacaagacacug

SEQ ID NO: 7096 - RNA, 20 nt, Artificial Sequence
  TRAC targeting sequence
uccggaaagggaaggccuuu

SEQ ID NO: 7097 - RNA, 20 nt, Artificial Sequence
  TRAC targeting sequence
ggaaagggaaggccuuuuau

SEQ ID NO: 7098 - RNA, 20 nt, Artificial Sequence
  TRAC targeting sequence
ggaagaugcaacgccacauc

SEQ ID NO: 7099 - RNA, 20 nt, Artificial Sequence
  TRAC targeting sequence
cuuuccggaagaugcaacgc

SEQ ID NO: 7100 - RNA, 20 nt, Artificial Sequence
  TRAC targeting sequence
guucgccaagcuugaaccca

SEQ ID NO: 7101 - RNA, 20 nt, Artificial Sequence
  TRAC targeting sequence
ccaagcuugaacccaagggg

SEQ ID NO: 7102 - RNA, 20 nt, Artificial Sequence
  TRAC targeting sequence
agcuuggcgaacagauugca

SEQ ID NO: 7103 - RNA, 20 nt, Artificial Sequence
  TRAC targeting sequence
cacaaagcaccauaugggcu

SEQ ID NO: 7104 - RNA, 20 nt, Artificial Sequence
  TRAC targeting sequence
ggccaguagcccauauggug

SEQ ID NO: 7105 - RNA, 20 nt, Artificial Sequence
  TRAC targeting sequence
caguugcuaaauucaggcca

SEQ ID NO: 7106 - RNA, 20 nt, Artificial Sequence
  TRAC targeting sequence
ucccaguugcuaaauucagg

SEQ ID NO: 7107 - RNA, 20 nt, Artificial Sequence
  TRAC targeting sequence
auggaggggacacaauuuua

SEQ ID NO: 7108 - RNA, 20 nt, Artificial Sequence
  TRAC targeting sequence
auugaccuccucccaguugc

SEQ ID NO: 7109 - RNA, 20 nt, Artificial Sequence
  TRAC targeting sequence
ccuccauugaccuccuccca

SEQ ID NO: 7110 - RNA, 20 nt, Artificial Sequence
  TRAC targeting sequence
uguaaauuuaaaauuguguc

SEQ ID NO: 7111 - RNA, 20 nt, Artificial Sequence
  TRAC targeting sequence
uccugcuuuacacuugaaua

SEQ ID NO: 7112 - RNA, 20 nt, Artificial Sequence
  TRAC targeting sequence
ccucuuccugcuuuacacuu

SEQ ID NO: 7113 - RNA, 20 nt, Artificial Sequence
  TRAC targeting sequence
gaagcuuagcaggugacagg

SEQ ID NO: 7114 - RNA, 20 nt, Artificial Sequence
  TRAC targeting sequence
gaaucaccucuuccugcuuu

SEQ ID NO: 7115 - RNA, 20 nt, Artificial Sequence
  TRAC targeting sequence
ccugcuaagcuucugaauca

SEQ ID NO: 7116 - RNA, 20 nt, Artificial Sequence
  TRAC targeting sequence
ugucaccugcuaagcuucug

SEQ ID NO: 7117 - RNA, 20 nt, Artificial Sequence
  TRAC targeting sequence
ccugucaccugcuaagcuuc

SEQ ID NO: 7118 - RNA, 20 nt, Artificial Sequence
  TRAC targeting sequence
guguaauuucuccugucacc

SEQ ID NO: 7119 - RNA, 20 nt, Artificial Sequence
  TRAC targeting sequence
gccuaacccacagcauguag

SEQ ID NO: 7120 - RNA, 20 nt, Artificial Sequence
  TRAC targeting sequence
gugggaaaccauuugagggc

SEQ ID NO: 7121 - RNA, 20 nt, Artificial Sequence
  TRAC targeting sequence
cacugaggaguuugucgggu

SEQ ID NO: 7122 - RNA, 20 nt, Artificial Sequence
  TRAC targeting sequence
aaugguuucccacugaggag

SEQ ID NO: 7123 - RNA, 20 nt, Artificial Sequence
  TRAC targeting sequence
gcccucaaaugguuucccac

SEQ ID NO: 7124 - RNA, 20 nt, Artificial Sequence
  TRAC targeting sequence
ggccagucugcccucaaaug

SEQ ID NO: 7125 - RNA, 20 nt, Artificial Sequence
  TRAC targeting sequence
gugcuuucuggccagucugc

SEQ ID NO: 7126 - RNA, 20 nt, Artificial Sequence
  TRAC targeting sequence
caucugugcuuucuggccag

SEQ ID NO: 7127 - RNA, 20 nt, Artificial Sequence
  TRAC targeting sequence
auucccaucugugcuuucug

SEQ ID NO: 7128 - RNA, 20 nt, Artificial Sequence
  TRAC targeting sequence
cauccauucccaucugugcu

SEQ ID NO: 7129 - RNA, 20 nt, Artificial Sequence
  TRAC targeting sequence
aaaaguccauucuagucaca

SEQ ID NO: 7130 - RNA, 20 nt, Artificial Sequence
  TRAC targeting sequence
auucuagucacaaaccccaa

SEQ ID NO: 7131 - RNA, 20 nt, Artificial Sequence
  TRAC targeting sequence
agucacaaaccccaaggcag

SEQ ID NO: 7132 - RNA, 20 nt, Artificial Sequence
  TRAC targeting sequence
ggggcucuucugccccacug

SEQ ID NO: 7133 - RNA, 20 nt, Artificial Sequence
  TRAC targeting sequence
gucuggggcucuucugcccc

SEQ ID NO: 7134 - RNA, 20 nt, Artificial Sequence
  TRAC targeting sequence
ggugcuucugucuggggcuc

SEQ ID NO: 7135 - RNA, 20 nt, Artificial Sequence
  TRAC targeting sequence
ggccaagcuggcucaggugc

SEQ ID NO: 7136 - RNA, 20 nt, Artificial Sequence
  TRAC targeting sequence
ggacccuuugaucuugcugg

SEQ ID NO: 7137 - RNA, 20 nt, Artificial Sequence
  TRAC targeting sequence
ugacaguuaggucaggccaa

SEQ ID NO: 7138 - RNA, 20 nt, Artificial Sequence
  TRAC targeting sequence
aaggguccugacaguuaggu

SEQ ID NO: 7139 - RNA, 20 nt, Artificial Sequence
  TRAC targeting sequence
ugcuggagcuugacuuggag

SEQ ID NO: 7140 - RNA, 20 nt, Artificial Sequence
  TRAC targeting sequence
agcaagaucaaaggguccug

SEQ ID NO: 7141 - RNA, 20 nt, Artificial Sequence
  TRAC targeting sequence
agcuccagcaagaucaaagg

SEQ ID NO: 7142 - RNA, 20 nt, Artificial Sequence
  TRAC targeting sequence
aagucaagcuccagcaagau

SEQ ID NO: 7143 - RNA, 20 nt, Artificial Sequence
  TRAC targeting sequence
ccaagucaagcuccagcaag

SEQ ID NO: 7144 - RNA, 20 nt, Artificial Sequence
  TRAC targeting sequence
gguucuggggauucucaggg

SEQ ID NO: 7145 - RNA, 20 nt, Artificial Sequence
  TRAC targeting sequence
ggggauucucaggggccaua

SEQ ID NO: 7146 - RNA, 20 nt, Artificial Sequence
  TRAC targeting sequence
ccagaaccagauguuuucuc

SEQ ID NO: 7147 - RNA, 20 nt, Artificial Sequence
  TRAC targeting sequence
caggggccauauagugugaa

SEQ ID NO: 7148 - RNA, 20 nt, Artificial Sequence
  TRAC targeting sequence
ggggccauauagugugaaac

SEQ ID NO: 7149 - RNA, 20 nt, Artificial Sequence
  TRAC targeting sequence
cacuauauggccccugagaa

SEQ ID NO: 7150 - RNA, 20 nt, Artificial Sequence
  TRAC targeting sequence
guuucacacuauauggcccc

SEQ ID NO: 7151 - RNA, 20 nt, Artificial Sequence
  TRAC targeting sequence
ccucgguuucacacuauaug

SEQ ID NO: 7152 - RNA, 20 nt, Artificial Sequence
  TRAC targeting sequence
guagcacugugacuggggga

SEQ ID NO: 7153 - RNA, 20 nt, Artificial Sequence
  TRAC targeting sequence
cagugcuacagagcuuuaca

SEQ ID NO: 7154 - RNA, 20 nt, Artificial Sequence
  TRAC targeting sequence
cccagucacagugcuacaga

SEQ ID NO: 7155 - RNA, 20 nt, Artificial Sequence
  TRAC targeting sequence
guagguuuuguagcacugug

SEQ ID NO: 7156 - RNA, 20 nt, Artificial Sequence
  TRAC targeting sequence
cuguagguuuuguagcacug

SEQ ID NO: 7157 - RNA, 20 nt, Artificial Sequence
  TRAC targeting sequence
cugggauauccucacccugg

SEQ ID NO: 7158 - RNA, 20 nt, Artificial Sequence
  TRAC targeting sequence
cagggaaauggcacuuuugc

SEQ ID NO: 7159 - RNA, 20 nt, Artificial Sequence
  TRAC targeting sequence
ucacccugggucccaugccu

SEQ ID NO: 7160 - RNA, 20 nt, Artificial Sequence
  TRAC targeting sequence
cccugggucccaugccucag

SEQ ID NO: 7161 - RNA, 20 nt, Artificial Sequence
  TRAC targeting sequence
uuugcaauagaaucaacaug

SEQ ID NO: 7162 - RNA, 20 nt, Artificial Sequence
  TRAC targeting sequence
cuuuugcaauagaaucaaca

SEQ ID NO: 7163 - RNA, 20 nt, Artificial Sequence
  TRAC targeting sequence
uauaacucucuuuugcaaua

SEQ ID NO: 7164 - RNA, 20 nt, Artificial Sequence
  TRAC targeting sequence
uacggaauuucuaaauucaa

SEQ ID NO: 7165 - RNA, 20 nt, Artificial Sequence
  TRAC targeting sequence
guaugagguggcucauauaa

SEQ ID NO: 7166 - RNA, 20 nt, Artificial Sequence
  TRAC targeting sequence
aaauucaaaccucuagagag

SEQ ID NO: 7167 - RNA, 20 nt, Artificial Sequence
  TRAC targeting sequence
aaccucuagagagauuuacc

SEQ ID NO: 7168 - RNA, 20 nt, Artificial Sequence
  TRAC targeting sequence
agagagauuuacccaagugc

SEQ ID NO: 7169 - RNA, 20 nt, Artificial Sequence
  TRAC targeting sequence
agagguuugaauuuagaaau

SEQ ID NO: 7170 - RNA, 20 nt, Artificial Sequence
  TRAC targeting sequence
cuagagguuugaauuuagaa

SEQ ID NO: 7171 - RNA, 20 nt, Artificial Sequence
  TRAC targeting sequence
cucuagagguuugaauuuag

SEQ ID NO: 7172 - RNA, 20 nt, Artificial Sequence
  TRAC targeting sequence
caaacugcaaagcaaagcac

SEQ ID NO: 7173 - RNA, 20 nt, Artificial Sequence
  TRAC targeting sequence
gagcacugcaucaaguguac

SEQ ID NO: 7174 - RNA, 20 nt, Artificial Sequence
  TRAC targeting sequence
gaacuguugcuuucuauugu

SEQ ID NO: 7175 - RNA, 20 nt, Artificial Sequence
  TRAC targeting sequence
aguguacugugcuggaaagg

SEQ ID NO: 7176 - RNA, 20 nt, Artificial Sequence
  TRAC targeting sequence
agcacaguacacuugaugca

SEQ ID NO: 7177 - RNA, 20 nt, Artificial Sequence
  TRAC targeting sequence
gccauaggaaauaugguccu

SEQ ID NO: 7178 - RNA, 20 nt, Artificial Sequence
  TRAC targeting sequence
uauggcggaccuuuccagca

SEQ ID NO: 7179 - RNA, 20 nt, Artificial Sequence
  TRAC targeting sequence
uccauacuccucagacaaca

SEQ ID NO: 7180 - RNA, 20 nt, Artificial Sequence
  TRAC targeting sequence
auacuccucagacaacagcc

SEQ ID NO: 7181 - RNA, 20 nt, Artificial Sequence
  TRAC targeting sequence
ucagacaacagccuuccgaa

SEQ ID NO: 7182 - RNA, 20 nt, Artificial Sequence
  TRAC targeting sequence
gcuuuaggacuggaggaucu

SEQ ID NO: 7183 - RNA, 20 nt, Artificial Sequence
  TRAC targeting sequence
cgucagcuuuaggacuggag

SEQ ID NO: 7184 - RNA, 20 nt, Artificial Sequence
  TRAC targeting sequence
ucccgucagcuuuaggacug

SEQ ID NO: 7185 - RNA, 20 nt, Artificial Sequence
  TRAC targeting sequence
caccuaccuucuucccguca

SEQ ID NO: 7186 - RNA, 20 nt, Artificial Sequence
  TRAC targeting sequence
gcgcugcucccaccuaccuu

SEQ ID NO: 7187 - RNA, 20 nt, Artificial Sequence
  TRAC targeting sequence
aaaaaccucagcgcugcucc

SEQ ID NO: 7188 - RNA, 20 nt, Artificial Sequence
  TRAC targeting sequence
ucaagugcugugacaccgau

SEQ ID NO: 7189 - RNA, 20 nt, Artificial Sequence
  TRAC targeting sequence
agugcugugacaccgauaaa

SEQ ID NO: 7190 - RNA, 20 nt, Artificial Sequence
  TRAC targeting sequence
cagcacuugaggacguucca

SEQ ID NO: 7191 - RNA, 20 nt, Artificial Sequence
  TRAC targeting sequence
gugucacagcacuugaggac

SEQ ID NO: 7192 - RNA, 20 nt, Artificial Sequence
  TRAC targeting sequence
ucuuuggaaaaggaacccgu

SEQ ID NO: 7193 - RNA, 20 nt, Artificial Sequence
  TRAC targeting sequence
uuggaaaaggaacccgugug

SEQ ID NO: 7194 - RNA, 20 nt, Artificial Sequence
  TRAC targeting sequence
aaagaugaguuuaucggugu

SEQ ID NO: 7195 - RNA, 20 nt, Artificial Sequence
  TRAC targeting sequence
uuuuccaaagaugaguuuau

SEQ ID NO: 7196 - RNA, 20 nt, Artificial Sequence
  TRAC targeting sequence
cacggguuccuuuuccaaag

SEQ ID NO: 7197 - RNA, 20 nt, Artificial Sequence
  TRAC targeting sequence
acagucacacggguuccuuu

SEQ ID NO: 7198 - RNA, 20 nt, Artificial Sequence
  TRAC targeting sequence
uuuauuuaucugaaguuuaa

SEQ ID NO: 7199 - RNA, 20 nt, Artificial Sequence
  TRAC targeting sequence
gaaguuuaagguuaaggcau

SEQ ID NO: 7200 - RNA, 20 nt, Artificial Sequence
  TRAC targeting sequence
gauaaauaaaugaguuacuu

SEQ ID NO: 7201 - RNA, 20 nt, Artificial Sequence
  TRAC targeting sequence
cccauuucccauuucaggau

SEQ ID NO: 7202 - RNA, 20 nt, Artificial Sequence
  TRAC targeting sequence
uaaaugcuagcuauuucacc

SEQ ID NO: 7203 - RNA, 20 nt, Artificial Sequence
  TRAC targeting sequence
uccuaaaugcuagcuauuuc

SEQ ID NO: 7204 - RNA, 20 nt, Artificial Sequence
  TRAC targeting sequence
ugggaagaggugaaauaugg

SEQ ID NO: 7205 - RNA, 20 nt, Artificial Sequence
  TRAC targeting sequence
caggaguccuccuaaaugcu

SEQ ID NO: 7206 - RNA, 20 nt, Artificial Sequence
  TRAC targeting sequence
ucccaggaguccuccuaaau

SEQ ID NO: 7207 - RNA, 20 nt, Artificial Sequence
  TRAC targeting sequence
ccucuucccaggaguccucc

SEQ ID NO: 7208 - RNA, 20 nt, Artificial Sequence
  TRAC targeting sequence
uuuccauaggagaggagcag

SEQ ID NO: 7209 - RNA, 20 nt, Artificial Sequence
  TRAC targeting sequence
auaggagaggagcagaaggu

SEQ ID NO: 7210 - RNA, 20 nt, Artificial Sequence
  TRAC targeting sequence
uauggaaaggauuaaccaua

SEQ ID NO: 7211 - RNA, 20 nt, Artificial Sequence
  TRAC targeting sequence
ccuauggaaaggauuaacca

SEQ ID NO: 7212 - RNA, 20 nt, Artificial Sequence
  TRAC targeting sequence
ucuccuauggaaaggauuaa

SEQ ID NO: 7213 - RNA, 20 nt, Artificial Sequence
  TRAC targeting sequence
gcuccucuccuauggaaagg

SEQ ID NO: 7214 - RNA, 20 nt, Artificial Sequence
  TRAC targeting sequence
guaaaaaaagaguuuggggc

SEQ ID NO: 7215 - RNA, 20 nt, Artificial Sequence
  TRAC targeting sequence
uuuuuuacagacaccuucug

SEQ ID NO: 7216 - RNA, 20 nt, Artificial Sequence
  TRAC targeting sequence
uaugccccaaacucuuuuuu

SEQ ID NO: 7217 - RNA, 20 nt, Artificial Sequence
  TRAC targeting sequence
cuucauaugccccaaacucu

SEQ ID NO: 7218 - RNA, 20 nt, Artificial Sequence
  TRAC targeting sequence
ggcucagaggaaacagagaa

SEQ ID NO: 7219 - RNA, 20 nt, Artificial Sequence
  TRAC targeting sequence
ccccacccuccaugcccagg

SEQ ID NO: 7220 - RNA, 20 nt, Artificial Sequence
  TRAC targeting sequence
cugguguugcgauauuucuc

SEQ ID NO: 7221 - RNA, 20 nt, Artificial Sequence
  TRAC targeting sequence
caacaccagggacuacuugc

SEQ ID NO: 7222 - RNA, 20 nt, Artificial Sequence
  TRAC targeting sequence
cuuuagaagaaaauaaccug

SEQ ID NO: 7223 - RNA, 20 nt, Artificial Sequence
  TRAC targeting sequence
uuagaagaaaauaaccuguu

SEQ ID NO: 7224 - RNA, 20 nt, Artificial Sequence
  TRAC targeting sequence
aaagagaaauaucgcaacac

SEQ ID NO: 7225 - RNA, 20 nt, Artificial Sequence
  TRAC targeting sequence
ucuaaagagaaauaucgcaa

SEQ ID NO: 7226 - RNA, 20 nt, Artificial Sequence
  TRAC targeting sequence
gacauuuguuucuaauuguu

SEQ ID NO: 7227 - RNA, 20 nt, Artificial Sequence
  TRAC targeting sequence
gaaacagguuauuuucuucu

SEQ ID NO: 7228 - RNA, 20 nt, Artificial Sequence
  TRAC targeting sequence
aauuguuugagcugcaaaug

SEQ ID NO: 7229 - RNA, 20 nt, Artificial Sequence
  TRAC targeting sequence
aacaauuagaaacaaauguc

SEQ ID NO: 7230 - RNA, 20 nt, Artificial Sequence
  TRAC targeting sequence
uuugcagcucaaacaauuag

SEQ ID NO: 7231 - RNA, 20 nt, Artificial Sequence
  TRAC targeting sequence
cuaguaaccuaguuuucauu

SEQ ID NO: 7232 - RNA, 20 nt, Artificial Sequence
  TRAC targeting sequence
cacuaguaaccuaguuuuca

SEQ ID NO: 7233 - RNA, 20 nt, Artificial Sequence
  TRAC targeting sequence
cauauuucucacuaguaacc

SEQ ID NO: 7234 - RNA, 20 nt, Artificial Sequence
  TRAC targeting sequence
gguucccacugagaccagau

SEQ ID NO: 7235 - RNA, 20 nt, Artificial Sequence
  TRAC targeting sequence
cacugagaccagauuccaag

SEQ ID NO: 7236 - RNA, 20 nt, Artificial Sequence
  TRAC targeting sequence
gugggaaccagaauguccca

SEQ ID NO: 7237 - RNA, 20 nt, Artificial Sequence
  TRAC targeting sequence
cagugggaaccagaaugucc

SEQ ID NO: 7238 - RNA, 20 nt, Artificial Sequence
  TRAC targeting sequence
ggucucagugggaaccagaa

SEQ ID NO: 7239 - RNA, 20 nt, Artificial Sequence
  TRAC targeting sequence
aagcaggacaaagugaaugu

SEQ ID NO: 7240 - RNA, 20 nt, Artificial Sequence
  TRAC targeting sequence
ugcuuggaaucuggucucag

SEQ ID NO: 7241 - RNA, 20 nt, Artificial Sequence
  TRAC targeting sequence
cuuuguccugcuuggaaucu

SEQ ID NO: 7242 - RNA, 20 nt, Artificial Sequence
  TRAC targeting sequence
aacuaagaaaugcuuugaag

SEQ ID NO: 7243 - RNA, 20 nt, Artificial Sequence
  TRAC targeting sequence
uaguuggaagcacuacacau

SEQ ID NO: 7244 - RNA, 20 nt, Artificial Sequence
  TRAC targeting sequence
aagcauuucuuaguuggaag

SEQ ID NO: 7245 - RNA, 20 nt, Artificial Sequence
  TRAC targeting sequence
ccaggacacagccaggagag

SEQ ID NO: 7246 - RNA, 20 nt, Artificial Sequence
  TRAC targeting sequence
aggacacagccaggagaguu

SEQ ID NO: 7247 - RNA, 20 nt, Artificial Sequence
  TRAC targeting sequence
uggagacuucaaagcauuuc

SEQ ID NO: 7248 - RNA, 20 nt, Artificial Sequence
  TRAC targeting sequence
uggcuguguccuggagacuu

SEQ ID NO: 7249 - RNA, 20 nt, Artificial Sequence
  TRAC targeting sequence
ccuggcuguguccuggagac

SEQ ID NO: 7250 - RNA, 20 nt, Artificial Sequence
  TRAC targeting sequence
guguugagcacaauccuuca

SEQ ID NO: 7251 - RNA, 20 nt, Artificial Sequence
  TRAC targeting sequence
uugguguccuuucaaugaca

SEQ ID NO: 7252 - RNA, 20 nt, Artificial Sequence
  TRAC targeting sequence
uuucaaugacauuugaauuc

SEQ ID NO: 7253 - RNA, 20 nt, Artificial Sequence
  TRAC targeting sequence
augacauuugaauucgaccg

SEQ ID NO: 7254 - RNA, 20 nt, Artificial Sequence
  TRAC targeting sequence
uugaaaggacaccaaagaug

SEQ ID NO: 7255 - RNA, 20 nt, Artificial Sequence
  TRAC targeting sequence
aaugucauugaaaggacacc

SEQ ID NO: 7256 - RNA, 20 nt, Artificial Sequence
  TRAC targeting sequence
accgugucuugcuaaaaaau

SEQ ID NO: 7257 - RNA, 20 nt, Artificial Sequence
  TRAC targeting sequence
aauucaaaugucauugaaag

SEQ ID NO: 7258 - RNA, 20 nt, Artificial Sequence
  TRAC targeting sequence
ugcuaaaaaauaaaauaaaa

SEQ ID NO: 7259 - RNA, 20 nt, Artificial Sequence
  TRAC targeting sequence
augcaaauaaaaagaacguc

SEQ ID NO: 7260 - RNA, 20 nt, Artificial Sequence
  TRAC targeting sequence
aucuuuuaauggcuaucaga

SEQ ID NO: 7261 - RNA, 20 nt, Artificial Sequence
  TRAC targeting sequence
uuuaauggcuaucagaauag

SEQ ID NO: 7262 - RNA, 20 nt, Artificial Sequence
  TRAC targeting sequence
gaauaguacaacuaggcuau

SEQ ID NO: 7263 - RNA, 20 nt, Artificial Sequence
  TRAC targeting sequence
gauagccauuaaaagauaga

SEQ ID NO: 7264 - RNA, 20 nt, Artificial Sequence
  TRAC targeting sequence
aacccaugugauuucaaguu

SEQ ID NO: 7265 - RNA, 20 nt, Artificial Sequence
  TRAC targeting sequence
cauggguuugauagccuagu

SEQ ID NO: 7266 - RNA, 20 nt, Artificial Sequence
  TRAC targeting sequence
aguuuccuuuuaauuauauu

SEQ ID NO: 7267 - RNA, 20 nt, Artificial Sequence
  TRAC targeting sequence
uuuuaauuauauuuuaaguu

SEQ ID NO: 7268 - RNA, 20 nt, Artificial Sequence
  TRAC targeting sequence
cuuuuuaacuuaaaauauaa

SEQ ID NO: 7269 - RNA, 20 nt, Artificial Sequence
  TRAC targeting sequence
uaauuugcuuaauaauuuaa

SEQ ID NO: 7270 - RNA, 20 nt, Artificial Sequence
  TRAC targeting sequence
gucauaauuugcuuaauaau

SEQ ID NO: 7271 - RNA, 20 nt, Artificial Sequence
  TRAC targeting sequence
ucugucauaauuugcuuaau

SEQ ID NO: 7272 - RNA, 20 nt, Artificial Sequence
  TRAC targeting sequence
uagucaucugucauaauuug

SEQ ID NO: 7273 - RNA, 20 nt, Artificial Sequence
  TRAC targeting sequence
cccgcuuuuuuggucauagu

SEQ ID NO: 7274 - RNA, 20 nt, Artificial Sequence
  TRAC targeting sequence
cccccgcuuuuuuggucaua

SEQ ID NO: 7275 - RNA, 20 nt, Artificial Sequence
  TRAC targeting sequence
auuaagcacaucucccccgc

SEQ ID NO: 7276 - RNA, 20 nt, Artificial Sequence
  TRAC targeting sequence
caaacuucaauuaagcacau

SEQ ID NO: 7277 - RNA, 20 nt, Artificial Sequence
  TRAC targeting sequence
gcacuucccaaacuucaauu

SEQ ID NO: 7278 - RNA, 20 nt, Artificial Sequence
  TRAC targeting sequence
uauuggugcauuucaucagc

SEQ ID NO: 7279 - RNA, 20 nt, Artificial Sequence
  TRAC targeting sequence
ucagccuuugaagugaaaaa

SEQ ID NO: 7280 - RNA, 20 nt, Artificial Sequence
  TRAC targeting sequence
gccuuugaagugaaaaagua

SEQ ID NO: 7281 - RNA, 20 nt, Artificial Sequence
  TRAC targeting sequence
aaggcugaugaaaugcacca

SEQ ID NO: 7282 - RNA, 20 nt, Artificial Sequence
  TRAC targeting sequence
cuucaaaggcugaugaaaug

SEQ ID NO: 7283 - RNA, 20 nt, Artificial Sequence
  TRAC targeting sequence
agagggggcacaaccuagaa

SEQ ID NO: 7284 - RNA, 20 nt, Artificial Sequence
  TRAC targeting sequence
ggauaccccuuacuuuuuca

SEQ ID NO: 7285 - RNA, 20 nt, Artificial Sequence
  TRAC targeting sequence
agguugugcccccucuggau

SEQ ID NO: 7286 - RNA, 20 nt, Artificial Sequence
  TRAC targeting sequence
uugaauggcagcuucuauuu

SEQ ID NO: 7287 - RNA, 20 nt, Artificial Sequence
  TRAC targeting sequence
aagauauucuagguugugcc

SEQ ID NO: 7288 - RNA, 20 nt, Artificial Sequence
  TRAC targeting sequence
auuuuuaagcuaccaacauu

SEQ ID NO: 7289 - RNA, 20 nt, Artificial Sequence
  TRAC targeting sequence
aauguugguagcuuaaaaau

SEQ ID NO: 7290 - RNA, 20 nt, Artificial Sequence
  TRAC targeting sequence
uuaauccaauguugguagcu

SEQ ID NO: 7291 - RNA, 20 nt, Artificial Sequence
  TRAC targeting sequence
cuuuaauccaauguugguag

SEQ ID NO: 7292 - RNA, 20 nt, Artificial Sequence
  TRAC targeting sequence
ucucagaagccuuuugaugc

SEQ ID NO: 7293 - RNA, 20 nt, Artificial Sequence
  TRAC targeting sequence
cagaagccuuuugaugcuuu

SEQ ID NO: 7294 - RNA, 20 nt, Artificial Sequence
  TRAC targeting sequence
gaagccuuuugaugcuuuuu

SEQ ID NO: 7295 - RNA, 20 nt, Artificial Sequence
  TRAC targeting sequence
gagaagauaaaggcccuggg

SEQ ID NO: 7296 - RNA, 20 nt, Artificial Sequence
  TRAC targeting sequence
aaaggcuucugagaagauaa

SEQ ID NO: 7297 - RNA, 20 nt, Artificial Sequence
  TRAC targeting sequence
uugggagcuucuuucaaguu

SEQ ID NO: 7298 - RNA, 20 nt, Artificial Sequence
  TRAC targeting sequence
caaggaaaaaaaaagcauca

SEQ ID NO: 7299 - RNA, 20 nt, Artificial Sequence
  TRAC targeting sequence
uucaaguucuuacuuacgga

SEQ ID NO: 7300 - RNA, 20 nt, Artificial Sequence
  TRAC targeting sequence
aguucuuacuuacggagcuc

SEQ ID NO: 7301 - RNA, 20 nt, Artificial Sequence
  TRAC targeting sequence
uacuuacggagcuccugggu

SEQ ID NO: 7302 - RNA, 20 nt, Artificial Sequence
  TRAC targeting sequence
guaaguaagaacuugaaaga

SEQ ID NO: 7303 - RNA, 20 nt, Artificial Sequence
  TRAC targeting sequence
uggguagcacaaaacuaaca

SEQ ID NO: 7304 - RNA, 20 nt, Artificial Sequence
  TRAC targeting sequence
ucuggauacaguaaaccugg

SEQ ID NO: 7305 - RNA, 20 nt, Artificial Sequence
  TRAC targeting sequence
ggauacaguaaaccuggaga

SEQ ID NO: 7306 - RNA, 20 nt, Artificial Sequence
  TRAC targeting sequence
agaggacuaaagugugggau

SEQ ID NO: 7307 - RNA, 20 nt, Artificial Sequence
  TRAC targeting sequence
agguuuacuguauccagagg

SEQ ID NO: 7308 - RNA, 20 nt, Artificial Sequence
  TRAC targeting sequence
ccagguuuacuguauccaga

SEQ ID NO: 7309 - RNA, 20 nt, Artificial Sequence
  TRAC targeting sequence
cuccagguuuacuguaucca

SEQ ID NO: 7310 - RNA, 20 nt, Artificial Sequence
  TRAC targeting sequence
uaaaacagaacagagaaaca

SEQ ID NO: 7311 - RNA, 20 nt, Artificial Sequence
  TRAC targeting sequence
guuuuacgaagcuaaguggu

SEQ ID NO: 7312 - RNA, 20 nt, Artificial Sequence
  TRAC targeting sequence
guucuguuuuacgaagcuaa

SEQ ID NO: 7313 - RNA, 20 nt, Artificial Sequence
  TRAC targeting sequence
cuguucuguuuuacgaagcu

SEQ ID NO: 7314 - RNA, 20 nt, Artificial Sequence
  TRAC targeting sequence
uguuucucuguucuguuuua

SEQ ID NO: 7315 - RNA, 20 nt, Artificial Sequence
  TRAC targeting sequence
augcuguuuuguccuguuuc

SEQ ID NO: 7316 - RNA, 20 nt, Artificial Sequence
  TRAC targeting sequence
auuccacaugaucguaguga

SEQ ID NO: 7317 - RNA, 20 nt, Artificial Sequence
  TRAC targeting sequence
ugguaccucaauuccacaug

SEQ ID NO: 7318 - RNA, 20 nt, Artificial Sequence
  TRAC targeting sequence
auaaaacgcaagucauggua

SEQ ID NO: 7319 - RNA, 20 nt, Artificial Sequence
  TRAC targeting sequence
ggaaacugaaucuuaaaggg

SEQ ID NO: 7320 - RNA, 20 nt, Artificial Sequence
  TRAC targeting sequence
ugauccauaaaacgcaaguc

SEQ ID NO: 7321 - RNA, 20 nt, Artificial Sequence
  TRAC targeting sequence
guuuccugauccauaaaacg

SEQ ID NO: 7322 - RNA, 20 nt, Artificial Sequence
  TRAC targeting sequence
uaaagggguuccucaagauc

SEQ ID NO: 7323 - RNA, 20 nt, Artificial Sequence
  TRAC targeting sequence
ucaagaucacacagcuuagu

SEQ ID NO: 7324 - RNA, 20 nt, Artificial Sequence
  TRAC targeting sequence
agaucacacagcuuaguaaa

SEQ ID NO: 7325 - RNA, 20 nt, Artificial Sequence
  TRAC targeting sequence
ugaggaaccccuuuaagauu

SEQ ID NO: 7326 - RNA, 20 nt, Artificial Sequence
  TRAC targeting sequence
cacagcuuaguaaagucauc

SEQ ID NO: 7327 - RNA, 20 nt, Artificial Sequence
  TRAC targeting sequence
agguggaaggacuugcaggu

SEQ ID NO: 7328 - RNA, 20 nt, Artificial Sequence
  TRAC targeting sequence
cccagggacucacacaguuu

SEQ ID NO: 7329 - RNA, 20 nt, Artificial Sequence
  TRAC targeting sequence
cagggacucacacaguuuuc

SEQ ID NO: 7330 - RNA, 20 nt, Artificial Sequence
  TRAC targeting sequence
cugggagaaaauggcuccag

SEQ ID NO: 7331 - RNA, 20 nt, Artificial Sequence
  TRAC targeting sequence
cacaguuuucucccuccccu

SEQ ID NO: 7332 - RNA, 20 nt, Artificial Sequence
  TRAC targeting sequence
cccuccccuccuccaggucu

SEQ ID NO: 7333 - RNA, 20 nt, Artificial Sequence
  TRAC targeting sequence
cuccccuccuccaggucucc

SEQ ID NO: 7334 - RNA, 20 nt, Artificial Sequence
  TRAC targeting sequence
ccuccuccaggucuccacuc

SEQ ID NO: 7335 - RNA, 20 nt, Artificial Sequence
  TRAC targeting sequence
uccaggucuccacucaaaug

SEQ ID NO: 7336 - RNA, 20 nt, Artificial Sequence
  TRAC targeting sequence
aggucuccacucaaauguca

SEQ ID NO: 7337 - RNA, 20 nt, Artificial Sequence
  TRAC targeting sequence
ccacucaaaugucauuucca

SEQ ID NO: 7338 - RNA, 20 nt, Artificial Sequence
  TRAC targeting sequence
acucaaaugucauuuccagu

SEQ ID NO: 7339 - RNA, 20 nt, Artificial Sequence
  TRAC targeting sequence
aaugucauuuccagugaauc

SEQ ID NO: 7340 - RNA, 20 nt, Artificial Sequence
  TRAC targeting sequence
uuuccagugaauccuuuccc

SEQ ID NO: 7341 - RNA, 20 nt, Artificial Sequence
  TRAC targeting sequence
agugaauccuuucccuacca

SEQ ID NO: 7342 - RNA, 20 nt, Artificial Sequence
  TRAC targeting sequence
cuggaaaugacauuugagug

SEQ ID NO: 7343 - RNA, 20 nt, Artificial Sequence
  TRAC targeting sequence
uuucccuaccaccucauguc

SEQ ID NO: 7344 - RNA, 20 nt, Artificial Sequence
  TRAC targeting sequence
cuaccaccucaugucacucu

SEQ ID NO: 7345 - RNA, 20 nt, Artificial Sequence
  TRAC targeting sequence
gagaaaaagucagcuauggu

SEQ ID NO: 7346 - RNA, 20 nt, Artificial Sequence
  TRAC targeting sequence
gauucauucauuccuuuauu

SEQ ID NO: 7347 - RNA, 20 nt, Artificial Sequence
  TRAC targeting sequence
cugauucauucauuccuuua

SEQ ID NO: 7348 - RNA, 20 nt, Artificial Sequence
  TRAC targeting sequence
gcuaugguauaaagcaaaag

SEQ ID NO: 7349 - RNA, 20 nt, Artificial Sequence
  TRAC targeting sequence
uuugcuuuauaccauagcug

SEQ ID NO: 7350 - RNA, 20 nt, Artificial Sequence
  TRAC targeting sequence
uuucuuuugcuuuauaccau

SEQ ID NO: 7351 - RNA, 20 nt, Artificial Sequence
  TRAC targeting sequence
uuuuucuuuucuuuugcuuu

SEQ ID NO: 7352 - RNA, 20 nt, Artificial Sequence
  TRAC targeting sequence
cuucauuuuucuuuucuuuu

SEQ ID NO: 7353 - RNA, 20 nt, Artificial Sequence
  TRAC targeting sequence
guagguuaccagcuucccuu

SEQ ID NO: 7354 - RNA, 20 nt, Artificial Sequence
  TRAC targeting sequence
gggugccagggaaucgacau

SEQ ID NO: 7355 - RNA, 20 nt, Artificial Sequence
  TRAC targeting sequence
cuggcacccagaacagugcc

SEQ ID NO: 7356 - RNA, 20 nt, Artificial Sequence
  TRAC targeting sequence
acaugaacaaagcaggcaug

SEQ ID NO: 7357 - RNA, 20 nt, Artificial Sequence
  TRAC targeting sequence
auucccuggcacccagaaca

SEQ ID NO: 7358 - RNA, 20 nt, Artificial Sequence
  TRAC targeting sequence
ugucgauucccuggcaccca

SEQ ID NO: 7359 - RNA, 20 nt, Artificial Sequence
  TRAC targeting sequence
ugccugcuuuguucaugucg

SEQ ID NO: 7360 - RNA, 20 nt, Artificial Sequence
  TRAC targeting sequence
gccauauuggagcuuauuuu

SEQ ID NO: 7361 - RNA, 20 nt, Artificial Sequence
  TRAC targeting sequence
aauauggcagaaguucaugc

SEQ ID NO: 7362 - RNA, 20 nt, Artificial Sequence
  TRAC targeting sequence
aauggcaaaagacagauggu

SEQ ID NO: 7363 - RNA, 20 nt, Artificial Sequence
  TRAC targeting sequence
uuugccauuagaaaauaagc

SEQ ID NO: 7364 - RNA, 20 nt, Artificial Sequence
  TRAC targeting sequence
gucuuuugccauuagaaaau

SEQ ID NO: 7365 - RNA, 20 nt, Artificial Sequence
  TRAC targeting sequence
uuauucuccuucccggcuuu

SEQ ID NO: 7366 - RNA, 20 nt, Artificial Sequence
  TRAC targeting sequence
ucuuuauucuccuucccggc

SEQ ID NO: 7367 - RNA, 20 nt, Artificial Sequence
  TRAC targeting sequence
cacuaguccucuuuauucuc

SEQ ID NO: 7368 - RNA, 20 nt, Artificial Sequence
  TRAC targeting sequence
cucccacuaguccucuuuau

SEQ ID NO: 7369 - RNA, 20 nt, Artificial Sequence
  TRAC targeting sequence
guuuaaaacugcaugcuggu

SEQ ID NO: 7370 - RNA, 20 nt, Artificial Sequence
  TRAC targeting sequence
ucuguuuaaaacugcaugcu

SEQ ID NO: 7371 - RNA, 20 nt, Artificial Sequence
  TRAC targeting sequence
cagaaggucucacuggaaag

SEQ ID NO: 7372 - RNA, 20 nt, Artificial Sequence
  TRAC targeting sequence
gugacucuucuguuuaaaac

SEQ ID NO: 7373 - RNA, 20 nt, Artificial Sequence
  TRAC targeting sequence
cacuggaaaggugacagugg

SEQ ID NO: 7374 - RNA, 20 nt, Artificial Sequence
  TRAC targeting sequence
cuggaaaggugacaguggag

SEQ ID NO: 7375 - RNA, 20 nt, Artificial Sequence
  TRAC targeting sequence
agugagaccuucugugacuc

SEQ ID NO: 7376 - RNA, 20 nt, Artificial Sequence
  TRAC targeting sequence
ccuuuccagugagaccuucu

SEQ ID NO: 7377 - RNA, 20 nt, Artificial Sequence
  TRAC targeting sequence
acugucaccuuuccagugag

SEQ ID NO: 7378 - RNA, 20 nt, Artificial Sequence
  TRAC targeting sequence
gcuccacugucaccuuucca

SEQ ID NO: 7379 - RNA, 20 nt, Artificial Sequence
  TRAC targeting sequence
cugcuccacugucaccuuuc

SEQ ID NO: 7380 - RNA, 20 nt, Artificial Sequence
  TRAC targeting sequence
ggucucugcuccacugucac

SEQ ID NO: 7381 - RNA, 20 nt, Artificial Sequence
  TRAC targeting sequence
ucgggucucugcuccacugu

SEQ ID NO: 7382 - RNA, 20 nt, Artificial Sequence
  TRAC targeting sequence
cuuuaccaccuccucggguc

SEQ ID NO: 7383 - RNA, 20 nt, Artificial Sequence
  TRAC targeting sequence
aauaauuacaucgagucucu

SEQ ID NO: 7384 - RNA, 20 nt, Artificial Sequence
  TRAC targeting sequence
agucucucuaguucacagau

SEQ ID NO: 7385 - RNA, 20 nt, Artificial Sequence
  TRAC targeting sequence
auguaauuauuagaauguuu

SEQ ID NO: 7386 - RNA, 20 nt, Artificial Sequence
  TRAC targeting sequence
cucuaguucacagaugcugu

SEQ ID NO: 7387 - RNA, 20 nt, Artificial Sequence
  TRAC targeting sequence
cuaguucacagaugcuguau

SEQ ID NO: 7388 - RNA, 20 nt, Artificial Sequence
  TRAC targeting sequence
aguucacagaugcuguaucu

SEQ ID NO: 7389 - RNA, 20 nt, Artificial Sequence
  TRAC targeting sequence
cagaugcuguaucuaaucuu

SEQ ID NO: 7390 - RNA, 20 nt, Artificial Sequence
  TRAC targeting sequence
gugaacuagagagacucgau

SEQ ID NO: 7391 - RNA, 20 nt, Artificial Sequence
  TRAC targeting sequence
aaucuuauaaccuauaauac

SEQ ID NO: 7392 - RNA, 20 nt, Artificial Sequence
  TRAC targeting sequence
uauaaccuauaauacggaag

SEQ ID NO: 7393 - RNA, 20 nt, Artificial Sequence
  TRAC targeting sequence
guauuauagguuauaagauu

SEQ ID NO: 7394 - RNA, 20 nt, Artificial Sequence
  TRAC targeting sequence
uccguauuauagguuauaag

SEQ ID NO: 7395 - RNA, 20 nt, Artificial Sequence
  TRAC targeting sequence
ucacuucguagagaaaccag

SEQ ID NO: 7396 - RNA, 20 nt, Artificial Sequence
  TRAC targeting sequence
cuucguagagaaaccagaua

SEQ ID NO: 7397 - RNA, 20 nt, Artificial Sequence
  TRAC targeting sequence
uagagaaaccagauaaagcu

SEQ ID NO: 7398 - RNA, 20 nt, Artificial Sequence
  TRAC targeting sequence
acgaagugaggauaacaucu

SEQ ID NO: 7399 - RNA, 20 nt, Artificial Sequence
  TRAC targeting sequence
cuacgaagugaggauaacau

SEQ ID NO: 7400 - RNA, 20 nt, Artificial Sequence
  TRAC targeting sequence
gguuucucuacgaagugagg

SEQ ID NO: 7401 - RNA, 20 nt, Artificial Sequence
  TRAC targeting sequence
gugaguuuaaggaacuuggc

SEQ ID NO: 7402 - RNA, 20 nt, Artificial Sequence
  TRAC targeting sequence
cugagcuuuaucugguuucu

SEQ ID NO: 7403 - RNA, 20 nt, Artificial Sequence
  TRAC targeting sequence
uuaaacucacugagcuuuau

SEQ ID NO: 7404 - RNA, 20 nt, Artificial Sequence
  TRAC targeting sequence
acuuuacaacgacuaggaac

SEQ ID NO: 7405 - RNA, 20 nt, Artificial Sequence
  TRAC targeting sequence
uuguaaaguagaaggauguc

SEQ ID NO: 7406 - RNA, 20 nt, Artificial Sequence
  TRAC targeting sequence
uagucguuguaaaguagaag

SEQ ID NO: 7407 - RNA, 20 nt, Artificial Sequence
  TRAC targeting sequence
uguuagugauucuccaacua

SEQ ID NO: 7408 - RNA, 20 nt, Artificial Sequence
  TRAC targeting sequence
cuaacaugaagggugguucc

SEQ ID NO: 7409 - RNA, 20 nt, Artificial Sequence
  TRAC targeting sequence
ccaacuaucaucuacagucu

SEQ ID NO: 7410 - RNA, 20 nt, Artificial Sequence
  TRAC targeting sequence
aacuaucaucuacagucuuu

SEQ ID NO: 7411 - RNA, 20 nt, Artificial Sequence
  TRAC targeting sequence
ucuacagucuuuuaaggauu

SEQ ID NO: 7412 - RNA, 20 nt, Artificial Sequence
  TRAC targeting sequence
acagucuuuuaaggauugua

SEQ ID NO: 7413 - RNA, 20 nt, Artificial Sequence
  TRAC targeting sequence
uuuaaggauuguaaacugau

SEQ ID NO: 7414 - RNA, 20 nt, Artificial Sequence
  TRAC targeting sequence
uuaaaagacuguagaugaua

SEQ ID NO: 7415 - RNA, 20 nt, Artificial Sequence
  TRAC targeting sequence
guuuacaauccuuaaaagac

SEQ ID NO: 7416 - RNA, 20 nt, Artificial Sequence
  TRAC targeting sequence
gaaaaauccauauucccucc

SEQ ID NO: 7417 - RNA, 20 nt, Artificial Sequence
  TRAC targeting sequence
gaucaguuuacaauccuuaa

SEQ ID NO: 7418 - RNA, 20 nt, Artificial Sequence
  TRAC targeting sequence
auauucccuccuugguuuuu

SEQ ID NO: 7419 - RNA, 20 nt, Artificial Sequence
  TRAC targeting sequence
cuccuugguuuuuaugagug

SEQ ID NO: 7420 - RNA, 20 nt, Artificial Sequence
  TRAC targeting sequence
uugguuuuuaugagugacau

SEQ ID NO: 7421 - RNA, 20 nt, Artificial Sequence
  TRAC targeting sequence
uaaaaaccaaggagggaaua

SEQ ID NO: 7422 - RNA, 20 nt, Artificial Sequence
  TRAC targeting sequence
cucauaaaaaccaaggaggg

SEQ ID NO: 7423 - RNA, 20 nt, Artificial Sequence
  TRAC targeting sequence
cauagauucugauguucacg

SEQ ID NO: 7424 - RNA, 20 nt, Artificial Sequence
  TRAC targeting sequence
uagauucugauguucacgua

SEQ ID NO: 7425 - RNA, 20 nt, Artificial Sequence
  TRAC targeting sequence
augagauugccuguauguca

SEQ ID NO: 7426 - RNA, 20 nt, Artificial Sequence
  TRAC targeting sequence
gauguucacguauaacagaa

SEQ ID NO: 7427 - RNA, 20 nt, Artificial Sequence
  TRAC targeting sequence
gaaucuaugagauugccugu

SEQ ID NO: 7428 - RNA, 20 nt, Artificial Sequence
  TRAC targeting sequence
cguauaacagaaauuaauuu

SEQ ID NO: 7429 - RNA, 20 nt, Artificial Sequence
  TRAC targeting sequence
guuauacgugaacaucagaa

SEQ ID NO: 7430 - RNA, 20 nt, Artificial Sequence
  TRAC targeting sequence
cuucuaagugugagaguguc

SEQ ID NO: 7431 - RNA, 20 nt, Artificial Sequence
  TRAC targeting sequence
aagugugagagugucauuga

SEQ ID NO: 7432 - RNA, 20 nt, Artificial Sequence
  TRAC targeting sequence
cacuuagaagugacaguuaa

SEQ ID NO: 7433 - RNA, 20 nt, Artificial Sequence
  TRAC targeting sequence
cacacuuagaagugacaguu

SEQ ID NO: 7434 - RNA, 20 nt, Artificial Sequence
  TRAC targeting sequence
uugaagcuugcuaaaauuug

SEQ ID NO: 7435 - RNA, 20 nt, Artificial Sequence
  TRAC targeting sequence
augacacucucacacuuaga

SEQ ID NO: 7436 - RNA, 20 nt, Artificial Sequence
  TRAC targeting sequence
aauuuuagcaagcuucaaug

SEQ ID NO: 7437 - RNA, 20 nt, Artificial Sequence
  TRAC targeting sequence
ugcauaucaaauuuuagcaa

SEQ ID NO: 7438 - RNA, 20 nt, Artificial Sequence
  TRAC targeting sequence
auuuuaauaacacauucaug

SEQ ID NO: 7439 - RNA, 20 nt, Artificial Sequence
  TRAC targeting sequence
auccauuuuaauaacacauu

SEQ ID NO: 7440 - RNA, 20 nt, Artificial Sequence
  TRAC targeting sequence
auuuuguacuaagcaguuug

SEQ ID NO: 7441 - RNA, 20 nt, Artificial Sequence
  TRAC targeting sequence
cugccucaccuaaguguagc

SEQ ID NO: 7442 - RNA, 20 nt, Artificial Sequence
  TRAC targeting sequence
ccuaaguguagcccgaaggu

SEQ ID NO: 7443 - RNA, 20 nt, Artificial Sequence
  TRAC targeting sequence
ggcuacacuuaggugaggca

SEQ ID NO: 7444 - RNA, 20 nt, Artificial Sequence
  TRAC targeting sequence
accuucgggcuacacuuagg

SEQ ID NO: 7445 - RNA, 20 nt, Artificial Sequence
  TRAC targeting sequence
ccaccuucgggcuacacuua

SEQ ID NO: 7446 - RNA, 20 nt, Artificial Sequence
  TRAC targeting sequence
augaccaacguuccacccuu

SEQ ID NO: 7447 - RNA, 20 nt, Artificial Sequence
  TRAC targeting sequence
uagagcagugguucuccacc

SEQ ID NO: 7448 - RNA, 20 nt, Artificial Sequence
  TRAC targeting sequence
acccuucuuuccucuugauc

SEQ ID NO: 7449 - RNA, 20 nt, Artificial Sequence
  TRAC targeting sequence
uuccucuugaucaaaccaaa

SEQ ID NO: 7450 - RNA, 20 nt, Artificial Sequence
  TRAC targeting sequence
gucagauuguaauaugggca

SEQ ID NO: 7451 - RNA, 20 nt, Artificial Sequence
  TRAC targeting sequence
gauuguaauaugggcaaaag

SEQ ID NO: 7452 - RNA, 20 nt, Artificial Sequence
  TRAC targeting sequence
gacagaauuugugcucaaau

SEQ ID NO: 7453 - RNA, 20 nt, Artificial Sequence
  TRAC targeting sequence
aagcuuuugcccauauuaca

SEQ ID NO: 7454 - RNA, 20 nt, Artificial Sequence
  TRAC targeting sequence
auuugaugcuagagucaccu

SEQ ID NO: 7455 - RNA, 20 nt, Artificial Sequence
  TRAC targeting sequence
aauagaaauccaagcuuuug

SEQ ID NO: 7456 - RNA, 20 nt, Artificial Sequence
  TRAC targeting sequence
agcaucaaauagaaauccaa

SEQ ID NO: 7457 - RNA, 20 nt, Artificial Sequence
  TRAC targeting sequence
ccucuuguuccauccugaag

SEQ ID NO: 7458 - RNA, 20 nt, Artificial Sequence
  TRAC targeting sequence
uguuccauccugaaggacaa

SEQ ID NO: 7459 - RNA, 20 nt, Artificial Sequence
  TRAC targeting sequence
auccugaaggacaaccucua

SEQ ID NO: 7460 - RNA, 20 nt, Artificial Sequence
  TRAC targeting sequence
ugaaggacaaccucuaagac

SEQ ID NO: 7461 - RNA, 20 nt, Artificial Sequence
  TRAC targeting sequence
cuuuacggcaacccuagccc

SEQ ID NO: 7462 - RNA, 20 nt, Artificial Sequence
  TRAC targeting sequence
aaaaacuaccuugcuuuucc

SEQ ID NO: 7463 - RNA, 20 nt, Artificial Sequence
  TRAC targeting sequence
gcugugccagaccccugauc

SEQ ID NO: 7464 - RNA, 20 nt, Artificial Sequence
  TRAC targeting sequence
ggcacagcugacauaccuaa

SEQ ID NO: 7465 - RNA, 20 nt, Artificial Sequence
  TRAC targeting sequence
ggggucuggcacagcugaca

SEQ ID NO: 7466 - RNA, 20 nt, Artificial Sequence
  TRAC targeting sequence
uuggcaaaggaaccuaucug

SEQ ID NO: 7467 - RNA, 20 nt, Artificial Sequence
  TRAC targeting sequence
uuugccaaagaucagggguc

SEQ ID NO: 7468 - RNA, 20 nt, Artificial Sequence
  TRAC targeting sequence
ggagguacaacaacguaagu

SEQ ID NO: 7469 - RNA, 20 nt, Artificial Sequence
  TRAC targeting sequence
agauagguuccuuugccaaa

SEQ ID NO: 7470 - RNA, 20 nt, Artificial Sequence
  TRAC targeting sequence
uucuuaugaccacuauguuu

SEQ ID NO: 7471 - RNA, 20 nt, Artificial Sequence
  TRAC targeting sequence
uaugaccacuauguuuggca

SEQ ID NO: 7472 - RNA, 20 nt, Artificial Sequence
  TRAC targeting sequence
uaagaaggaaaaguagguua

SEQ ID NO: 7473 - RNA, 20 nt, Artificial Sequence
  TRAC targeting sequence
aagucaccagguuaggaagc

SEQ ID NO: 7474 - RNA, 20 nt, Artificial Sequence
  TRAC targeting sequence
ccagguuaggaagcagugcu

SEQ ID NO: 7475 - RNA, 20 nt, Artificial Sequence
  TRAC targeting sequence
uaaccuggugacuuagaaaa

SEQ ID NO: 7476 - RNA, 20 nt, Artificial Sequence
  TRAC targeting sequence
gaggccaaguuccaaucugu

SEQ ID NO: 7477 - RNA, 20 nt, Artificial Sequence
  TRAC targeting sequence
gauuuacugguucagcgugc

SEQ ID NO: 7478 - RNA, 20 nt, Artificial Sequence
  TRAC targeting sequence
aaucuguccaaugcauuaac

SEQ ID NO: 7479 - RNA, 20 nt, Artificial Sequence
  TRAC targeting sequence
guccaaugcauuaacugaca

SEQ ID NO: 7480 - RNA, 20 nt, Artificial Sequence
  TRAC targeting sequence
aaugcauuaacugacaaugc

SEQ ID NO: 7481 - RNA, 20 nt, Artificial Sequence
  TRAC targeting sequence
guuaaugcauuggacagauu

SEQ ID NO: 7482 - RNA, 20 nt, Artificial Sequence
  TRAC targeting sequence
gcuaaugcauugucaguuaa

SEQ ID NO: 7483 - RNA, 20 nt, Artificial Sequence
  TRAC targeting sequence
gugacuuaacugcacugaac

SEQ ID NO: 7484 - RNA, 20 nt, Artificial Sequence
  TRAC targeting sequence
cagaguuugucagcuaaugc

SEQ ID NO: 7485 - RNA, 20 nt, Artificial Sequence
  TRAC targeting sequence
gugcaguuaagucacagagu

SEQ ID NO: 7486 - RNA, 20 nt, Artificial Sequence
  TRAC targeting sequence
ccagaccaauucuuaugaac

SEQ ID NO: 7487 - RNA, 20 nt, Artificial Sequence
  TRAC targeting sequence
ggggauaaucaggaucauag

SEQ ID NO: 7488 - RNA, 20 nt, Artificial Sequence
  TRAC targeting sequence
uaugaacaauugggaggaaa

SEQ ID NO: 7489 - RNA, 20 nt, Artificial Sequence
  TRAC targeting sequence
uaagaauuggucuggggaua

SEQ ID NO: 7490 - RNA, 20 nt, Artificial Sequence
  TRAC targeting sequence
caauuguucauaagaauugg

SEQ ID NO: 7491 - RNA, 20 nt, Artificial Sequence
  TRAC targeting sequence
ucccaauuguucauaagaau

SEQ ID NO: 7492 - RNA, 20 nt, Artificial Sequence
  TRAC targeting sequence
uugcuuuuccucccaauugu

SEQ ID NO: 7493 - RNA, 20 nt, Artificial Sequence
  TRAC targeting sequence
caccauugggcuuccuugcu

SEQ ID NO: 7494 - RNA, 20 nt, Artificial Sequence
  TRAC targeting sequence
uauuacccaguaggaauucu

SEQ ID NO: 7495 - RNA, 20 nt, Artificial Sequence
  TRAC targeting sequence
gugagauggaucuaaaaaua

SEQ ID NO: 7496 - RNA, 20 nt, Artificial Sequence
  TRAC targeting sequence
cagacaaaggcacuguaaag

SEQ ID NO: 7497 - RNA, 20 nt, Artificial Sequence
  TRAC targeting sequence
cacagacaaaggcacuguaa

SEQ ID NO: 7498 - RNA, 20 nt, Artificial Sequence
  TRAC targeting sequence
aucucacagacaaaggcacu

SEQ ID NO: 7499 - RNA, 20 nt, Artificial Sequence
  TRAC targeting sequence
aaaaauaucaccucauagag

SEQ ID NO: 7500 - RNA, 20 nt, Artificial Sequence
  TRAC targeting sequence
ccucauagaguuuauuucaa

SEQ ID NO: 7501 - RNA, 20 nt, Artificial Sequence
  TRAC targeting sequence
uagaguuuauuucaauaacu

SEQ ID NO: 7502 - RNA, 20 nt, Artificial Sequence
  TRAC targeting sequence
augaggugauauuuuuagau

SEQ ID NO: 7503 - RNA, 20 nt, Artificial Sequence
  TRAC targeting sequence
auaacuuuguugaaguagua

SEQ ID NO: 7504 - RNA, 20 nt, Artificial Sequence
  TRAC targeting sequence
acuaaaucaaucacaacagg

SEQ ID NO: 7505 - RNA, 20 nt, Artificial Sequence
  TRAC targeting sequence
gccuacaacggccauuuggc

SEQ ID NO: 7506 - RNA, 20 nt, Artificial Sequence
  TRAC targeting sequence
cagcaaaauaugugaaaaug

SEQ ID NO: 7507 - RNA, 20 nt, Artificial Sequence
  TRAC targeting sequence
gcaaaauaugugaaaauguu

SEQ ID NO: 7508 - RNA, 20 nt, Artificial Sequence
  TRAC targeting sequence
cauauuuugcugagaauugc

SEQ ID NO: 7509 - RNA, 20 nt, Artificial Sequence
  TRAC targeting sequence
ugaagcaagaucugggagua

SEQ ID NO: 7510 - RNA, 20 nt, Artificial Sequence
  TRAC targeting sequence
ggauaacauuuucacauauu

SEQ ID NO: 7511 - RNA, 20 nt, Artificial Sequence
  TRAC targeting sequence
ugcuucaggauaacauuuuc

SEQ ID NO: 7512 - RNA, 20 nt, Artificial Sequence
  TRAC targeting sequence
gggaguaagagauggcaggu

SEQ ID NO: 7513 - RNA, 20 nt, Artificial Sequence
  TRAC targeting sequence
cagaucuugcuucaggauaa

SEQ ID NO: 7514 - RNA, 20 nt, Artificial Sequence
  TRAC targeting sequence
uacucccagaucuugcuuca

SEQ ID NO: 7515 - RNA, 20 nt, Artificial Sequence
  TRAC targeting sequence
cuuacucccagaucuugcuu

SEQ ID NO: 7516 - RNA, 20 nt, Artificial Sequence
  TRAC targeting sequence
accugccaucucuuacuccc

SEQ ID NO: 7517 - RNA, 20 nt, Artificial Sequence
  TRAC targeting sequence
ucaaccugccaucucuuacu

SEQ ID NO: 7518 - RNA, 20 nt, Artificial Sequence
  TRAC targeting sequence
ccucaaccugccaucucuua

SEQ ID NO: 7519 - RNA, 20 nt, Artificial Sequence
  TRAC targeting sequence
gcuauuaucuccucaaccug

SEQ ID NO: 7520 - RNA, 20 nt, Artificial Sequence
  TRAC targeting sequence
aaggacuugccuaaguguca

SEQ ID NO: 7521 - RNA, 20 nt, Artificial Sequence
  TRAC targeting sequence
uuagauuuucugcuauuauc

SEQ ID NO: 7522 - RNA, 20 nt, Artificial Sequence
  TRAC targeting sequence
aaacucagaagauagcagac

SEQ ID NO: 7523 - RNA, 20 nt, Artificial Sequence
  TRAC targeting sequence
gaagauagcagacaucaaaa

SEQ ID NO: 7524 - RNA, 20 nt, Artificial Sequence
  TRAC targeting sequence
gaguuuugacacuuaggcaa

SEQ ID NO: 7525 - RNA, 20 nt, Artificial Sequence
  TRAC targeting sequence
ucugaguuuugacacuuagg

SEQ ID NO: 7526 - RNA, 20 nt, Artificial Sequence
  TRAC targeting sequence
gcuaucuucugaguuuugac

SEQ ID NO: 7527 - RNA, 20 nt, Artificial Sequence
  TRAC targeting sequence
aaaaagcugccaaaauauaa

SEQ ID NO: 7528 - RNA, 20 nt, Artificial Sequence
  TRAC targeting sequence
gaucucagaaacccuugcaa

SEQ ID NO: 7529 - RNA, 20 nt, Artificial Sequence
  TRAC targeting sequence
gagcauuauauuuuggcagc

SEQ ID NO: 7530 - RNA, 20 nt, Artificial Sequence
  TRAC targeting sequence
cagaaacccuugcaaagcuc

SEQ ID NO: 7531 - RNA, 20 nt, Artificial Sequence
  TRAC targeting sequence
gaaacccuugcaaagcucug

SEQ ID NO: 7532 - RNA, 20 nt, Artificial Sequence
  TRAC targeting sequence
gagaucugagcauuauauuu

SEQ ID NO: 7533 - RNA, 20 nt, Artificial Sequence
  TRAC targeting sequence
gucuccagcuacacccauuc

SEQ ID NO: 7534 - RNA, 20 nt, Artificial Sequence
  TRAC targeting sequence
ccagcuacacccauucugcu

SEQ ID NO: 7535 - RNA, 20 nt, Artificial Sequence
  TRAC targeting sequence
agcuacacccauucugcucc

SEQ ID NO: 7536 - RNA, 20 nt, Artificial Sequence
  TRAC targeting sequence
gcuccacccacccacuucca

SEQ ID NO: 7537 - RNA, 20 nt, Artificial Sequence
  TRAC targeting sequence
acccacccacuuccaaacag

SEQ ID NO: 7538 - RNA, 20 nt, Artificial Sequence
  TRAC targeting sequence
aaacagaugaauuagacuga

SEQ ID NO: 7539 - RNA, 20 nt, Artificial Sequence
  TRAC targeting sequence
guuuggaagugggugggugg

SEQ ID NO: 7540 - RNA, 20 nt, Artificial Sequence
  TRAC targeting sequence
ucuguuuggaaguggguggg

SEQ ID NO: 7541 - RNA, 20 nt, Artificial Sequence
  TRAC targeting sequence
aauucaucuguuuggaagug

SEQ ID NO: 7542 - RNA, 20 nt, Artificial Sequence
  TRAC targeting sequence
gucuaauucaucuguuugga

SEQ ID NO: 7543 - RNA, 20 nt, Artificial Sequence
  TRAC targeting sequence
cugucagucuaauucaucug

SEQ ID NO: 7544 - RNA, 20 nt, Artificial Sequence
  TRAC targeting sequence
uaaugaugccugugguagug

SEQ ID NO: 7545 - RNA, 20 nt, Artificial Sequence
  TRAC targeting sequence
uuacgaaaaaccuugcuacc

SEQ ID NO: 7546 - RNA, 20 nt, Artificial Sequence
  TRAC targeting sequence
aagcacuaccacaggcauca

SEQ ID NO: 7547 - RNA, 20 nt, Artificial Sequence
  TRAC targeting sequence
ucuuuggaaagggaacacaa

SEQ ID NO: 7548 - RNA, 20 nt, Artificial Sequence
  TRAC targeting sequence
uuggaaagggaacacaacuc

SEQ ID NO: 7549 - RNA, 20 nt, Artificial Sequence
  TRAC targeting sequence
aaagaagaguugugcuguca

SEQ ID NO: 7550 - RNA, 20 nt, Artificial Sequence
  TRAC targeting sequence
cuuuccaaagaagaguugug

SEQ ID NO: 7551 - RNA, 20 nt, Artificial Sequence
  TRAC targeting sequence
ucguggaaccagguaaguua

SEQ ID NO: 7552 - RNA, 20 nt, Artificial Sequence
  TRAC targeting sequence
uggaaccagguaaguuaugc

SEQ ID NO: 7553 - RNA, 20 nt, Artificial Sequence
  TRAC targeting sequence
acgaugaguuguguucccuu

SEQ ID NO: 7554 - RNA, 20 nt, Artificial Sequence
  TRAC targeting sequence
guguguauauuucuuuaggg

SEQ ID NO: 7555 - RNA, 20 nt, Artificial Sequence
  TRAC targeting sequence
uuaggguuguuguagcguag

SEQ ID NO: 7556 - RNA, 20 nt, Artificial Sequence
  TRAC targeting sequence
caaauuuuaccccuacuguu

SEQ ID NO: 7557 - RNA, 20 nt, Artificial Sequence
  TRAC targeting sequence
aaugcauuugcucccaaauu

SEQ ID NO: 7558 - RNA, 20 nt, Artificial Sequence
  TRAC targeting sequence
cuuaagaaaauauucuguau

SEQ ID NO: 7559 - RNA, 20 nt, Artificial Sequence
  TRAC targeting sequence
uaagaaaauauucuguauau

SEQ ID NO: 7560 - RNA, 20 nt, Artificial Sequence
  TRAC targeting sequence
uaagagaaaucuaaugcauu

SEQ ID NO: 7561 - RNA, 20 nt, Artificial Sequence
  TRAC targeting sequence
guauaugcuuggaaacucca

SEQ ID NO: 7562 - RNA, 20 nt, Artificial Sequence
  TRAC targeting sequence
aagcauauacagaauauuuu

SEQ ID NO: 7563 - RNA, 20 nt, Artificial Sequence
  TRAC targeting sequence
auucugaggcuugguauuca

SEQ ID NO: 7564 - RNA, 20 nt, Artificial Sequence
  TRAC targeting sequence
gaggcuugguauucauaagu

SEQ ID NO: 7565 - RNA, 20 nt, Artificial Sequence
  TRAC targeting sequence
gaauggaguuuccaagcaua

SEQ ID NO: 7566 - RNA, 20 nt, Artificial Sequence
  TRAC targeting sequence
guaguuguaaaaaacuuaug

SEQ ID NO: 7567 - RNA, 20 nt, Artificial Sequence
  TRAC targeting sequence
ggcuuuuaguuuugggcucc

SEQ ID NO: 7568 - RNA, 20 nt, Artificial Sequence
  TRAC targeting sequence
cuagaaccaggaaaaaggca

SEQ ID NO: 7569 - RNA, 20 nt, Artificial Sequence
  TRAC targeting sequence
agggagcccaaaacuaaaag

SEQ ID NO: 7570 - RNA, 20 nt, Artificial Sequence
  TRAC targeting sequence
ugguucuagggagcccaaaa

SEQ ID NO: 7571 - RNA, 20 nt, Artificial Sequence
  TRAC targeting sequence
ccaguaggggaccacgacuu

SEQ ID NO: 7572 - RNA, 20 nt, Artificial Sequence
  TRAC targeting sequence
acugguagccuacuccaaug

SEQ ID NO: 7573 - RNA, 20 nt, Artificial Sequence
  TRAC targeting sequence
aauguuuggaaauccagggg

SEQ ID NO: 7574 - RNA, 20 nt, Artificial Sequence
  TRAC targeting sequence
aaacauuggaguaggcuacc

SEQ ID NO: 7575 - RNA, 20 nt, Artificial Sequence
  TRAC targeting sequence
aggggcuauauucugguagu

SEQ ID NO: 7576 - RNA, 20 nt, Artificial Sequence
  TRAC targeting sequence
gguaguuuggguagcugcca

SEQ ID NO: 7577 - RNA, 20 nt, Artificial Sequence
  TRAC targeting sequence
uagugauugacuguuggcag

SEQ ID NO: 7578 - RNA, 20 nt, Artificial Sequence
  TRAC targeting sequence
agagaauagccuucagacac

SEQ ID NO: 7579 - RNA, 20 nt, Artificial Sequence
  TRAC targeting sequence
ggacuggucuuagugauuga

SEQ ID NO: 7580 - RNA, 20 nt, Artificial Sequence
  TRAC targeting sequence
cuggacuggucuuagugauu

SEQ ID NO: 7581 - RNA, 20 nt, Artificial Sequence
  TRAC targeting sequence
gacaccuuccaaaaugccaa

SEQ ID NO: 7582 - RNA, 20 nt, Artificial Sequence
  TRAC targeting sequence
gaaggcuauucucuggacug

SEQ ID NO: 7583 - RNA, 20 nt, Artificial Sequence
  TRAC targeting sequence
aaaaugccaaguccauuggg

SEQ ID NO: 7584 - RNA, 20 nt, Artificial Sequence
  TRAC targeting sequence
auugggagagccauuaccuc

SEQ ID NO: 7585 - RNA, 20 nt, Artificial Sequence
  TRAC targeting sequence
caauggacuuggcauuuugg

SEQ ID NO: 7586 - RNA, 20 nt, Artificial Sequence
  TRAC targeting sequence
cccaauggacuuggcauuuu

SEQ ID NO: 7587 - RNA, 20 nt, Artificial Sequence
  TRAC targeting sequence
uacaugauuagguauugauu

SEQ ID NO: 7588 - RNA, 20 nt, Artificial Sequence
  TRAC targeting sequence
uguaagagguaauggcucuc

SEQ ID NO: 7589 - RNA, 20 nt, Artificial Sequence
  TRAC targeting sequence
auaccuaaucauguaagagg

SEQ ID NO: 7590 - RNA, 20 nt, Artificial Sequence
  TRAC targeting sequence
gaggaaauaaauaaguaggg

SEQ ID NO: 7591 - RNA, 20 nt, Artificial Sequence
  TRAC targeting sequence
gaauaaacaaaaucaauacc

SEQ ID NO: 7592 - RNA, 20 nt, Artificial Sequence
  TRAC targeting sequence
ucugaauaaacaaaaucaau

SEQ ID NO: 7593 - RNA, 20 nt, Artificial Sequence
  TRAC targeting sequence
cuacuuauuuauuuccucug

SEQ ID NO: 7594 - RNA, 20 nt, Artificial Sequence
  TRAC targeting sequence
acugccuguugccuccaggg

SEQ ID NO: 7595 - RNA, 20 nt, Artificial Sequence
  TRAC targeting sequence
agggaaaugguagaauuugg

SEQ ID NO: 7596 - RNA, 20 nt, Artificial Sequence
  TRAC targeting sequence
cuggaggcaacaggcagugg

SEQ ID NO: 7597 - RNA, 20 nt, Artificial Sequence
  TRAC targeting sequence
accauuucccuggaggcaac

SEQ ID NO: 7598 - RNA, 20 nt, Artificial Sequence
  TRAC targeting sequence
ccaaauucuaccauuucccu

SEQ ID NO: 7599 - RNA, 20 nt, Artificial Sequence
  TRAC targeting sequence
uaucuuugaggggagagaga

SEQ ID NO: 7600 - RNA, 20 nt, Artificial Sequence
  TRAC targeting sequence
uugaggggagagagacuaga

SEQ ID NO: 7601 - RNA, 20 nt, Artificial Sequence
  TRAC targeting sequence
aagauaagaaaacucaccaa

SEQ ID NO: 7602 - RNA, 20 nt, Artificial Sequence
  TRAC targeting sequence
ccucaaagauaagaaaacuc

SEQ ID NO: 7603 - RNA, 20 nt, Artificial Sequence
  TRAC targeting sequence
ccccucaaagauaagaaaac

SEQ ID NO: 7604 - RNA, 20 nt, Artificial Sequence
  TRAC targeting sequence
cuccccucaaagauaagaaa

SEQ ID NO: 7605 - RNA, 20 nt, Artificial Sequence
  TRAC targeting sequence
cucuccccucaaagauaaga

SEQ ID NO: 7606 - RNA, 20 nt, Artificial Sequence
  TRAC targeting sequence
agucucucuccccucaaaga

SEQ ID NO: 7607 - RNA, 20 nt, Artificial Sequence
  TRAC targeting sequence
gugcucuagucucucucccc

SEQ ID NO: 7608 - RNA, 20 nt, Artificial Sequence
  TRAC targeting sequence
uuuucagugcucuagucucu

SEQ ID NO: 7609 - RNA, 20 nt, Artificial Sequence
  TRAC targeting sequence
cuccuuuucagugcucuagu

SEQ ID NO: 7610 - RNA, 20 nt, Artificial Sequence
  TRAC targeting sequence
guuucccuccuuuucagugc

SEQ ID NO: 7611 - RNA, 20 nt, Artificial Sequence
  TRAC targeting sequence
ugucguagcugauuguaguc

SEQ ID NO: 7612 - RNA, 20 nt, Artificial Sequence
  TRAC targeting sequence
uagcugauuguagucugauu

SEQ ID NO: 7613 - RNA, 20 nt, Artificial Sequence
  TRAC targeting sequence
gcuacgacaugauucuguuu

SEQ ID NO: 7614 - RNA, 20 nt, Artificial Sequence
  TRAC targeting sequence
gauugauguuuagcaaauug

SEQ ID NO: 7615 - RNA, 20 nt, Artificial Sequence
  TRAC targeting sequence
gacuacaaucagcuacgaca

SEQ ID NO: 7616 - RNA, 20 nt, Artificial Sequence
  TRAC targeting sequence
aucagacuacaaucagcuac

SEQ ID NO: 7617 - RNA, 20 nt, Artificial Sequence
  TRAC targeting sequence
gagcaaaaacuacuguguuu

SEQ ID NO: 7618 - RNA, 20 nt, Artificial Sequence
  TRAC targeting sequence
gaugcaauuugcuaaacauc

SEQ ID NO: 7619 - RNA, 20 nt, Artificial Sequence
  TRAC targeting sequence
uuuuccccuaaaaucauuuc

SEQ ID NO: 7620 - RNA, 20 nt, Artificial Sequence
  TRAC targeting sequence
ccuaaaaucauuuccacuug

SEQ ID NO: 7621 - RNA, 20 nt, Artificial Sequence
  TRAC targeting sequence
uuuccacuugaaauuuggaa

SEQ ID NO: 7622 - RNA, 20 nt, Artificial Sequence
  TRAC targeting sequence
acuugaaauuuggaauuauc

SEQ ID NO: 7623 - RNA, 20 nt, Artificial Sequence
  TRAC targeting sequence
aguggaaaugauuuuagggg

SEQ ID NO: 7624 - RNA, 20 nt, Artificial Sequence
  TRAC targeting sequence
aaauuucaaguggaaaugau

SEQ ID NO: 7625 - RNA, 20 nt, Artificial Sequence
  TRAC targeting sequence
gcaguguuagaaucaaaucu

SEQ ID NO: 7626 - RNA, 20 nt, Artificial Sequence
  TRAC targeting sequence
aacacugcagauaauuccaa

SEQ ID NO: 7627 - RNA, 20 nt, Artificial Sequence
  TRAC targeting sequence
aaucuuugaggcugugccuu

SEQ ID NO: 7628 - RNA, 20 nt, Artificial Sequence
  TRAC targeting sequence
uugaggcugugccuuuggga

SEQ ID NO: 7629 - RNA, 20 nt, Artificial Sequence
  TRAC targeting sequence
aagauuugauucuaacacug

SEQ ID NO: 7630 - RNA, 20 nt, Artificial Sequence
  TRAC targeting sequence
caaaggcacagccucaaaga

SEQ ID NO: 7631 - RNA, 20 nt, Artificial Sequence
  TRAC targeting sequence
uagggaagaaggaaauugau

SEQ ID NO: 7632 - RNA, 20 nt, Artificial Sequence
  TRAC targeting sequence
cuaagacucccaaaggcaca

SEQ ID NO: 7633 - RNA, 20 nt, Artificial Sequence
  TRAC targeting sequence
ucccuaagacucccaaaggc

SEQ ID NO: 7634 - RNA, 20 nt, Artificial Sequence
  TRAC targeting sequence
uucuucccuaagacucccaa

SEQ ID NO: 7635 - RNA, 20 nt, Artificial Sequence
  TRAC targeting sequence
auuuccuucuucccuaagac

SEQ ID NO: 7636 - RNA, 20 nt, Artificial Sequence
  TRAC targeting sequence
ucaauuuccuucuucccuaa

SEQ ID NO: 7637 - RNA, 20 nt, Artificial Sequence
  TRAC targeting sequence
guuucaucaauuuccuucuu

SEQ ID NO: 7638 - RNA, 20 nt, Artificial Sequence
  TRAC targeting sequence
gccaggaugcugaccaugcu

SEQ ID NO: 7639 - RNA, 20 nt, Artificial Sequence
  TRAC targeting sequence
uggcagaggggcuaagcauc

SEQ ID NO: 7640 - RNA, 20 nt, Artificial Sequence
  TRAC targeting sequence
gcauccuggcagaggggcua

SEQ ID NO: 7641 - RNA, 20 nt, Artificial Sequence
  TRAC targeting sequence
ccgaugacacuccauucgcu

SEQ ID NO: 7642 - RNA, 20 nt, Artificial Sequence
  TRAC targeting sequence
gggagcauggucagcauccu

SEQ ID NO: 7643 - RNA, 20 nt, Artificial Sequence
  TRAC targeting sequence
ucggggagcauggucagcau

SEQ ID NO: 7644 - RNA, 20 nt, Artificial Sequence
  TRAC targeting sequence
auucgcuucucugguuuucu

SEQ ID NO: 7645 - RNA, 20 nt, Artificial Sequence
  TRAC targeting sequence
cuucucugguuuucuucucc

SEQ ID NO: 7646 - RNA, 20 nt, Artificial Sequence
  TRAC targeting sequence
cugguuuucuucuccugcag

SEQ ID NO: 7647 - RNA, 20 nt, Artificial Sequence
  TRAC targeting sequence
gguuuucuucuccugcagug

SEQ ID NO: 7648 - RNA, 20 nt, Artificial Sequence
  TRAC targeting sequence
ucuccugcaguggugaaaug

SEQ ID NO: 7649 - RNA, 20 nt, Artificial Sequence
  TRAC targeting sequence
ccugcaguggugaaauguaa

SEQ ID NO: 7650 - RNA, 20 nt, Artificial Sequence
  TRAC targeting sequence
ugcaguggugaaauguaaua

SEQ ID NO: 7651 - RNA, 20 nt, Artificial Sequence
  TRAC targeting sequence
ccacugcaggagaagaaaac

SEQ ID NO: 7652 - RNA, 20 nt, Artificial Sequence
  TRAC targeting sequence
uauuacauuucaccacugca

SEQ ID NO: 7653 - RNA, 20 nt, Artificial Sequence
  TRAC targeting sequence
ucauauuacauuucaccacu

SEQ ID NO: 7654 - RNA, 20 nt, Artificial Sequence
  TRAC targeting sequence
caucaucauauuacauuuca

SEQ ID NO: 7655 - RNA, 20 nt, Artificial Sequence
  TRAC targeting sequence
gguaggggaugugaaaauuu

SEQ ID NO: 7656 - RNA, 20 nt, Artificial Sequence
  TRAC targeting sequence
ccuaccugagcuucacauca

SEQ ID NO: 7657 - RNA, 20 nt, Artificial Sequence
  TRAC targeting sequence
cauccccuaccugagcuuca

SEQ ID NO: 7658 - RNA, 20 nt, Artificial Sequence
  TRAC targeting sequence
aaucaaaccccaaguccuua

SEQ ID NO: 7659 - RNA, 20 nt, Artificial Sequence
  TRAC targeting sequence
aaccccaaguccuuaaagcu

SEQ ID NO: 7660 - RNA, 20 nt, Artificial Sequence
  TRAC targeting sequence
uuaaagcuuugacagugaau

SEQ ID NO: 7661 - RNA, 20 nt, Artificial Sequence
  TRAC targeting sequence
aagcuuuaaggacuuggggu

SEQ ID NO: 7662 - RNA, 20 nt, Artificial Sequence
  TRAC targeting sequence
cugucaaagcuuuaaggacu

SEQ ID NO: 7663 - RNA, 20 nt, Artificial Sequence
  TRAC targeting sequence
uucucuuuugccuggcucua

SEQ ID NO: 7664 - RNA, 20 nt, Artificial Sequence
  TRAC targeting sequence
cuuuugccuggcucuagccc

SEQ ID NO: 7665 - RNA, 20 nt, Artificial Sequence
  TRAC targeting sequence
uuugccuggcucuagcccaa

SEQ ID NO: 7666 - RNA, 20 nt, Artificial Sequence
  TRAC targeting sequence
agcccaacgaucuugauuuu

SEQ ID NO: 7667 - RNA, 20 nt, Artificial Sequence
  TRAC targeting sequence
uugggcuagagccaggcaaa

SEQ ID NO: 7668 - RNA, 20 nt, Artificial Sequence
  TRAC targeting sequence
ugauuuuuggugaugaggca

SEQ ID NO: 7669 - RNA, 20 nt, Artificial Sequence
  TRAC targeting sequence
agaucguugggcuagagcca

SEQ ID NO: 7670 - RNA, 20 nt, Artificial Sequence
  TRAC targeting sequence
ccaaaaaucaagaucguugg

SEQ ID NO: 7671 - RNA, 20 nt, Artificial Sequence
  TRAC targeting sequence
ucaccaaaaaucaagaucgu

SEQ ID NO: 7672 - RNA, 20 nt, Artificial Sequence
  TRAC targeting sequence
gccucaucaccaaaaaucaa

SEQ ID NO: 7673 - RNA, 20 nt, Artificial Sequence
  TRAC targeting sequence
cauggucuuuauguuacauu

SEQ ID NO: 7674 - RNA, 20 nt, Artificial Sequence
  TRAC targeting sequence
uuauguuacauugcacauga

SEQ ID NO: 7675 - RNA, 20 nt, Artificial Sequence
  TRAC targeting sequence
ugugcaauguaacauaaaga

SEQ ID NO: 7676 - RNA, 20 nt, Artificial Sequence
  TRAC targeting sequence
ucaugugcaauguaacauaa

SEQ ID NO: 7677 - RNA, 20 nt, Artificial Sequence
  TRAC targeting sequence
ugaaacuuauaucuggaucc

SEQ ID NO: 7678 - RNA, 20 nt, Artificial Sequence
  TRAC targeting sequence
ggaguauauagucaucaugu

SEQ ID NO: 7679 - RNA, 20 nt, Artificial Sequence
  TRAC targeting sequence
ggauccagagucaggagaaa

SEQ ID NO: 7680 - RNA, 20 nt, Artificial Sequence
  TRAC targeting sequence
agauauaaguuucaggagua

SEQ ID NO: 7681 - RNA, 20 nt, Artificial Sequence
  TRAC targeting sequence
agagucaggagaaauuauaa

SEQ ID NO: 7682 - RNA, 20 nt, Artificial Sequence
  TRAC targeting sequence
ggauccagauauaaguuuca

SEQ ID NO: 7683 - RNA, 20 nt, Artificial Sequence
  TRAC targeting sequence
ggagaaauuauaaaacaaaa

SEQ ID NO: 7684 - RNA, 20 nt, Artificial Sequence
  TRAC targeting sequence
ugacucuggauccagauaua

SEQ ID NO: 7685 - RNA, 20 nt, Artificial Sequence
  TRAC targeting sequence
ccugacucuggauccagaua

SEQ ID NO: 7686 - RNA, 20 nt, Artificial Sequence
  TRAC targeting sequence
cugaccuguguccaugacac

SEQ ID NO: 7687 - RNA, 20 nt, Artificial Sequence
  TRAC targeting sequence
gaccuguguccaugacacac

SEQ ID NO: 7688 - RNA, 20 nt, Artificial Sequence
  TRAC targeting sequence
gagaagccagugcuugcuuu

SEQ ID NO: 7689 - RNA, 20 nt, Artificial Sequence
  TRAC targeting sequence
cugagcagugaccaauuucu

SEQ ID NO: 7690 - RNA, 20 nt, Artificial Sequence
  TRAC targeting sequence
gggagcccacuggugcugug

SEQ ID NO: 7691 - RNA, 20 nt, Artificial Sequence
  TRAC targeting sequence
cugcucagggagcccacugg

SEQ ID NO: 7692 - RNA, 20 nt, Artificial Sequence
  TRAC targeting sequence
uguucaacccucagguccuu

SEQ ID NO: 7693 - RNA, 20 nt, Artificial Sequence
  TRAC targeting sequence
acccucagguccuuagaaag

SEQ ID NO: 7694 - RNA, 20 nt, Artificial Sequence
  TRAC targeting sequence
gguccuuagaaagccuuucg

SEQ ID NO: 7695 - RNA, 20 nt, Artificial Sequence
  TRAC targeting sequence
uuagaaagccuuucgccaag

SEQ ID NO: 7696 - RNA, 20 nt, Artificial Sequence
  TRAC targeting sequence
aaggaccugaggguugaaca

SEQ ID NO: 7697 - RNA, 20 nt, Artificial Sequence
  TRAC targeting sequence
ccaagcucagggaauuagaa

SEQ ID NO: 7698 - RNA, 20 nt, Artificial Sequence
  TRAC targeting sequence
gggaauuagaaagcagguuc

SEQ ID NO: 7699 - RNA, 20 nt, Artificial Sequence
  TRAC targeting sequence
cugagcuuggcgaaaggcuu

SEQ ID NO: 7700 - RNA, 20 nt, Artificial Sequence
  TRAC targeting sequence
aauucccugagcuuggcgaa

SEQ ID NO: 7701 - RNA, 20 nt, Artificial Sequence
  TRAC targeting sequence
uuauuauugugagacucagu

SEQ ID NO: 7702 - RNA, 20 nt, Artificial Sequence
  TRAC targeting sequence
caauaauaacgaaccugcuu

SEQ ID NO: 7703 - RNA, 20 nt, Artificial Sequence
  TRAC targeting sequence
cacaauaauaacgaaccugc

SEQ ID NO: 7704 - RNA, 20 nt, Artificial Sequence
  TRAC targeting sequence
gucugagugaugggggaaau

SEQ ID NO: 7705 - RNA, 20 nt, Artificial Sequence
  TRAC targeting sequence
gagugaugggggaaauuagg

SEQ ID NO: 7706 - RNA, 20 nt, Artificial Sequence
  TRAC targeting sequence
gacugagucucacaauaaua

SEQ ID NO: 7707 - RNA, 20 nt, Artificial Sequence
  TRAC targeting sequence
cucagacugagucucacaau

SEQ ID NO: 7708 - RNA, 20 nt, Artificial Sequence
  TRAC targeting sequence
cccaucacucagacugaguc

SEQ ID NO: 7709 - RNA, 20 nt, Artificial Sequence
  TRAC targeting sequence
aaucaaaauucuguacuugu

SEQ ID NO: 7710 - RNA, 20 nt, Artificial Sequence
  TRAC targeting sequence
aaauucuguacuugugaccc

SEQ ID NO: 7711 - RNA, 20 nt, Artificial Sequence
  TRAC targeting sequence
guacuugugacccaagagaa

SEQ ID NO: 7712 - RNA, 20 nt, Artificial Sequence
  TRAC targeting sequence
caaguacagaauuuugauua

SEQ ID NO: 7713 - RNA, 20 nt, Artificial Sequence
  TRAC targeting sequence
ugggucacaaguacagaauu

SEQ ID NO: 7714 - RNA, 20 nt, Artificial Sequence
  TRAC targeting sequence
cuugggucacaaguacagaa

SEQ ID NO: 7715 - RNA, 20 nt, Artificial Sequence
  TRAC targeting sequence
auucucuugggucacaagua

SEQ ID NO: 7716 - RNA, 20 nt, Artificial Sequence
  TRAC targeting sequence
gguuccauucucuuggguca

SEQ ID NO: 7717 - RNA, 20 nt, Artificial Sequence
  TRAC targeting sequence
uauuauacucugguuccauu

SEQ ID NO: 7718 - RNA, 20 nt, Artificial Sequence
  TRAC targeting sequence
auucuuauuauacucugguu

SEQ ID NO: 7719 - RNA, 20 nt, Artificial Sequence
  TRAC targeting sequence
uucuauaacccuccucuccu

SEQ ID NO: 7720 - RNA, 20 nt, Artificial Sequence
  TRAC targeting sequence
auaacccuccucuccucaac

SEQ ID NO: 7721 - RNA, 20 nt, Artificial Sequence
  TRAC targeting sequence
ucuccucaaccuaacauuug

SEQ ID NO: 7722 - RNA, 20 nt, Artificial Sequence
  TRAC targeting sequence
ccucaaccuaacauuuguug

SEQ ID NO: 7723 - RNA, 20 nt, Artificial Sequence
  TRAC targeting sequence
ucaaccuaacauuuguugua

SEQ ID NO: 7724 - RNA, 20 nt, Artificial Sequence
  TRAC targeting sequence
accuaacauuuguuguaaga

SEQ ID NO: 7725 - RNA, 20 nt, Artificial Sequence
  TRAC targeting sequence
uacaacaaauguuagguuga

SEQ ID NO: 7726 - RNA, 20 nt, Artificial Sequence
  TRAC targeting sequence
aguuaagugccccaucccua

SEQ ID NO: 7727 - RNA, 20 nt, Artificial Sequence
  TRAC targeting sequence
cuacccucaagcuauugugu

SEQ ID NO: 7728 - RNA, 20 nt, Artificial Sequence
  TRAC targeting sequence
aacuuccaguuuauugagag

SEQ ID NO: 7729 - RNA, 20 nt, Artificial Sequence
  TRAC targeting sequence
aucaugaaggcagcuauuug

SEQ ID NO: 7730 - RNA, 20 nt, Artificial Sequence
  TRAC targeting sequence
ugaaggcagcuauuugucac

SEQ ID NO: 7731 - RNA, 20 nt, Artificial Sequence
  TRAC targeting sequence
ugauggaaaaucuaacuucc

SEQ ID NO: 7732 - RNA, 20 nt, Artificial Sequence
  TRAC targeting sequence
ccugccacccucuucucuug

SEQ ID NO: 7733 - RNA, 20 nt, Artificial Sequence
  TRAC targeting sequence
ucucuugcucugucucagcc

SEQ ID NO: 7734 - RNA, 20 nt, Artificial Sequence
  TRAC targeting sequence
cuugcucugucucagcccug

SEQ ID NO: 7735 - RNA, 20 nt, Artificial Sequence
  TRAC targeting sequence
ugcucugucucagcccugcc

SEQ ID NO: 7736 - RNA, 20 nt, Artificial Sequence
  TRAC targeting sequence
gucucagcccugcccuagua

SEQ ID NO: 7737 - RNA, 20 nt, Artificial Sequence
  TRAC targeting sequence
cagcccugcccuaguaucuc

SEQ ID NO: 7738 - RNA, 20 nt, Artificial Sequence
  TRAC targeting sequence
gcccugcccuaguaucucuu

SEQ ID NO: 7739 - RNA, 20 nt, Artificial Sequence
  TRAC targeting sequence
cuuggauggggauaucaccc

SEQ ID NO: 7740 - RNA, 20 nt, Artificial Sequence
  TRAC targeting sequence
ccauccaagagauacuaggg

SEQ ID NO: 7741 - RNA, 20 nt, Artificial Sequence
  TRAC targeting sequence
cccucacaucucuaucaagc

SEQ ID NO: 7742 - RNA, 20 nt, Artificial Sequence
  TRAC targeting sequence
caucucuaucaagcaguuca

SEQ ID NO: 7743 - RNA, 20 nt, Artificial Sequence
  TRAC targeting sequence
cuaucaagcaguucaacuau

SEQ ID NO: 7744 - RNA, 20 nt, Artificial Sequence
  TRAC targeting sequence
aucaagcaguucaacuauua

SEQ ID NO: 7745 - RNA, 20 nt, Artificial Sequence
  TRAC targeting sequence
agcaguucaacuauuauuag

SEQ ID NO: 7746 - RNA, 20 nt, Artificial Sequence
  TRAC targeting sequence
acuauuauuagcuucaaagg

SEQ ID NO: 7747 - RNA, 20 nt, Artificial Sequence
  TRAC targeting sequence
aagggaacugagacucugug

SEQ ID NO: 7748 - RNA, 20 nt, Artificial Sequence
  TRAC targeting sequence
cuuugaagcuaauaauaguu

SEQ ID NO: 7749 - RNA, 20 nt, Artificial Sequence
  TRAC targeting sequence
guucccuuugaagcuaauaa

SEQ ID NO: 7750 - RNA, 20 nt, Artificial Sequence
  TRAC targeting sequence
caguucccuuugaagcuaau

SEQ ID NO: 7751 - RNA, 20 nt, Artificial Sequence
  TRAC targeting sequence
guguacucagccccuugguc

SEQ ID NO: 7752 - RNA, 20 nt, Artificial Sequence
  TRAC targeting sequence
gccccuuggucucaucaaga

SEQ ID NO: 7753 - RNA, 20 nt, Artificial Sequence
  TRAC targeting sequence
caucaagagcagcuuuguag

SEQ ID NO: 7754 - RNA, 20 nt, Artificial Sequence
  TRAC targeting sequence
ucaagagcagcuuuguaguu

SEQ ID NO: 7755 - RNA, 20 nt, Artificial Sequence
  TRAC targeting sequence
agagcagcuuuguaguucuc

SEQ ID NO: 7756 - RNA, 20 nt, Artificial Sequence
  TRAC targeting sequence
ugaugagaccaaggggcuga

SEQ ID NO: 7757 - RNA, 20 nt, Artificial Sequence
  TRAC targeting sequence
cugagcuguggggucucuag

SEQ ID NO: 7758 - RNA, 20 nt, Artificial Sequence
  TRAC targeting sequence
gagcuguggggucucuaggc

SEQ ID NO: 7759 - RNA, 20 nt, Artificial Sequence
  TRAC targeting sequence
gagaacuacaaagcugcucu

SEQ ID NO: 7760 - RNA, 20 nt, Artificial Sequence
  TRAC targeting sequence
cuaggcugagaacugaggcu

SEQ ID NO: 7761 - RNA, 20 nt, Artificial Sequence
  TRAC targeting sequence
aggcugagaacugaggcugg

SEQ ID NO: 7762 - RNA, 20 nt, Artificial Sequence
  TRAC targeting sequence
gccuagagaccccacagcuc

SEQ ID NO: 7763 - RNA, 20 nt, Artificial Sequence
  TRAC targeting sequence
cagccuagagaccccacagc

SEQ ID NO: 7764 - RNA, 20 nt, Artificial Sequence
  TRAC targeting sequence
guucucagccuagagacccc

SEQ ID NO: 7765 - RNA, 20 nt, Artificial Sequence
  TRAC targeting sequence
ccagccucaguucucagccu

SEQ ID NO: 7766 - RNA, 20 nt, Artificial Sequence
  TRAC targeting sequence
gugcccugccuccccagccu

SEQ ID NO: 7767 - RNA, 20 nt, Artificial Sequence
  TRAC targeting sequence
ggccccagggccagcuccag

SEQ ID NO: 7768 - RNA, 20 nt, Artificial Sequence
  TRAC targeting sequence
aggcuaguuaccugugaggc

SEQ ID NO: 7769 - RNA, 20 nt, Artificial Sequence
  TRAC targeting sequence
cagguaacuagccuggagcu

SEQ ID NO: 7770 - RNA, 20 nt, Artificial Sequence
  TRAC targeting sequence
uaaugugcuccugggacacc

SEQ ID NO: 7771 - RNA, 20 nt, Artificial Sequence
  TRAC targeting sequence
ugggacacccgacagauguu

SEQ ID NO: 7772 - RNA, 20 nt, Artificial Sequence
  TRAC targeting sequence
caggagcacauuaugacagu

SEQ ID NO: 7773 - RNA, 20 nt, Artificial Sequence
  TRAC targeting sequence
ggugucccaggagcacauua

SEQ ID NO: 7774 - RNA, 20 nt, Artificial Sequence
  TRAC targeting sequence
gucgggugucccaggagcac

SEQ ID NO: 7775 - RNA, 20 nt, Artificial Sequence
  TRAC targeting sequence
gaacuggcaucaaacucuuc

SEQ ID NO: 7776 - RNA, 20 nt, Artificial Sequence
  TRAC targeting sequence
gaaaaacaucugucgggugu

SEQ ID NO: 7777 - RNA, 20 nt, Artificial Sequence
  TRAC targeting sequence
aacucuucguggagccccgu

SEQ ID NO: 7778 - RNA, 20 nt, Artificial Sequence
  TRAC targeting sequence
ucguggagccccgugaguug

SEQ ID NO: 7779 - RNA, 20 nt, Artificial Sequence
  TRAC targeting sequence
uggagccccgugaguugauc

SEQ ID NO: 7780 - RNA, 20 nt, Artificial Sequence
  TRAC targeting sequence
acgaagaguuugaugccagu

SEQ ID NO: 7781 - RNA, 20 nt, Artificial Sequence
  TRAC targeting sequence
cggggcuccacgaagaguuu

SEQ ID NO: 7782 - RNA, 20 nt, Artificial Sequence
  TRAC targeting sequence
acucacggggcuccacgaag

SEQ ID NO: 7783 - RNA, 20 nt, Artificial Sequence
  TRAC targeting sequence
uuuuccuauauuucugggau

SEQ ID NO: 7784 - RNA, 20 nt, Artificial Sequence
  TRAC targeting sequence
uauauuucugggauaauuug

SEQ ID NO: 7785 - RNA, 20 nt, Artificial Sequence
  TRAC targeting sequence
gggauaauuugaguccuggc

SEQ ID NO: 7786 - RNA, 20 nt, Artificial Sequence
  TRAC targeting sequence
cagaaauauaggaaaaagau

SEQ ID NO: 7787 - RNA, 20 nt, Artificial Sequence
  TRAC targeting sequence
aauuaucccagaaauauagg

SEQ ID NO: 7788 - RNA, 20 nt, Artificial Sequence
  TRAC targeting sequence
uggcacuggggcugcaaucc

SEQ ID NO: 7789 - RNA, 20 nt, Artificial Sequence
  TRAC targeting sequence
aguuugcauuauaaauuaua

SEQ ID NO: 7790 - RNA, 20 nt, Artificial Sequence
  TRAC targeting sequence
uuuacuaguuauaauuuaua

SEQ ID NO: 7791 - RNA, 20 nt, Artificial Sequence
  TRAC targeting sequence
uuguuauaauuucauuuacu

SEQ ID NO: 7792 - RNA, 20 nt, Artificial Sequence
  TRAC targeting sequence
ccuuguuauaauuucauuua

SEQ ID NO: 7793 - RNA, 20 nt, Artificial Sequence
  TRAC targeting sequence
gucuccuuguuauaauuuca

SEQ ID NO: 7794 - RNA, 20 nt, Artificial Sequence
  TRAC targeting sequence
cauauuggcagaaagucuug

SEQ ID NO: 7795 - RNA, 20 nt, Artificial Sequence
  TRAC targeting sequence
gccaauaugggauuuaacuu

SEQ ID NO: 7796 - RNA, 20 nt, Artificial Sequence
  TRAC targeting sequence
ugaaauucugagugacauuu

SEQ ID NO: 7797 - RNA, 20 nt, Artificial Sequence
  TRAC targeting sequence
agacuuucugccaauauggg

SEQ ID NO: 7798 - RNA, 20 nt, Artificial Sequence
  TRAC targeting sequence
gagugacauuuauuacaguu

SEQ ID NO: 7799 - RNA, 20 nt, Artificial Sequence
  TRAC targeting sequence
gaauuucaagacuuucugcc

SEQ ID NO: 7800 - RNA, 20 nt, Artificial Sequence
  TRAC targeting sequence
cucagaauuucaagacuuuc

SEQ ID NO: 7801 - RNA, 20 nt, Artificial Sequence
  TRAC targeting sequence
uaggggaucaguaggacuag

SEQ ID NO: 7802 - RNA, 20 nt, Artificial Sequence
  TRAC targeting sequence
ccuaagaauugcaacaacug

SEQ ID NO: 7803 - RNA, 20 nt, Artificial Sequence
  TRAC targeting sequence
guaggacuagcuaugagaau

SEQ ID NO: 7804 - RNA, 20 nt, Artificial Sequence
  TRAC targeting sequence
uacugauccccuaagaauug

SEQ ID NO: 7805 - RNA, 20 nt, Artificial Sequence
  TRAC targeting sequence
uagcuaguccuacugauccc

SEQ ID NO: 7806 - RNA, 20 nt, Artificial Sequence
  TRAC targeting sequence
cauagcuaguccuacugauc

SEQ ID NO: 7807 - RNA, 20 nt, Artificial Sequence
  TRAC targeting sequence
aaaacauaggugacuucuaa

SEQ ID NO: 7808 - RNA, 20 nt, Artificial Sequence
  TRAC targeting sequence
ccuauguuuuagauucucau

SEQ ID NO: 7809 - RNA, 20 nt, Artificial Sequence
  TRAC targeting sequence
aaguuuauaaauuaagaaag

SEQ ID NO: 7810 - RNA, 20 nt, Artificial Sequence
  TRAC targeting sequence
uaauuuauaaacuuagaagu

SEQ ID NO: 7811 - RNA, 20 nt, Artificial Sequence
  TRAC targeting sequence
uucuuaauuuauaaacuuag

SEQ ID NO: 7812 - RNA, 20 nt, Artificial Sequence
  TRAC targeting sequence
ggaaugguacacacuuuuuu

SEQ ID NO: 7813 - RNA, 20 nt, Artificial Sequence
  TRAC targeting sequence
ugaacagucuuucuuaauuu

SEQ ID NO: 7814 - RNA, 20 nt, Artificial Sequence
  TRAC targeting sequence
uaaaaagagaaagucugaca

SEQ ID NO: 7815 - RNA, 20 nt, Artificial Sequence
  TRAC targeting sequence
uuuuaugaacaccaauacau

SEQ ID NO: 7816 - RNA, 20 nt, Artificial Sequence
  TRAC targeting sequence
cuuuuuaugaacaccaauac

SEQ ID NO: 7817 - RNA, 20 nt, Artificial Sequence
  TRAC targeting sequence
gacaauaaagcaauuuucca

SEQ ID NO: 7818 - RNA, 20 nt, Artificial Sequence
  TRAC targeting sequence
gacuuucucuuuuuaugaac

SEQ ID NO: 7819 - RNA, 20 nt, Artificial Sequence
  TRAC targeting sequence
aaagaaauaacacuugaaac

SEQ ID NO: 7820 - RNA, 20 nt, Artificial Sequence
  TRAC targeting sequence
uuggaaaauugcuuuauugu

SEQ ID NO: 7821 - RNA, 20 nt, Artificial Sequence
  TRAC targeting sequence
aguguuauuucuuuggaaaa

SEQ ID NO: 7822 - RNA, 20 nt, Artificial Sequence
  TRAC targeting sequence
acaaauauaauuacauugca

SEQ ID NO: 7823 - RNA, 20 nt, Artificial Sequence
  TRAC targeting sequence
uaguccacaaauauaauuac

SEQ ID NO: 7824 - RNA, 20 nt, Artificial Sequence
  TRAC targeting sequence
uuuuuucuuaguccacaaau

SEQ ID NO: 7825 - RNA, 20 nt, Artificial Sequence
  TRAC targeting sequence
ucaaagauaaacgauuaaau

SEQ ID NO: 7826 - RNA, 20 nt, Artificial Sequence
  TRAC targeting sequence
aagauaaacgauuaaaucuu

SEQ ID NO: 7827 - RNA, 20 nt, Artificial Sequence
  TRAC targeting sequence
uugaagaacuuguagucuuu

SEQ ID NO: 7828 - RNA, 20 nt, Artificial Sequence
  TRAC targeting sequence
uuuaucuuugaagaacuugu

SEQ ID NO: 7829 - RNA, 20 nt, Artificial Sequence
  TRAC targeting sequence
uuaaucuaaauucuggacua

SEQ ID NO: 7830 - RNA, 20 nt, Artificial Sequence
  TRAC targeting sequence
aaauucuggacuacaauuuc

SEQ ID NO: 7831 - RNA, 20 nt, Artificial Sequence
  TRAC targeting sequence
ggacuacaauuucauacagc

SEQ ID NO: 7832 - RNA, 20 nt, Artificial Sequence
  TRAC targeting sequence
agaauuuagauuaaagauuu

SEQ ID NO: 7833 - RNA, 20 nt, Artificial Sequence
  TRAC targeting sequence
uacagcuucacgucuggguu

SEQ ID NO: 7834 - RNA, 20 nt, Artificial Sequence
  TRAC targeting sequence
cgucuggguuuaagucaaau

SEQ ID NO: 7835 - RNA, 20 nt, Artificial Sequence
  TRAC targeting sequence
ggguuuaagucaaauacaaa

SEQ ID NO: 7836 - RNA, 20 nt, Artificial Sequence
  TRAC targeting sequence
aaacgauuguuugaaagaaa

SEQ ID NO: 7837 - RNA, 20 nt, Artificial Sequence
  TRAC targeting sequence
acauuaauguuuauauuuuc

SEQ ID NO: 7838 - RNA, 20 nt, Artificial Sequence
  TRAC targeting sequence
uucuacauuaauguuuauau

SEQ ID NO: 7839 - RNA, 20 nt, Artificial Sequence
  TRAC targeting sequence
cucuuucuacauuaauguuu

SEQ ID NO: 7840 - RNA, 20 nt, Artificial Sequence
  TRAC targeting sequence
gaaaaauguuuuaucaaauc

SEQ ID NO: 7841 - RNA, 20 nt, Artificial Sequence
  TRAC targeting sequence
gaaucccucuuucuacauua

SEQ ID NO: 7842 - RNA, 20 nt, Artificial Sequence
  TRAC targeting sequence
aaucaauguauuaugcucua

SEQ ID NO: 7843 - RNA, 20 nt, Artificial Sequence
  TRAC targeting sequence
auguauuaugcucuaucuga

SEQ ID NO: 7844 - RNA, 20 nt, Artificial Sequence
  TRAC targeting sequence
aucugaaaugcugacuaaca

SEQ ID NO: 7845 - RNA, 20 nt, Artificial Sequence
  TRAC targeting sequence
gaaaugcugacuaacagagu

SEQ ID NO: 7846 - RNA, 20 nt, Artificial Sequence
  TRAC targeting sequence
gauagagcauaauacauuga

SEQ ID NO: 7847 - RNA, 20 nt, Artificial Sequence
  TRAC targeting sequence
gcauuucagauagagcauaa

SEQ ID NO: 7848 - RNA, 20 nt, Artificial Sequence
  TRAC targeting sequence
guuagucagcauuucagaua

SEQ ID NO: 7849 - RNA, 20 nt, Artificial Sequence
  TRAC targeting sequence
gagcacaauaucauaagugc

SEQ ID NO: 7850 - RNA, 20 nt, Artificial Sequence
  TRAC targeting sequence
gacucuguuagucagcauuu

SEQ ID NO: 7851 - RNA, 20 nt, Artificial Sequence
  TRAC targeting sequence
uaagugcaugaccuucuuca

SEQ ID NO: 7852 - RNA, 20 nt, Artificial Sequence
  TRAC targeting sequence
ugcacuuaugauauugugcu

SEQ ID NO: 7853 - RNA, 20 nt, Artificial Sequence
  TRAC targeting sequence
ucagacaucugucuuuucag

SEQ ID NO: 7854 - RNA, 20 nt, Artificial Sequence
  TRAC targeting sequence
gacaucugucuuuucaguua

SEQ ID NO: 7855 - RNA, 20 nt, Artificial Sequence
  TRAC targeting sequence
gaagaaggucaugcacuuau

SEQ ID NO: 7856 - RNA, 20 nt, Artificial Sequence
  TRAC targeting sequence
gucuuuucaguuauauugua

SEQ ID NO: 7857 - RNA, 20 nt, Artificial Sequence
  TRAC targeting sequence
uuucaguuauauuguauuau

SEQ ID NO: 7858 - RNA, 20 nt, Artificial Sequence
  TRAC targeting sequence
guuauauuguauuauucaaa

SEQ ID NO: 7859 - RNA, 20 nt, Artificial Sequence
  TRAC targeting sequence
aauuacucaaacccaaucuc

SEQ ID NO: 7860 - RNA, 20 nt, Artificial Sequence
  TRAC targeting sequence
aacccaaucuccccagccca

SEQ ID NO: 7861 - RNA, 20 nt, Artificial Sequence
  TRAC targeting sequence
ccccagcccaaagugaugau

SEQ ID NO: 7862 - RNA, 20 nt, Artificial Sequence
  TRAC targeting sequence
ccagcccaaagugaugauuu

SEQ ID NO: 7863 - RNA, 20 nt, Artificial Sequence
  TRAC targeting sequence
cuuugggcuggggagauugg

SEQ ID NO: 7864 - RNA, 20 nt, Artificial Sequence
  TRAC targeting sequence
ucacuuugggcuggggagau

SEQ ID NO: 7865 - RNA, 20 nt, Artificial Sequence
  TRAC targeting sequence
aaucaucacuuugggcuggg

SEQ ID NO: 7866 - RNA, 20 nt, Artificial Sequence
  TRAC targeting sequence
ggcaguugucaaaucaucac

SEQ ID NO: 7867 - RNA, 20 nt, Artificial Sequence
  TRAC targeting sequence
ucaggcaguugucaaaucau

SEQ ID NO: 7868 - RNA, 20 nt, Artificial Sequence
  TRAC targeting sequence
agcaagccuuaauuauccaa

SEQ ID NO: 7869 - RNA, 20 nt, Artificial Sequence
  TRAC targeting sequence
aacuaaaucagaccaggauu

SEQ ID NO: 7870 - RNA, 20 nt, Artificial Sequence
  TRAC targeting sequence
gaccaggauuaagagauacu

SEQ ID NO: 7871 - RNA, 20 nt, Artificial Sequence
  TRAC targeting sequence
gauuuaguuggauaauuaag

SEQ ID NO: 7872 - RNA, 20 nt, Artificial Sequence
  TRAC targeting sequence
uggucugauuuaguuggaua

SEQ ID NO: 7873 - RNA, 20 nt, Artificial Sequence
  TRAC targeting sequence
uaauccuggucugauuuagu

SEQ ID NO: 7874 - RNA, 20 nt, Artificial Sequence
  TRAC targeting sequence
cuuaauccuggucugauuua

SEQ ID NO: 7875 - RNA, 20 nt, Artificial Sequence
  TRAC targeting sequence
uaaauaaacaaggagauagg

SEQ ID NO: 7876 - RNA, 20 nt, Artificial Sequence
  TRAC targeting sequence
uuguuuauuuaagaguaucu

SEQ ID NO: 7877 - RNA, 20 nt, Artificial Sequence
  TRAC targeting sequence
ccuuguuuauuuaagaguau

SEQ ID NO: 7878 - RNA, 20 nt, Artificial Sequence
  TRAC targeting sequence
auaaaauaaacacccuaucu

SEQ ID NO: 7879 - RNA, 20 nt, Artificial Sequence
  TRAC targeting sequence
uuuguaacuuguaacucccu

SEQ ID NO: 7880 - RNA, 20 nt, Artificial Sequence
  TRAC targeting sequence
cuugaaagucagccagagua

SEQ ID NO: 7881 - RNA, 20 nt, Artificial Sequence
  TRAC targeting sequence
agggaguuacaaguuacaaa

SEQ ID NO: 7882 - RNA, 20 nt, Artificial Sequence
  TRAC targeting sequence
gccagaguaugucucaaacc

SEQ ID NO: 7883 - RNA, 20 nt, Artificial Sequence
  TRAC targeting sequence
ggcugacuuucaagggaguu

SEQ ID NO: 7884 - RNA, 20 nt, Artificial Sequence
  TRAC targeting sequence
caaaccaaagucaagauagu

SEQ ID NO: 7885 - RNA, 20 nt, Artificial Sequence
  TRAC targeting sequence
aaccaaagucaagauaguga

SEQ ID NO: 7886 - RNA, 20 nt, Artificial Sequence
  TRAC targeting sequence
agauagugagcaagaagugu

SEQ ID NO: 7887 - RNA, 20 nt, Artificial Sequence
  TRAC targeting sequence
ugacuuugguuugagacaua

SEQ ID NO: 7888 - RNA, 20 nt, Artificial Sequence
  TRAC targeting sequence
cuaucuugacuuugguuuga

SEQ ID NO: 7889 - RNA, 20 nt, Artificial Sequence
  TRAC targeting sequence
ugcucacuaucuugacuuug

SEQ ID NO: 7890 - RNA, 20 nt, Artificial Sequence
  TRAC targeting sequence
uaagugcaacacuucuugcu

SEQ ID NO: 7891 - RNA, 20 nt, Artificial Sequence
  TRAC targeting sequence
cuucauaagugcaacacuuc

SEQ ID NO: 7892 - RNA, 20 nt, Artificial Sequence
  TRAC targeting sequence
ccucccuucauaagugcaac

SEQ ID NO: 7893 - RNA, 20 nt, Artificial Sequence
  TRAC targeting sequence
cucaccucccuucauaagug

SEQ ID NO: 7894 - RNA, 20 nt, Artificial Sequence
  TRAC targeting sequence
aaccguuaaugcuagaguua

SEQ ID NO: 7895 - RNA, 20 nt, Artificial Sequence
  TRAC targeting sequence
agcauuaacgguuggaaacc

SEQ ID NO: 7896 - RNA, 20 nt, Artificial Sequence
  TRAC targeting sequence
cuuucuguuaucaaguggcu

SEQ ID NO: 7897 - RNA, 20 nt, Artificial Sequence
  TRAC targeting sequence
guuaucaaguggcuucagcu

SEQ ID NO: 7898 - RNA, 20 nt, Artificial Sequence
  TRAC targeting sequence
aguggcuucagcuaugcaag

SEQ ID NO: 7899 - RNA, 20 nt, Artificial Sequence
  TRAC targeting sequence
gcuaugcaaggaaaccaaac

SEQ ID NO: 7900 - RNA, 20 nt, Artificial Sequence
  TRAC targeting sequence
uugcauagcugaagccacuu

SEQ ID NO: 7901 - RNA, 20 nt, Artificial Sequence
  TRAC targeting sequence
ccuguuugguuuccuugcau

SEQ ID NO: 7902 - RNA, 20 nt, Artificial Sequence
  TRAC targeting sequence
caagcagguugaaagcaggu

SEQ ID NO: 7903 - RNA, 20 nt, Artificial Sequence
  TRAC targeting sequence
agcagguugaaagcagguuc

SEQ ID NO: 7904 - RNA, 20 nt, Artificial Sequence
  TRAC targeting sequence
accugcuugagaaaacuucc

SEQ ID NO: 7905 - RNA, 20 nt, Artificial Sequence
  TRAC targeting sequence
aagaaagcccuuugaaaaau

SEQ ID NO: 7906 - RNA, 20 nt, Artificial Sequence
  TRAC targeting sequence
uggaaccugcuuucaaccug

SEQ ID NO: 7907 - RNA, 20 nt, Artificial Sequence
  TRAC targeting sequence
aagggcuuucuuggaaccug

SEQ ID NO: 7908 - RNA, 20 nt, Artificial Sequence
  TRAC targeting sequence
aauccuuucaauugucuaga

SEQ ID NO: 7909 - RNA, 20 nt, Artificial Sequence
  TRAC targeting sequence
uuucaauugucuagaacuaa

SEQ ID NO: 7910 - RNA, 20 nt, Artificial Sequence
  TRAC targeting sequence
auugucuagaacuaaagcca

SEQ ID NO: 7911 - RNA, 20 nt, Artificial Sequence
  TRAC targeting sequence
uaagaaucugguuccuuaug

SEQ ID NO: 7912 - RNA, 20 nt, Artificial Sequence
  TRAC targeting sequence
ugcccugagugacugaaaca

SEQ ID NO: 7913 - RNA, 20 nt, Artificial Sequence
  TRAC targeting sequence
gggcaggaaacuuauuccua

SEQ ID NO: 7914 - RNA, 20 nt, Artificial Sequence
  TRAC targeting sequence
cucagggcaggaaacuuauu

SEQ ID NO: 7915 - RNA, 20 nt, Artificial Sequence
  TRAC targeting sequence
gucacucagggcaggaaacu

SEQ ID NO: 7916 - RNA, 20 nt, Artificial Sequence
  TRAC targeting sequence
guuucagucacucagggcag

SEQ ID NO: 7917 - RNA, 20 nt, Artificial Sequence
  TRAC targeting sequence
gucuuuuaguugagcuucuc

SEQ ID NO: 7918 - RNA, 20 nt, Artificial Sequence
  TRAC targeting sequence
uuuaguugagcuucucagca

SEQ ID NO: 7919 - RNA, 20 nt, Artificial Sequence
  TRAC targeting sequence
acuaaaagacugauucuguu

SEQ ID NO: 7920 - RNA, 20 nt, Artificial Sequence
  TRAC targeting sequence
cagcagaggaaacggggaga

SEQ ID NO: 7921 - RNA, 20 nt, Artificial Sequence
  TRAC targeting sequence
gcagaggaaacggggagaau

SEQ ID NO: 7922 - RNA, 20 nt, Artificial Sequence
  TRAC targeting sequence
gcugagaagcucaacuaaaa

SEQ ID NO: 7923 - RNA, 20 nt, Artificial Sequence
  TRAC targeting sequence
ucugcugagaagcucaacua

SEQ ID NO: 7924 - RNA, 20 nt, Artificial Sequence
  TRAC targeting sequence
ccguuuccucugcugagaag

SEQ ID NO: 7925 - RNA, 20 nt, Artificial Sequence
  TRAC targeting sequence
ccccguuuccucugcugaga

SEQ ID NO: 7926 - RNA, 20 nt, Artificial Sequence
  TRAC targeting sequence
uucuccccguuuccucugcu

SEQ ID NO: 7927 - RNA, 20 nt, Artificial Sequence
  TRAC targeting sequence
ucauucuccccguuuccucu

SEQ ID NO: 7928 - RNA, 20 nt, Artificial Sequence
  TRAC targeting sequence
cuaccaucaucauucucccc

SEQ ID NO: 7929 - RNA, 20 nt, Artificial Sequence
  TRAC targeting sequence
cugaauaguugauuuucuag

SEQ ID NO: 7930 - RNA, 20 nt, Artificial Sequence
  TRAC targeting sequence
gaauaguugauuuucuagga

SEQ ID NO: 7931 - RNA, 20 nt, Artificial Sequence
  TRAC targeting sequence
gagaaaccccccaucacuac

SEQ ID NO: 7932 - RNA, 20 nt, Artificial Sequence
  TRAC targeting sequence
acuauucagagaaacccccc

SEQ ID NO: 7933 - RNA, 20 nt, Artificial Sequence
  TRAC targeting sequence
aggaaaaccaugaucaacuu

SEQ ID NO: 7934 - RNA, 20 nt, Artificial Sequence
  TRAC targeting sequence
uagaaaaucaacuauucaga

SEQ ID NO: 7935 - RNA, 20 nt, Artificial Sequence
  TRAC targeting sequence
ugguuuuccuagaaaaucaa

SEQ ID NO: 7936 - RNA, 20 nt, Artificial Sequence
  TRAC targeting sequence
acuuugguccauuuacaaag

SEQ ID NO: 7937 - RNA, 20 nt, Artificial Sequence
  TRAC targeting sequence
gcugugagguucacagcagc

SEQ ID NO: 7938 - RNA, 20 nt, Artificial Sequence
  TRAC targeting sequence
gauucaggauaaagcauuag

SEQ ID NO: 7939 - RNA, 20 nt, Artificial Sequence
  TRAC targeting sequence
gaauuugggcuucagcugug

SEQ ID NO: 7940 - RNA, 20 nt, Artificial Sequence
  TRAC targeting sequence
ggauaaagcauuagaaaaau

SEQ ID NO: 7941 - RNA, 20 nt, Artificial Sequence
  TRAC targeting sequence
ugaaucugaauuugggcuuc

SEQ ID NO: 7942 - RNA, 20 nt, Artificial Sequence
  TRAC targeting sequence
aaugcuuuauccugaaucug

SEQ ID NO: 7943 - RNA, 20 nt, Artificial Sequence
  TRAC targeting sequence
guauaaaaauaaauaauuuu

SEQ ID NO: 7944 - RNA, 20 nt, Artificial Sequence
  TRAC targeting sequence
cuccaaccuggguggaaaag

SEQ ID NO: 7945 - RNA, 20 nt, Artificial Sequence
  TRAC targeting sequence
aaccuggguggaaaagaccc

SEQ ID NO: 7946 - RNA, 20 nt, Artificial Sequence
  TRAC targeting sequence
acccagguuggagugaagug

SEQ ID NO: 7947 - RNA, 20 nt, Artificial Sequence
  TRAC targeting sequence
uuuccacccagguuggagug

SEQ ID NO: 7948 - RNA, 20 nt, Artificial Sequence
  TRAC targeting sequence
caaaaaaaaaaaaaaaaaag

SEQ ID NO: 7949 - RNA, 20 nt, Artificial Sequence
  TRAC targeting sequence
aaaaaaaaaaaaaaaaagga

SEQ ID NO: 7950 - RNA, 20 nt, Artificial Sequence
  TRAC targeting sequence
uuuuuuuuuuuuuuuuuuga

SEQ ID NO: 7951 - RNA, 20 nt, Artificial Sequence
  TRAC targeting sequence
uuuuccuuuuuuuuuuuuuu

SEQ ID NO: 7952 - RNA, 20 nt, Artificial Sequence
  TRAC targeting sequence
auuuacacauucauuaccaa

SEQ ID NO: 7953 - RNA, 20 nt, Artificial Sequence
  TRAC targeting sequence
uuaccaacuuucuguucagc

SEQ ID NO: 7954 - RNA, 20 nt, Artificial Sequence
  TRAC targeting sequence
guucagcaacaccuaauguc

SEQ ID NO: 7955 - RNA, 20 nt, Artificial Sequence
  TRAC targeting sequence
gcaacaccuaaugucuugau

SEQ ID NO: 7956 - RNA, 20 nt, Artificial Sequence
  TRAC targeting sequence
agacauuagguguugcugaa

SEQ ID NO: 7957 - RNA, 20 nt, Artificial Sequence
  TRAC targeting sequence
auaaucaagacauuaggugu

SEQ ID NO: 7958 - RNA, 20 nt, Artificial Sequence
  TRAC targeting sequence
aguguacuuuuaccuacuau

SEQ ID NO: 7959 - RNA, 20 nt, Artificial Sequence
  TRAC targeting sequence
auguauuuuucauuugauau

SEQ ID NO: 7960 - RNA, 20 nt, Artificial Sequence
  TRAC targeting sequence
uuugauaucaagaagcaaaa

SEQ ID NO: 7961 - RNA, 20 nt, Artificial Sequence
  TRAC targeting sequence
aaugaaaaauacauugaauu

SEQ ID NO: 7962 - RNA, 20 nt, Artificial Sequence
  TRAC targeting sequence
agaagcaaaauucaccuaag

SEQ ID NO: 7963 - RNA, 20 nt, Artificial Sequence
  TRAC targeting sequence
ugauaucaaaugaaaaauac

SEQ ID NO: 7964 - RNA, 20 nt, Artificial Sequence
  TRAC targeting sequence
uguaaauuuggcccuuagua

SEQ ID NO: 7965 - RNA, 20 nt, Artificial Sequence
  TRAC targeting sequence
gcauuaaauuuaggauugaa

SEQ ID NO: 7966 - RNA, 20 nt, Artificial Sequence
  TRAC targeting sequence
uaaauuuaaugcugacuuuu

SEQ ID NO: 7967 - RNA, 20 nt, Artificial Sequence
  TRAC targeting sequence
auccuaaauuuaaugcugac

SEQ ID NO: 7968 - RNA, 20 nt, Artificial Sequence
  TRAC targeting sequence
ugaucaucauucacagguug

SEQ ID NO: 7969 - RNA, 20 nt, Artificial Sequence
  TRAC targeting sequence
ccauggacacaacauuuauc

SEQ ID NO: 7970 - RNA, 20 nt, Artificial Sequence
  TRAC targeting sequence
auggggacuuaaauucuuag

SEQ ID NO: 7971 - RNA, 20 nt, Artificial Sequence
  TRAC targeting sequence
caauucaaaaacuucaguga

SEQ ID NO: 7972 - RNA, 20 nt, Artificial Sequence
  TRAC targeting sequence
aaaacuucagugaggcacug

SEQ ID NO: 7973 - RNA, 20 nt, Artificial Sequence
  TRAC targeting sequence
gugaggcacugugugaaaga

SEQ ID NO: 7974 - RNA, 20 nt, Artificial Sequence
  TRAC targeting sequence
cugaaguuuuugaauuguga

SEQ ID NO: 7975 - RNA, 20 nt, Artificial Sequence
  TRAC targeting sequence
cacagugccucacugaaguu

SEQ ID NO: 7976 - RNA, 20 nt, Artificial Sequence
  TRAC targeting sequence
uucacacagugccucacuga

SEQ ID NO: 7977 - RNA, 20 nt, Artificial Sequence
  TRAC targeting sequence
ucacuaccucucucaaagcu

SEQ ID NO: 7978 - RNA, 20 nt, Artificial Sequence
  TRAC targeting sequence
cuaccucucucaaagcuuca

SEQ ID NO: 7979 - RNA, 20 nt, Artificial Sequence
  TRAC targeting sequence
cucaaagcuucaagacuugu

SEQ ID NO: 7980 - RNA, 20 nt, Artificial Sequence
  TRAC targeting sequence
caaagcuucaagacuugugg

SEQ ID NO: 7981 - RNA, 20 nt, Artificial Sequence
  TRAC targeting sequence
aagcuucaagacuugugguc

SEQ ID NO: 7982 - RNA, 20 nt, Artificial Sequence
  TRAC targeting sequence
agacuuguggucuuaaggaa

SEQ ID NO: 7983 - RNA, 20 nt, Artificial Sequence
  TRAC targeting sequence
ugaagcuuugagagagguag

SEQ ID NO: 7984 - RNA, 20 nt, Artificial Sequence
  TRAC targeting sequence
uaaggaaagaaaaguaugca

SEQ ID NO: 7985 - RNA, 20 nt, Artificial Sequence
  TRAC targeting sequence
uuaagaccacaagucuugaa

SEQ ID NO: 7986 - RNA, 20 nt, Artificial Sequence
  TRAC targeting sequence
uuccuuaagaccacaagucu

SEQ ID NO: 7987 - RNA, 20 nt, Artificial Sequence
  TRAC targeting sequence
aaagugaggcacaaaagaag

SEQ ID NO: 7988 - RNA, 20 nt, Artificial Sequence
  TRAC targeting sequence
uguuuuaaucuaagaggaac

SEQ ID NO: 7989 - RNA, 20 nt, Artificial Sequence
  TRAC targeting sequence
uucuuguuuuaaucuaagag

SEQ ID NO: 7990 - RNA, 20 nt, Artificial Sequence
  TRAC targeting sequence
auugguuuuauuucuuuaag

SEQ ID NO: 7991 - RNA, 20 nt, Artificial Sequence
  TRAC targeting sequence
uuaaggacuuccugaaaaug

SEQ ID NO: 7992 - RNA, 20 nt, Artificial Sequence
  TRAC targeting sequence
uuaaagaaauaaaaccaauu

SEQ ID NO: 7993 - RNA, 20 nt, Artificial Sequence
  TRAC targeting sequence
ugaaaaugaucauuguuauc

SEQ ID NO: 7994 - RNA, 20 nt, Artificial Sequence
  TRAC targeting sequence
ggaaguccuuaaagaaauaa

SEQ ID NO: 7995 - RNA, 20 nt, Artificial Sequence
  TRAC targeting sequence
uuuucaggaaguccuuaaag

SEQ ID NO: 7996 - RNA, 20 nt, Artificial Sequence
  TRAC targeting sequence
uuguuauccucugauuaaag

(The sequence listing continues in the following parts.)

What is claimed is:

1. A system comprising a CasX protein and a first guide nucleic acid (gNA), wherein the first gNA comprises a targeting sequence complementary to a target nucleic acid sequence of a gene encoding a first protein involved in antigen processing, antigen presentation, antigen recognition, and/or antigen response, wherein the first gNA has a scaffold comprising the sequence of SEQ ID NO: 2238, or a sequence having at least about 70% sequence identity thereto.

2. The system of claim 1, wherein the first protein is an immune cell surface marker or an immune checkpoint protein.

3. The system of claim 1, wherein the first protein is an intracellular protein.

4. The system of claim 1, wherein the first protein is selected from the group consisting of beta-2-microglobulin (B2M), T cell receptor alpha chain constant region (TRAC), class II major histocompatibility complex transactivator (CIITA), T cell receptor beta constant 1 (TRBC1), T cell receptor beta constant 2 (TRBC2), human leukocyte antigen A (HLA-A), human leukocyte antigen B (HLA-B), TGFβ Receptor 2 (TGFβRII), programmed cell death 1 (PD-1), cytokine inducible SH2 (CISH), lymphocyte activating 3 (LAG-3), T cell immunoreceptor with Ig and ITIM domains (TIGIT), adenosine A2a receptor (ADORA2A), killer cell lectin like receptor C1 (NKG2A), cytotoxic T-lymphocyte-associated protein 4 (CTLA-4), T-cell immunoglobulin and mucin domain 3 (TIM-3), and 2B4 (CD244).

5. The system of claim 1, further comprising a second gNA wherein the second gNA has a scaffold comprising the sequence of SEQ ID NO: 2238, or a sequence having at least about 70% sequence identity thereto, and wherein the second gNA comprises a targeting sequence complementary to a target nucleic acid sequence of an immune cell gene encoding a second protein selected from the group consisting of beta-2-microglobulin (B2M), T cell receptor alpha chain constant region (TRAC), class II major histocompatibility complex transactivator (CIITA), T cell receptor beta constant 1 (TRBC1), T cell receptor beta constant 2 (TRBC2), human leukocyte antigen A (HLA-A), human leukocyte antigen B (HLA-B), TGFβRII, PD-1, CISH, LAG-3, TIGIT, ADORA2A, NKG2A, CTLA-4, TIM-3, and CD244, wherein the second protein is different from the first protein.

6. The system of claim 5, wherein the first and/or the second gNA is a guide RNA (gRNA).

7. The system of claim 1, wherein the CasX protein comprises the sequence of SEQ ID NO: 138, or a sequence having at least about 90% sequence identity thereto.

8. The system of claim 1, wherein the CasX protein is a chimeric CasX protein comprising protein domains from two or more different CasX proteins.

9. The system of claim 1, wherein the CasX protein further comprises one or more nuclear localization signals (NLS).

10. The system of claim 1, wherein the CasX protein is capable of forming a ribonuclear protein complex (RNP) with the gNA and wherein an RNP of the CasX protein and the gNA exhibits at least one or more improved characteristics as compared to an RNP of a reference CasX protein of SEQ ID NO:2 and a reference gNA comprising a sequence of any one of SEQ ID NOS: 4-16, wherein the improved characteristics are selected from the group consisting of increased PAM versatility, increased editing activity; improved editing efficiency; and improved RNP stability.

11. The system of claim 10, wherein the RNP comprising the CasX protein and the gNA exhibits greater editing efficiency and/or binding of a target sequence in a cellular assay system comprising a protospacer on a target DNA strand complementary to the gNA and a non-target DNA strand with a PAM sequence, wherein any one of the PAM sequences TTC, ATC, GTC, or CTC is located 1 nucleotide 5' to the non-target strand of the protospacer, when compared to the editing efficiency and/or binding of an RNP comprising a reference CasX protein of SEQ ID NO:2 and a reference gNA comprising the sequence of any one of SEQ ID NOS: 4-16 in a comparable assay system.

12. The system of claim 1, further comprising a donor template nucleic acid.

13. A polynucleotide comprising a sequence that encodes the CasX protein and/or gNA of claim 1.

14. A vector comprising the polynucleotide of claim 13.

15. A method of modifying a target nucleic acid sequence of a gene in cells, wherein the gene encodes a protein involved in antigen processing, antigen presentation, antigen recognition, and/or antigen response, comprising introducing into each cell the system of claim 1 wherein the target nucleic acid sequence of the cells is modified by the CasX protein.

16. The method of claim 15, wherein the cells are modified by introduction of a polynucleotide encoding a chimeric antigen receptor (CAR) with binding affinity for a disease antigen, optionally a tumor cell antigen, and/or are modified by introduction of a polynucleotide encoding an engineered T cell receptor (TCR) comprising a binding domain with binding affinity for a disease antigen, optionally a tumor cell antigen.

17. The method of claim 16, wherein the tumor cell antigen is selected from the group consisting of Cluster of Differentiation 19 (CD19), cluster of differentiation 3 (CD3), CD3d molecule (CD3D), CD3g molecule (CD3G), CD3e molecule (CD3E), CD247 molecule (CD3Z), CD8a molecule (CD8), CD7 molecule (CD7), membrane metalloendopeptidase (CD10), membrane spanning 4-domains A1 (CD20), CD22 molecule (CD22), TNF receptor superfamily member 8 (CD30), C-type lectin domain family 12 member A (CLL1), CD33 molecule (CD33), CD34 molecule (CD34), CD38 molecule (CD38), integrin subunit alpha 2b (CD41), Indian blood group CD44 molecule (CD44), CD47 molecule (CD47), integrin alpha 6 (CD49f), neural cell adhesion molecule 1 (CD56), CD70 molecule (CD70), CD74 molecule (CD74), Xg blood group CD99 molecule (CD99), interleukin 3 receptor subunit/alpha (CD123), prominin 1 (CD133), syndecan 1 (CD138), carbonic anhydrase IX (CAIX), CC chemokine receptor 4 (CCR4), ADAM metallopeptidase domain 12 (ADAM12), adhesion G protein-coupled receptor E2 (ADGRE2), alkaline phosphatase placental-like 2 (ALPPL2), alpha 4 Integrin, angiopoietin-2 (ANG2), B-cell maturation antigen (BCMA), CD44V6, carcinoembryonic antigen (CEA), CEAC, CEA cell adhesion molecule 5 (CEACAMS), Claudin 6 (CLDN6), claudin 18 (CLDN18), C-type lectin domain family 12 member A (CLEC12A), mesenchymal-epithelial transition factor (CMET), cytotoxic T-lymphocyte-associated protein 4 (CTLA4), epidermal growth factor receptor 1 (EGFIR), epidermal growth factor receptor variant III (EGFRvIID), epithelial glycoprotein 2 (EGP-2), epithelial cell adhesion molecule (EGP-40 or EpCAM), EPH receptor A2 (EphA2), ectonucleotide pyrophosphatase/phosphodiesterase 3 (ENPP3), erb-b2 receptor tyrosine kinase 2 (ERBB2), erb-b2 receptor tyrosine kinase 3 (ERBB3), erb-b2 receptor tyrosine kinase 4 (ERBB4), folate binding protein (FBP), fetal nicotinic acetylcholine receptor (AChR), folate receptor alpha (FRalpha or FOLR1), G protein-coupled receptor 143 (GPR143), glutamate metabotropic receptor 8 (GRMS8), glypican-3 (GPC3), ganglioside GD2, ganglioside GD3, human epidermal growth factor receptor 1 (HER1), human epidermal growth factor receptor 2 (HER2), human epidermal growth factor receptor 3 (HER3), Integrin B7, intercellular cell-adhesion molecule-1 (CAM-1), human telomerase reverse transcriptase (hTERT), Interleukin-13 receptor a2 (IL-I13R-a2), K-light chain, Kinase insert domain receptor (KDR), Lewis-Y (LeY), chondromodulin-1 (LECT1), LI cell adhesion molecule (L1CAM), Lysophosphatidic acid receptor 3 (LPAR3), melanoma-associated antigen 1 (MAGE-A1), mesothelin (MSLN), mucin 1 (MUC1), mucin 16 (MUC16), melanoma-associated antigen 3 (MAGE-A3), tumor protein p53 (p53), Melanoma Antigen Recognized by T cells 1 (MART1), glycoprotein 100 (GPI100), Proteinase3 (PR1), ephrin-A receptor 2 (EphA2), Natural killer group 2D ligand (NKG2D ligand), New York esophageal squamous cell carcinoma 1 (NY-ESO-1), oncofetal antigen (h5T4), prostate-specific membrane antigen (PSMA), programmed death ligand 1 (PDL-1), receptor tyrosine kinase-like orphan receptor 1 (ROR1), trophoblast glycoprotein (TPBG), tumor-associated glycoprotein 72 (TAG-72), tumor-associated calcium signal transducer 2 (TROP-2), tyrosinase (TYR), survivin, vascular endothelial growth factor receptor 2 (VEGF-R2), Wilms tumor-1 (WT-1), leukocyte immunoglobulin-like receptor B2 (LILRB2), Preferentially Expressed Antigen In Melanoma (PRAME), T cell receptor beta constant 1 (TRBC1), TRBC2, and T-cell immunoglobulin mucin-3 (TIM-3).

18. The method of claim 17, wherein the CAR and/or the TCR comprises an antigen binding domain selected from the group consisting of a linear antibody, single domain antibody (sdAb), and single-chain variable fragment (scFv).

19. The method of claim 18, wherein the antigen binding domain is an scFv comprising variable heavy (VH) and variable light (VL) and/or heavy chain and light chain CDRs selected from the group consisting of the sequences set forth in SEQ ID NOs: 217-436, or comprising one or more amino acid modifications wherein the scFv retains binding affinity to the tumor antigen, and wherein the modification is selected from the group consisting of a substitution, deletion, and insertion.

20. The method of claim 15, wherein the cells are human cells.

21. The method of claim 15, wherein the cells are selected from the group consisting of progenitor cells, hematopoietic stem cells, and pluripotent stem cells.

22. The method of claim 15, wherein the cells are immune cells.

23. The method of claim 22, wherein the immune cells are selected from the group consisting of T cells, tumor infiltrating lymphocytes, NK cells, B cells, monocytes, macrophages, and dendritic cells.

24. The method of claim 23, wherein the T cells are selected from the group consisting of CD4+ T cells, CD8+ T cells, cytotoxic T cells, terminal effector T cells, memory T cells, naive T cells, regulatory T cells, natural killer T cells, gamma-delta T cells, cytokine-induced killer (CIK) T cells, tumor infiltrating lymphocytes, and a combination thereof.

25. The method of claim 15, wherein the modifying comprises introducing an insertion, deletion, substitution, duplication, or inversion of one or more nucleotides in the target nucleic acid sequence of the cells, resulting in a knock-down or knock-out of a gene in the cells of the population encoding one or more proteins selected from the group consisting of B2M, TRAC, CIITA, TRBC1, TRBC2, HLA-A, HLA-B, TGFBRII, PD-1, CISH, LAG3, TIGIT, ADORA2A, NKG2A, CTLA-4, TIM-3, and CD244, wherein the cells of the population have been modified such that at least about 50% of the cells do not express a detectable level of the one or more proteins in comparison to a cell that has not been modified.

26. The method of claim 15, wherein the method comprises insertion of a donor template into one or more break site(s) of the target nucleic acid sequence of the cells, wherein the insertion of the donor template is mediated by homology-directed repair (HDR) or homology-independent targeted integration (HITT).

27. The method of claim 26, wherein insertion of the donor template results in a knock-down or knock-out of one or more genes in the cells encoding one or more proteins selected from the group consisting of B2M, TRAC, CITA, TRBC1, TRBC2, HLA-A, HLA-B, TGFBRII, PD-1, CISH, LAG-3, TIGIT, ADORA2A, NKG2A, CTLA-4, TIM-3, and CD244.

28. The method of claim 15, wherein the method is conducted ex vivo on the population of cells.

29. The method of claim 15, wherein the method is conducted in vivo in a subject.

30. The method of claim 29, wherein the subject is a human or a non-human primate.

31. A population of cells modified ex vivo by the method of claim 15.

32. A method of providing anti-tumor immunity in a subject, the method comprising administering to the subject a therapeutically effective amount of the population of cells of claim 31.

33. The method of claim 32, wherein the administering of the therapeutically effective amount of the population of cells results in an improvement in a clinical parameter or endpoint in the subject selected from one or more of tumor shrinkage as a complete, partial or incomplete response; time-to-progression, time to treatment failure, biomarker response; progression-free survival; disease free-survival; time to recurrence; time to metastasis; time of overall survival; improvement of quality of life; and improvement of symptoms.

34. A method of treating a subject in need thereof, comprising administering to the subject a therapeutically effective amount of the population of cells of claim 31.

35. The method of claim 34, wherein the subject has cancer or an autoimmune disease.

36. The method of claim 35, wherein the cancer expresses a tumor cell antigen.

37. The method of claim 36, wherein the cells express a CAR, wherein the CAR has a specific binding affinity to the tumor cell antigen.

* * * * *